United States Patent 7,745,391 (HUMAN THROMBOSPONDIN POLYPEPTIDE) - sequence listing, part 226

SEQ ID NO: 591098 - DNA, 891 bp, Homo sapiens
aggaaacctttcacaacgcggattctcctagcttgaacgttctatcttctttagtcggttatcatggtaatgggagccatgctactggtttatttacaccagctggatggtttccttttaggcaagaaggaggtcatcagcaggctcccaacaataatgccgaagttaacaatgatgggcgaaaatgcaaacaacttggaacttgaagaaatggagcgtcttatggatgatagggcttgaagatgagagtggagaagatggaggtgaagatgccagtgcaattcaaaggcctggattaatggcttcagcttggtcttgttcatcaccaccttctgttacttcactaatagccagaggggcctccccaggcttcgccagattgagccttgataaatactgtgccagcctacaacggagggtctgacatctctagatttgtgcatactagaagacggtaattattgaaaaacagctgaagagaagaaatggctatcatgagaattgcgaatccagtcaatagactattagacatctgtgaaagcaacacacattagaggttcgggttggtgcaatgttcctttcttcccaggactattctggtcttccaaggcttttctcatgcagatcagaaggactgatggactgtagaagtttctgaagaggacgagttacgctgccatgttttgaagcaggaagacattaccacttctcaaaggtctttaattgcctgaccactgcttatctttggaagtctgtcagggtgatggaatctcagatcatcagcacagatataatggacaaagcaagaaagatacaagaatggactgtataaatgtccataagtgtactcatgtatcttgcggaaacctataatgcctatggaatggatta

SEQ ID NO: 591099 - DNA, 108 bp, Homo sapiens
acaaaaacggaaaattgcatactggtataagttcatttttctgctagcttataacagagtacctgaaactgggtactattacaaataaaagaaatttatttctataca

SEQ ID NO: 591100 - DNA, 308 bp, Homo sapiens
cgacgtagtcatcagaagaaatcaagagagagcacaccagattactgatgagtctctggaaggatacgaggagaatcctgggtaagccattgagtctcaggatgcaggactcaagaccatcactatgctggatgaccaaaaggaacaactaaaccgcatagaaaaaggcttggaccacataaataaggacctgagagagacagagaagacttgacagaactcaacaaatgctgtggcctttgtgtctgcccatgtcatagaacacagaactttgagtctggcagggcttattagacaacgcgtagtcg

SEQ ID NO: 591101 - DNA, 245 bp, Homo sapiens
cactagctccttcaactctgttaatccaatccagtaggcaactacaggggtactcactaacttgaaggcactggtaggttcgcagaaggaggccttctgagggctattttctgccttcactataggcaaaattcattttcacggcacctcatagcagaattccagtgcgtttaccacgcaagagctttgacgcttctagggtctcagaaggacttgcagagctcgattcgaattcgtgtttaata

SEQ ID NO: 591102 - DNA, 391 bp, Homo sapiens
ggcggttgggaaccgcgggccgtacggaagcgagaatgcccgttctgactcggtgggcgcctttcgttcgcgttgaaggccgccttttcaaaaccggttgcccacgaactgctgaaaagggggaagtccgcaatgccgcggggggggtgcacattgagccccggaataaacagttcccccagttgaccaaatcccaggggttccaaagcgagtttttcagggaactcagggggttctgaatcctctggcgcttttgccatgactcaaaaaaggcgctgggccactttccgaatcctgacccttcccagtgaccagatgaagaattaggaatccctcctgatgatgaaaactgaaggggtaaactcagcctaactcggacaagagccaggtg

SEQ ID NO: 591103 - DNA, 392 bp, Homo sapiens
  misc_feature (5)..(5): n is a, c, g, or t
  misc_feature (74)..(76): n is a, c, g, or t
  misc_feature (163)..(163): n is a, c, g, or t
  misc_feature (308)..(308): n is a, c, g, or t
  misc_feature (347)..(347): n is a, c, g, or t
  misc_feature (376)..(376): n is a, c, g, or t
gcttnactatcaattcgcgtaatctttatattgccccgggaagcagtatagccgtctttattccgagtcgcacnnngcacgtgcgcccttgtcgcatcacatacaatggcaatacatagggggagtagcaagtcaactactgttttcgcagttccgaccgctncaccagcaccaaaactgtcaacaccagtaaccatgggtgtaacaatggcaagtgccgcgactacctacaattcagcttcattataagtctctttcgcgggggcgtagtatttgacggtaatttcgtagttacattttgcattcancgagcccaaattttatttcacgacacggccggtatattnacctcgtgcaggaagaaaattttatcatncccgtataaaaaaaaa

SEQ ID NO: 591104 - DNA, 102 bp, Homo sapiens
ctcatagaggatccctgaacattcgtgtccatttatagtagagacaggttatgccatgtggccaggctggtctcaaactcttgacctcaggtgatccaccca

SEQ ID NO: 591105 - DNA, 400 bp, Homo sapiens
  misc_feature (27)..(27): n is a, c, g, or t
aatggataaaatgccttgaaggtgaanggataatcccaattatccttccatttggatccattaccacattaatatggttgtatcaaaaatttccacatgtccccccataaatatgtaaattattatgtagccataaaaatttaaaaagaccactttgggaggcagaggggggtggatcacttgagcccgggcattcaagactagcctgagcaacatggcaaaaccctgtctctacaaaatacaaaaaaaattaggcaggcatggtgatgtgcgcctttggttccagctcctgggcaggctgagatgggaggatgcttgagcctggggatgtcgacactgcagggagctgtgatcgtcccactccagcctcggcaacagagcaagaccctgtctcaaaaat

SEQ ID NO: 591106 - DNA, 495 bp, Homo sapiens
aaagctgaatatgagggcgatggagaacctactatctttgttgcagtggcaggcagaagtaacggcttgggtcctgtgatgtcaggaaacactgcttatccagtcattaactgtccccctgtaacccctgactggggagctcaggacatctggtcgtctcttcgcatgcctagtggtctgggctgctccactgttctttctcctgaagctgctgctcagtttgcagcgcagatcctgggtctaaacaaccatttgatttgggccaaacttcgggcatttaggttgaacacctgggtctccctgaaacagggtgataaaaagatgcaagattgcagcctttaataaaccatccctttttgcatttccaattgatatttttgggcacccagcagtcattgcctttgacaggccggtgtgaaatgctgacctagagtttgtttgcaataacaacatttcgagtgtgaatgtatatcaataaagcattcctcaagggca

SEQ ID NO: 591107 - DNA, 928 bp, Homo sapiens
gtgagctgagatcgtgccactgcacttcagcctgggcaaaaagagcgaaactccatctcaaaaaaaaaaaaaaaagaaaaaaaaaaatgggttgggtgaaagggttccaaatattaacaacccaatttcaagctcattcctctaacctcttcctgttggttattcttcagtagaccgaagttttaaattaagcatttatttagaaaaagaacgatcacagattggcccactccctcaaaagggttaattgtgacagaaatttctccacctgctcaaaaaagacagcagacatgatctcctttaaaaaaaaaaggttcaaaagagattagagatgaaaaataagatggggggagttaaagggccttatacttagaaaaccacaaaacataaaacagcacagagaaaatatagggctgggaggaaatacaacaatgggacaacagagcacttttgtcgcattaaagaaatttttctggatggcgtttaaaaagaatgggccgggtgcgggggctcacgcctgtaatcccagcatttggggaggccgaggcagacggaatcatgaggtcaggagatcgagaccatccaggctaacacagtgaaccccgtctctactaaaaatacaaacacattagctgggtgtgacgcgggtagagctactaggggaggctgaggcaggagaatgggtgaatccgggaggcggacgcttcaagtgagccgagatcgggcattggactccagctgccaccagagtgaactccggttccaaaaaaacaaaaaaaggggggggggcataaaattcccggagggccagtttcgcgtcccccgttttgcacaagggcctaaggggccaataaagcaggcggcgggtaaacgcggcgggaaagcccggtctggcagcccctgggtgcaggacccccagaaagcggaa

SEQ ID NO: 591108 - DNA, 244 bp, Homo sapiens
gcacacctggagccggtgtactgtattcagcagctgacagcatagcagcacgacatacaagcgggagatgagccttcaagcgctacgtaagaagaaagcaagccagaaatgtgccgggtttcaccgactactgtgacctgaacaaagacaaggtcatttcactgcctgagctgaagggctgctgggtgttagcaagaagaggacgctcgtctaaggagcagaaaacccaagggcaggtggagag

SEQ ID NO: 591109 - DNA, 277 bp, Homo sapiens
actttatgtatcccaacacacgacaaaaaacctactctggagaaaaattttcactgaaatataaccaaacttctataatgtggcttgtgacaagattataagatgatatgaaaaataacattttaaaatttgaccatcaactttaagatatggtctgcctatacgaatttatgtaatttttaaaagataatatattctaccctcatatggtcctcagaattaaagcataatggacaggaagaaaaaggaagagaatgcgattgagtgtagggcgata

SEQ ID NO: 591110 - DNA, 827 bp, Homo sapiens
atcaaagggacctgttcagggcgcccccctggttgtgaggggatctctctccccccgcggtttccgcttttttttgggagcgcccccgttgttaatgggaagaacattcttcgggtgcttttctttataaatattgggggtgtgaaaaacctctcttggtgcacgaattagctttttctctcgacagagtcttctgcgcctgtcgcacaggagacttcctcatcggggtaacccgggggagaaaaaacccgccgtctcccccgcggaatatttgccccccggataaccggggtaaaattctctcgcggaagaacaccccgcgggaccgcacacagaagaatgggagtatacgcccacgctggggacaaatgggtggaggaactcacctcgccaccactgggggacacaccctctctttgtgtccccggcccctctcacagggagaagttccccactcttttttataaaaaacgccccacaaagagggtcgctcttctccaacctcatgttctcccagagagaccacctctcccgccataaaagtaaaaagggtgttttttgggctcctccccttcgtgtgttttgcgccccgggaaaatacgcccgaccgcaccagtgttggcgcccacagtgggccccccttgggcgccggataagagccactttttgtttatttctcccgcataaagaaaaaatcttgtgaaatattttggccctttatatgtattcccccccttctccccccatttttttggaatcacgggagtgtttaaaaagagaaaaaaacaccattgttgtgtttctataaaaaacacaaaataaacaaa

SEQ ID NO: 591111 - DNA, 169 bp, Homo sapiens
ctcgtgccgcgcaggctgagggcaggtgggaagcaaacccggacgcatcgcagcagcagcagcagcagcagaagcagcagcagcagcctccgcagttccttccagagacattggttcccaagcaagaaccttcccggggcggttcttgctccttcttttcttcgcaacc

SEQ ID NO: 591112 - DNA, 1447 bp, Homo sapiens
ccctcacctaacgacatcctgctacaagtattctagagaggcggaggggaacgggcagaacgtgcttacggtactgattgtttgaagacctagtcgtgatgttgaaacgagacatcgatgctctccatggaatttcacagatgctatctggtctgtagctatcaagactgagtaataacggcactgtaaaacttcgttggcaaccaacgtcagtgacaagcgtatatgtcaacatgccacttagagggggacagaactgagataggctcgtgtcctatggtgcctaggtgaagaaggaccgagaactgcgttcctcttagcttgtgctgaggagttggacattaaacggctatggaccttgccgagactgatgttcgagtatctattgcagggtaagcactagcgcgccctctggaaaatatcgctggtagcgtgtggtctcatgggacttctggcacgtagtccaaagcgacggcacccattacctcgtgtcattaacctcacttcaatggtcatgcgctgacgtctcgcgtgtgatggtgtaatagaggataagccgagggggtcaagggggatagaacacggataaagttaaggtcactaggagaagctcacttcaggacaagctggcgctttaagtagggatgtttgcctttgggtgtgcgcttgcgagcttcgaatagacatggtctcagggtagaacgacactcggaacgcaaggtgtctaagtgtctgggacgcaccgtagtcattacacgagcaagtaaacacggcggacaaggcccggaaggtttctccacttgaaactcccttttttacccctcttctggtgtttcaccttggtgttaaatcccccttaaaaagttgcaccgtggttagtgggggactacttggaatctgggttaacgggggcacaacagcggaaatcaaataggaaaaaactagagccgacagcattacgcccacgggcacaaggctcacggaggggcacaagaacggcgtcccccaacgggcatcgcacccggtcggaccccgtgaacggccacggggggcacgcctacggggccaactcggaacagcggacttcgggcgccaacgccactaccaccacgttcttgccgagagcaaaaaaataaagaccgaacaccacatactaaggaacaaacatcgcgaggcagcgcccggcactgacaattgcagagaaatagcgcacagctcacacactgtccctctcctcccagccgctgccctgctccctccctcgttgagacagaaacgaccaaacaaaagaaacagacaaaagagaagacaagagcaaaaaggaagaaacaaagacgcaagcagaaagagaaggaaaagaaagcaagaagacaaacaaagacgcgaacaaaaaaaaaaacaaacagaagcaaaaagaaacgaaaagcagaagagcacgagagaaatg

SEQ ID NO: 591113 - DNA, 108 bp, Homo sapiens
ttgccaggagtcgttacagcctgggcacgtgaggatataccgtctctgcaaaaatttagaaacggtgggtcgggcatggatggcattgtcccatgtggatctcgagat

SEQ ID NO: 591114 - DNA, 960 bp, Homo sapiens
tccgggcgcggtggctcacgcctgtaatcccagcactttgggagggcgagggggcggatcaagaggtcaggagatcgagaccacgatgaaaccccgtctctactaaaaatacaaaaaaatttagccgggcgcggtggcgggcgcctgtagtcccagctgctggggaggctaacggcaggagaatggcgtgaacctgggaggctgagtgcaatggcaaaatctcaacctcaccgaaacctcccgcctcccgggttcaagcgattctcctgcctcagcctcccgagtagttgggattacaggcgcctgccttccatgcctggctacatcgtggtattgcttcgaaggacagagacggggtttcttacatgtagcggcagggctgcgtcttcaaacttccttaacctcgtacatccgcctgccttcgacctcgccaaaaggtgctgtgattacagcgcattgtgccaaccatgccccagcacaaaagatcagactggcgccatatacgactacagccccttcgtagcataatggtaacttggagcattcttagcagtagcacaaaaacacttccactacacacgatgtgttgctacaacattttagcccttacacacaatatactgaccggggtagaaaatagagtgtgtgcaacacagcacagggcaaggacttcggccaccgatggcaagggaggacctcggccactcaaatccaggcgagcgctatcaacgcatcccaagtacatgccgcgcacggaagccgagcgtgcacaagttaccgccccgcatgacggaggcatggaacaacgcgggcccaaatggaatgcccgtcgcacgaagaacgccgggcaagaaccagacgcgcaaccggaggcggctacaaaccacatcgcgaggccgggcaaatcgccctggaccccggaaacacacccccggggcgagcgccacgaaaaccctgagg

SEQ ID NO: 591115 - DNA, 652 bp, Homo sapiens
  misc_feature (652)..(652): n is a, c, g, or t
agttttcagtgatcagaagcagcagttatttgagtgtatgaagtggaatgatgatcactgtgctataatgtactgaaaccaccatattacagagagatatttactacatattttccatcttgtagtttctccagaaggcgctatgggaatttaagttgtgaacgtgtcaaaatccttgccataactttcctggtggaacaaccccgtgcccccaatttttcgttggttcctttttaattttaaaaccaaaggggtgcgtataaacggggtgggtaggaacctggttccaaacaaaacgtgggttttaaattggttttattgtcccaaagggtttaaaaaacacttaaagggaaaagggtttaaccgggaattaattttgtggggaaatttaaaatttttacaatttaactttgtcgcggctaaactttttcttcccaaaaacgccctagaagcgccccgtttaaacaccccaccctgtggctctaccacttgtgggctttttgcggaaatgtttgttcccccttcttccaaaaagccgggaaaaaattttggggacccaaccaactcttgggaccacacaggcgggcccaaaccggtattaaacccaaaacttttcgcgggcaccacacaggctttaaccttgggggcttcn

SEQ ID NO: 591116 - DNA, 254 bp, Homo sapiens
atgctgtagcgggaacgttgcttcatcatgcgttgctccggtgtggagtttggggctttagggaaagcctgggttgggtggagcagaaccatcttggagaacatacagttccctgtcctcccggagatgcctgggtgtgttaacagaggtgacacgtgtctgacaggagacgggagctctgattgtccacgggctggaagaagtgagtgtccactggctgaatgacagtgagttatgtttcacctgagactttc

SEQ ID NO: 591117 - DNA, 294 bp, Homo sapiens
aaagctgctcctggcaaggccgctgagaggcgagacttgatatggagtgctgcactggaagagacttcagacttacaaaggctgccaggagctgtccaggagccgagtcaaaagagtctctttggagtcaggagctgggcctgtagacacagttgctagagagtactgtgactgcagaagaggcacgcaggcagcaactgcgaggcgagaggccgacttgaggaatttctcgtcctcgagaggccaccaaaagggaaaagctgaacctaagtggccgttgtgagaaatgagctg

SEQ ID NO: 591118 - DNA, 1862 bp, Homo sapiens
  misc_feature (1514)..(1514): n is a, c, g, or t
gaatgtactcctacgacgctagtacacctatcatagaggagcttcatgacctgacatgatcacggcctcaatgactcaataatttcctatatgtcgcttccttagatccctggtatgtcctctattcctaatactccactacgcaacacactagaatgaatgactaaaccaatgctactagacgtctacggcgagctagcagaactgccatgaatctattccttagactccggctcaatccttctcttcagtccatcatatacgtcctctgcgcaatacactcgtaacgccaataccgttatatcacatcacaccagaacgaagtgatctacaatgccatctcacatcacacttctatacaccaagcgacaaaatcaacatatagtgacacaaacctcaagaggagatcaacgtgcgcacacgctttacagacagtttcactgagcaggataacctaactgcaggggttgtacaccctccaaatgcgtttcacacaacgctctcgtgacacttattcctggtcggccccctggcaatattcattttcctctaagcaatagccacagagacagaaacccttagggcgccaacgctcaattctttagaacaagctccatatacatcaacactcaaggaatgctatacggtacaccttataccacaaggtacataatcgccagattgaccacgcccccttattactccgctttactcaacattcataactttcaaaccattccttatacattacgcaaaagtgctacattataggcgcaacgggcccaaagtctgtaaggaacgtggttcgccgcactctacaaccgaaatctccaaggaggccttctccacaaggaacataaccacaggccaaatcgggccagataaccttatccgccgccgggagtaatacacgtttcccctttaacagaaactctaaaggaaccccaaccgatttgacgccgacactcgtacttttaaacgcacttacggaaccccacacgtgtgtgcggtcgaacaccacctggatctgctaacagacagggcctccgtaacaatcggagtaacctctggccacatattccttatggataggtgtattgcaccgacaataaacgtcgtaatgcagtgaagtttctaactatctcggtacgccacagtttaccgggttaaaccccgtgagaatatttcctcagataatgcttaaccgcgttctaacacacatataacatcgacatcttatggcacaggccttaacggcggagccccaccgggatcaattaatgtatacacgactaatatacatacacgggcaacacccgattgctataatacgtaataaaacggccagtcataccgtataattgaaagcctcaaaagcaaaccagccgacctattcacagattcatccacaacttgaccaacagcagcaccaataccacatcagtgaccacccgacttaggcggaacgaggtccatcatagagtcacacaccacgcacctatagagacgcaggnggcggcaatcaccaatagggggacccccacagacaaatggctggacccccgccaagcaaccttacgccaagagcgaacgacactagaaacagtcagggaacaccaccaccacaactaaagagagcaactgaggctagatatcaccaccaaaccgcagccacgaaagagctgcgtcgccgcgacaccctcccacataagaggcttcgtcaacacgtgcagcccagagacccatacaagatagtgagcacaaccatgcgagacacagccgaacatgactccacacgaatctgtctaagagacacaacaaatagacaacaacactcgccaaccacgaaatcaaacaacgcc

SEQ ID NO: 591119 - DNA, 139 bp, Homo sapiens
cagctcggtaccttccttttctactgatatcttcttcctttagagcaaacttctccttaggacctcagagataagcacagcaggctcttcctccttcaataaactccggttgcttcctgcttctgcccctctcatgtct

SEQ ID NO: 591120 - DNA, 296 bp, Homo sapiens
  misc_feature (105)..(105): n is a, c, g, or t
attggatcccctttcttcctgaaaatgaagagtttaaagcttacgttagtattgtaatatgtaaagtaagccccccaaaaatttttaaaatttgatgatcccccnatattcccccttgtatgttaaataaatccccatttttgtagaaaaaattccccctgagagtaattgtcaatgagtacatgggtataagttgtatccccctccccccccttttattttttccagtggttttttgttaatgtagtgttttttccaagttaatcattaaatttgttagatcttgttatgggcta

SEQ ID NO: 591121 - DNA, 395 bp, Homo sapiens
  misc_feature (167)..(167): n is a, c, g, or t
agctggacctcacatgtggtaccccgcgtacgtagtttggctggtttcaaataagttattacaaaacaaaggggatgtgttgaagtggggatccgtgcacgttaacgattactaggactatgcagaaaccagagagtttaagaataccgcactcttaacctctcttntatcgtgccggttgctatttgagatttgccaggggagccattagtgagtgcattcactctaattaagcgaagcgcactcagcccgcaaacctgacgggtttccagacgagcctgcagctaattagttacggccttcgcgcggggtgtggcggaaagcgataagggcgcacaaccgcaaccacgcactcagtcacgcagcgcacggacgaacggcagcggggtgcggat

SEQ ID NO: 591122 - DNA, 4678 bp, Homo sapiens
  misc_feature (32)..(33): n is a, c, g, or t
  misc_feature (677)..(677): n is a, c, g, or t
tttaaagatggcacagaatatatataatatgnnccattagtgaattttgggttataaagacccaaaatgcgctataatgtattatgtactgtaattttaatcccttgaactatatggtacggcatgattttacagtggacatcttgatatggtatacacattaaactattatgtggaattaaatagtagctcttcaagtgaagtaagtataaatgtcaacgaccatcttttaaggaattttggatcaccgtaacacattttacacattgttaatcgctacccctgggattgtttaaactgtttcgtcatggagccacaaaagtttgaaatcctcctagtaagatactttgcatcttgtttgcagtctgttcagggagaactagtgaaaggctgtagtatatttggactagaaagtaactgaatctcaaaccaggtagtgtggagataccccctccatgaattacattcttcattccagggtaggtaatacacagaaacatgttactttacctgttgccaaggcctttgaaaaatctacttttacaaaattggaaaacgtcacttgtagtcaaagccattgccagtcattgattttaatgttgtaagattgcttataggacatttaatttaggaagaaatgatcatacgtctatgagagggtactaggaaaagcttanaaatttcaagggctctgtttattctgttacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggagctacgccttccacaaatccatttgttgctgctgctggtccttctgtggcatcttctacaaacccatttcagaccaatgccagaggagcaacagcggcaacctttggcactgcatccatgagcatgcccacgggattcggcactcctgctccctacagtcttcccaccagctttagtggcagctttcagcagcctgcctttccagcccaagcagctttccctcaacagacagctttttctcaacagcccaatggtgcaggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacatctctccacctcttgcactgttgtcttgtttcactgatcttagctttaaacacaagagaagtctttaaaaagcctgcattgtgtattaaacaccaggtaatatgtgcaaaaccgagggctccagtaacaccttctaacctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatgacctaaaatcattttaaccattgctactggaaagtaacagagtcaaaattggaaggttttattcattcttgaatttttcctttctaaagagctcttctatttatacatgcctaaattcttttaaaatgtagagggatacctgtctgcataataaagctgatcatgttttgctacagtttgcaggtgaaaaaaaataaatattataaaatatgctattgtttttgtgttcttgctgcaatgcctttaccaaagtggccttaaatatgagtagtgaattgagaacatcttgaattcttaaaagacttcttagtgactttttataaaaaggccatgtagaaaatttattaaaactactatgactgctacattcaggaatatgccagtggtaaagcatttaaatgtagcttgtcagatttaccataatcctactaatttctttgcagcttattaattttgtgaaatttgtatatatgaagaatttgcatgtatgtgtatttacaaatttttctaagtatcttgaattctcagactgcaaaaggcctattttaactattgattttttttaaaaaaaattgtctttgaatgtattggaagtagacatgcattaactgtgacattattgcacctcagtttttttctttctttttttgggcaaactgatattatctataggatatttgtttatgtttgttttttgggggaaagaaactggaactcagtgttaccttaaagttacggaatactttgttttaaaggaaaagataataagtttagttatatctttttgttaatattcaaatgaacttgtttaagtatctatgtacagtaatgcctcattcatctagaggtaatctggcagtcttgtgaaaaccgaacacaactcagaaacttggaatcgttttttttaaaaatgcctctgagcaacccatataagtcacaaagtctgtgtgttagagcttatgcatttgtttttatgagagattttaataaatttaattatttgcttgtccagactatagcatattagctgtttagaagggatggcttgaaaggaaggagactgaaaaacactctgagagcatacactgtccaaggccattagtgtaaggaccgctacccagcctagaggacatcactatactacatcatctgatgattattctttattatgcctctaggtaattaagtaaaggtgaaattgcatacacagatatgtagtacatattttaaaagttttatcttaaattgattaaaactttttaaaaagctttggtattaaaagaggtaaacatcagtttcctcaaacattttattcatgttgaatgcctttttgcaatgatgactgagttgttatcatagtattttaaaacctgtatagtgttttagacttgttaaaacattgctgtctagtgtacatctagctaaaagtgtggtttatctaaaccgttttaataagcaagatgactgggaaatctctgccccttttctgagcagtatgcctcttcttttagaattaaatgaatgctgcacaggtccagatgtgtgttgatgtagacttgaaatgtctccacattttggaggacttcctcagcccttttcattgagggaaaatatatttgaatttctgttttagattgtatcgggtcccagttgattcatgtgtacaaagttatgctacctaattacagaccattacccaaatatcctaccaggctttccatctgaatagtaaattaaacagttgttatcaaaatgattttaaagactatttctttttctgggtaactattgaagtttgtaattaaatgggggctcttactgactttaaattagcgcttataaaataaaaatgtttagttcaagaagagacccaagctgggtatggtggtgtgagagcctgtgagtcctagctacctggaggtgaggtgggaacatcacttgagcccaggagttggaggctgcagtgcgctacgatcacaccactgcacaccagcctggggatagagtgagatcccatctctaaaaaatgaaaaaaagaagagaggtagctttaaagtggtttttctcatgatattcactgtttattattaaagaaaatcagctttcgttagacttttacatttagatttattcttagttttatatagaccatcaaaattatgttgagtactaaaaaggagaaaaaatcctggaaggtaacaaggctgaagaccttcaaatttcctggcttactggtttagtcacatcatttttcctgttcaggtatctgcagatatccctgttcaggaaagatcttttttcaggatggcaaacttttgacatagtttaaagacattttttccccattttttgaaatagagaatattttattatttttgtgaaaatagagttttggtaatcactttcttcctcaaaataagtccttctgttaatttgtaaaagcacattagtgctttacctgtgaaattccccgcccccctgcacacacacccactttagtacagttcctgtcaattggcaacatggagagggtgacctggctgctggtttaccactgtaccaacatctctggagcattttagtttcagaaccttaacactccccaacagctttgttgatgtagcttgtatctctgagaatttattgtattaaaattaatactgagatatttttaaaa

SEQ ID NO: 591123 - DNA, 270 bp, Homo sapiens
ggtcaatgtggtggactcaggctcattggcagaagaacggagactacttgtgtgtgaagtagataggactccgaaagccaccaggtgttgtcacaaattttgaaatttccgaatgaggagacacaggtactgtgatgtggcgagatgaagagacatcatagctttgctggaaccaatgaagtagtttgctgtgctgcacggagaggtccgcggatatctgtgtctttctaccacgtcaaaaacaacgggaagattgaaccggatagcttg

SEQ ID NO: 591124 - DNA, 4190 bp, Homo sapiens
ccaagcagtcaggacttaggcgtcgaaagaatcagggctaccccaccacaagcaagagtcagcctctccatatttctccttttagctctgcgcagcagcacctatcccttctttgaaagagcatctcaggaaaaggggtcaatcccttttgattaataacaacaaatcctttatctgaatccccacagcaagtcactctccttttcagccccaaactacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggagctacgccttccacaaatccatttgttgctgctgctggtccttctgtggcatcttctacaaacccatttcagaccaatgccagaggagcaacagcggcaacctttggcactgcatccatgagcatgcccacgggattcggcactcctgctccctacagtcttcccaccagctttagtggcagctttcagcagcctgcctttccagcccaagcagctttccctcaacagacagctttttctcaacagcccaatggtgcaggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacatctctccacctcttgcactgttgtcttgtttcactgatcttagctttaaacacaagagaagtctttaaaaagcctgcattgtgtattaaacaccaggtaatatgtgcaaaaccgagggctccagtaacaccttctaacctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatgacctaaaatcattttaaccattgctactggaaagtaacagagtcaaaattggaaggttttattcattcttgaatttttcctttctaaagagctcttctatttatacatgcctaaattcttttaaaatgtagagggatacctgtctgcataataaagctgatcatgttttgctacagtttgcaggtgaaaaaaaataaatattataaaatatgctattgtttttgtgttcttgctgcaatgcctttaccaaagtggccttaaatatgagtagtgaattgagaacatcttgaattcttaaaagacttcttagtgactttttataaaaaggccatgtagaaaatttattaaaactactatgactgctacattcaggaatatgccagtggtaaagcatttaaatgtagcttgtcagatttaccataatcctactaatttctttgcagcttattaattttgtgaaatttgtatatatgaagaatttgcatgtatgtgtatttacaaatttttctaagtatcttgaattctcagactgcaaaaggcctattttaactattgattttttttaaaaaaaattgtctttgaatgtattggaagtagacatgcattaactgtgacattattgcacctcagtttttttctttctttttttgggcaaactgatattatctataggatatttgtttatgtttgttttttgggggaaagaaactggaactcagtgttaccttaaagttacggaatactttgttttaaaggaaaagataataagtttagttatatctttttgttaatattcaaatgaacttgtttaagtatctatgtacagtaatgcctcattcatctagaggtaatctggcagtcttgtgaaaaccgaacacaactcagaaacttggaatcgttttttttaaaaatgcctctgagcaacccatataagtcacaaagtctgtgtgttagagcttatgcatttgtttttatgagagattttaataaatttaattatttgcttgtccagactatagcatattagctgtttagaagggatggcttgaaaggaaggagactgaaaaacactctgagagcatacactgtccaaggccattagtgtaaggaccgctacccagcctagaggacatcactatactacatcatctgatgattattctttattatgcctctaggtaattaagtaaaggtgaaattgcatacacagatatgtagtacatattttaaaagttttatcttaaattgattaaaactttttaaaaagctttggtattaaaagaggtaaacatcagtttcctcaaacattttattcatgttgaatgcctttttgcaatgatgactgagttgttatcatagtattttaaaacctgtatagtgttttagacttgttaaaacattgctgtctagtgtacatctagctaaaagtgtggtttatctaaaccgttttaataagcaagatgactgggaaatctctgccccttttctgagcagtatgcctcttcttttagaattaaatgaatgctgcacaggtccagatgtgtgttgatgtagacttgaaatgtctccacattttggaggacttcctcagcccttttcattgagggaaaatatatttgaatttctgttttagattgtatcgggtcccagttgattcatgtgtacaaagttatgctacctaattacagaccattacccaaatatcctaccaggctttccatctgaatagtaaattaaacagttgttatcaaaatgattttaaagactatttctttttctgggtaactattgaagtttgtaattaaatgggggctcttactgactttaaattagcgcttataaaataaaaatgtttagttcaagaagagacccaagctgggtatggtggtgtgagagcctgtgagtcctagctacctggaggtgaggtgggaacatcacttgagcccaggagttggaggctgcagtgcgctacgatcacaccactgcacaccagcctggggatagagtgagatcccatctctaaaaaatgaaaaaaagaagagaggtagctttaaagtggtttttctcatgatattcactgtttattattaaagaaaatcagctttcgttagacttttacatttagatttattcttagttttatatagaccatcaaaattatgttgagtactaaaaaggagaaaaaatcctggaaggtaacaaggctgaagaccttcaaatttcctggcttactggtttagtcacatcatttttcctgttcaggtatctgcagatatccctgttcaggaaagatcttttttcaggatggcaaacttttgacatagtttaaagacattttttccccattttttgaaatagagaatattttattatttttgtgaaaatagagttttggtaatcactttcttcctcaaaataagtccttctgttaatttgtaaaagcacattagtgctttacctgtgaaattccccgcccccctgcacacacacccactttagtacagttcctgtcaattggcaacatggagagggtgacctggctgctggtttaccactgtaccaacatctctggagcattttagtttcagaaccttaacactccccaacagctttgttgatgtagcttgtatctctgagaatttattgtattaaaattaatactgagatatttttaaaa

SEQ ID NO: 591125 - DNA, 135 bp, Homo sapiens
ggagacacccatatctataccaaacaccatatactgataaatacggtcacccatgaagtttatattcttatcactaccaggcttcggaataatctacccatattgtaacttacctactccgagcacaaaagaacc

SEQ ID NO: 591126 - DNA, 144 bp, Homo sapiens
ttccccccccctggggtttataattttggggttaaccaggggtgggaaaggccccgtcggggaaaattgaaccccgcgggcacccctaggaaataaacgggagggttcccaattttgggattgggattatattgttttttatta

SEQ ID NO: 591127 - DNA, 3585 bp, Homo sapiens
cacctgaagccgcatgcaggtggctgattgttactcctgatccgtccaataacatgctgattctggtgtcgcctgatccatttggaagtacgccttccacaaatccatttgttgctgctgctggtccttctgtggcatcttctacaaacccatttcagaccaatgccagaggagcaacagcggcaacctttggcactgcatccatgagcatgcccacgggattcggcactcctgctccctacagtcttcccaccagctttagtggcagctttcagcagcctgcctttccagcccaagcagctttccctcaacagacagctttttctcaacagcccaatggtgcaggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacatctctccacctcttgcactgttgtcttgtttcactgatcttagctttaaacacaagagaagtctttaaaaagcctgcattgtgtattaaacaccaggtaatatgtgcaaaaccgagggctccagtaacaccttctaacctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatgacctaaaatcattttaaccattgctactggaaagtaacagagtcaaaattggaaggttttattcattcttgaatttttcctttctaaagagctcttctatttatacatgcctaaattcttttaaaatgtagagggatacctgtctgcataataaagctgatcatgttttgctacagtttgcaggtgaaaaaaaataaatattataaaatatgctattgtttttgtgttcttgctgcaatgcctttaccaaagtggccttaaatatgagtagtgaattgagaacatcttgaattcttaaaagacttcttagtgactttttataaaaaggccatgtagaaaatttattaaaactactatgactgctacattcaggaatatgccagtggtaaagcatttaaatgtagcttgtcagatttaccataatcctactaatttctttgcagcttattaattttgtgaaatttgtatatatgaagaatttgcatgtatgtgtatttacaaatttttctaagtatcttgaattctcagactgcaaaaggcctattttaactattgattttttttaaaaaaaattgtctttgaatgtattggaagtagacatgcattaactgtgacattattgcacctcagtttttttctttctttttttgggcaaactgatattatctataggatatttgtttatgtttgttttttgggggaaagaaactggaactcagtgttaccttaaagttacggaatactttgttttaaaggaaaagataataagtttagttatatctttttgttaatattcaaatgaacttgtttaagtatctatgtacagtaatgcctcattcatctagaggtaatctggcagtcttgtgaaaaccgaacacaactcagaaacttggaatcgttttttttaaaaatgcctctgagcaacccatataagtcacaaagtctgtgtgttagagcttatgcatttgtttttatgagagattttaataaatttaattatttgcttgtccagactatagcatattagctgtttagaagggatggcttgaaaggaaggagactgaaaaacactctgagagcatacactgtccaaggccattagtgtaaggaccgctacccagcctagaggacatcactatactacatcatctgatgattattctttattatgcctctaggtaattaagtaaaggtgaaattgcatacacagatatgtagtacatattttaaaagttttatcttaaattgattaaaactttttaaaaagctttggtattaaaagaggtaaacatcagtttcctcaaacattttattcatgttgaatgcctttttgcaatgatgactgagttgttatcatagtattttaaaacctgtatagtgttttagacttgttaaaacattgctgtctagtgtacatctagctaaaagtgtggtttatctaaaccgttttaataagcaagatgactgggaaatctctgccccttttctgagcagtatgcctcttcttttagaattaaatgaatgctgcacaggtccagatgtgtgttgatgtagacttgaaatgtctccacattttggaggacttcctcagcccttttcattgagggaaaatatatttgaatttctgttttagattgtatcgggtcccagttgattcatgtgtacaaagttatgctacctaattacagaccattacccaaatatcctaccaggctttccatctgaatagtaaattaaacagttgttatcaaaatgattttaaagactatttctttttctgggtaactattgaagtttgtaattaaatgggggctcttactgactttaaattagcgcttataaaataaaaatgtttagttcaagaagagacccaagctgggtatggtggtgtgagagcctgtgagtcctagctacctggaggtgaggtgggaacatcacttgagcccaggagttggaggctgcagtgcgctacgatcacaccactgcacaccagcctggggatagagtgagatcccatctctaaaaaatgaaaaaaagaagagaggtagctttaaagtggtttttctcatgatattcactgtttattattaaagaaaatcagctttcgttagacttttacatttagatttattcttagttttatatagaccatcaaaattatgttgagtactaaaaaggagaaaaaatcctggaaggtaacaaggctgaagaccttcaaatttcctggcttactggtttagtcacatcatttttcctgttcaggtatctgcagatatccctgttcaggaaagatcttttttcaggatggcaaacttttgacatagtttaaagacattttttccccattttttgaaatagagaatattttattatttttgtgaaaatagagttttggtaatcactttcttcctcaaaataagtccttctgttaatttgtaaaagcacattagtgctttacctgtgaaattccccgcccccctgcacacacacccactttagtacagttcctgtcaattggcaacatggagagggtgacctggctgctggtttaccactgtaccaacatctctggagcattttagtttcagaaccttaacactccccaacagctttgttgatgtagcttgtatctctgagaatttattgtattaaaattaatactgagatatttttaaaa

SEQ ID NO: 591128 - DNA, 585 bp, Homo sapiens
ggctttagcaatacagtacaaaaaaataaccaccataattataccaaattcctctaaatcactgcatactatgtgtattaaatacaatttcgaccgtataaaaatactgagaaaaattgataaataacaggtaagagaaagatatttctaggcaataactaggatcatttggaacgagtgagtactgtggatatttaaaatatcacagtaagaagatcatgcttgtacctacagtaatgcgggccagacacttaagtaacagcagaagtggaggggagactttcctacttaaaattggtggtcatatcattacaaaacatttgcatcttggttggctacatatgctttcttattgatcccaaaccaaatctaagaatcacttcatttaaaatacggagcgttattgaatacttcgaagcacaagaggcaatgtgcagccctcatttatgagacactcctcaggaaactcccagggtgatgcttggagaagctgtgagttgagctgaagctggagaacttcctccagaacaaggggcttaagaaagaaagacgaactctaaggtgggtctgataacttcactccag

SEQ ID NO: 591129 - DNA, 2146 bp, Homo sapiens
  misc_feature (2118)..(2118): n is a, c, g, or t
  misc_feature (2120)..(2120): n is a, c, g, or t
tggcggcggcggcggcggttgtcccggctgtgccggttggtgtggcccgtcagcccgcgtaccacagcgcccgggccgcgtcgagcccagtacagccaagccgctgcggccgggtccggcgcgggcggcgcgcgcagacggagggcggcggccgcggccagggcggcccgtgggaccgcgggcccccggcgcagcgctgcccggctcccggccctgccggcctcctcccttggcgccgcggccatggcggccagcgcgaagcggaagcaggaggagaagcacctgaagatgctgcgggacatgaccggcctcccgcacaaccgaaagtgcttcgactgcgaccagcgcggccccacctacgttaacatgacggtcggctccttcgtgtgtacctcctgctccggcagcctgcgaggattaaatccaccacacagggtgaaatctatctccatgacaacattcacacaacaggaaattgaattcttacaaaaacatggaaatgaagtctgtaaacagatttggctaggattatttgatgatagatcttcagcaattccagacttcagggatccacaaaaagtgaaagagtttctacaagaaaagtatgaaaagaaaagatggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcagctcagaattctgcaaatgcagattttgcaaactttgatgcatttggacagtctagtggttcgagtaattttggaggtttccccacagcaagtcactctccttttcagccccaaactacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggagctacgccttccacaaatccatttgttgctgctgctggtccttctgtggcatcttctacaaacccatttcagaccaatgccagaggagcaacagcggcaacctttggcactgcatccatgagcatgcccacgggattcggcactcctgctccctacagtcttcccaccagctttagtggcagctttcagcagcctgcctttccagcccaagcagctttccctcaacagacagctttttctcaacagcccaatggtaagatctaacatttggcgagctgtaagttcattttatgtatcctttttatatcataatgttgtgtgcttgggcaggaagacttttctaaagaatactatagtattatctactgagtgtttacacaaaaataaaagcctttggtgatttggacctcagaaagctaagtgattttacaagtttttgtgagcaggttacaatttatgggaaatcagtgactatgtaaagagcatcccgtcattctcagaatttctattgcctttttctgattatttcgtcttacatgttctaatatacctcttgattttggagaatttatagacctagtgttgggattntntttttcctttcaggacagtgtgtcct

SEQ ID NO: 591130 - DNA, 668 bp, Homo sapiens
tcaaataactcatttatttaaaggataaagactgaataactgtgacaagtcacattaatacagattctgacacaaaataatagttaaacttgggctgggcgtgggggttcatgcccccaatcccaacatttggggaggccagggcagacagataaccgtgaggtcgggagtgcaagaccagccgtgaccaacatagagaaacccgtgtctctactaaaaatacaaaattagccgggcgtgagtggcacgtgccgtgtaatcccagccactcagggtctacaagacgctactctcccctatcatagaagagcttatcacctttcatgatcacgccctcattaatcatttttccttatcgtggcttccatagttccgtggtagtgcccttttcctaacactcacaacaaaactaacataattacataacattcctcagaaccgctcaggaaatagaaacgcgtcgtgaactatcgcgtgccgcgccatacatccatagttcctcattgcgccctcccatccttaggacatccttatacattaaccaagaggaggttcaaggattccctcctttaccaatcaaattcatgtggggccaccacgggtacggaaccctacgagttacccccgaataggggggactaatctccaactccttaaatacttcccca

SEQ ID NO: 591131 - DNA, 3024 bp, Homo sapiens
gacagatacgactcgagctcggtaccgaactcgacaagtgtgcatgctgtccgctccactgtccgggatgtgaatcatccctttgtctagcgtgtccacgttgcagatgctccccgcctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatgacctaaaatcattttaaccattgctactggaaagtaacagagtcaaaattggaaggttttattcattcttgaatttttcctttctaaagagctcttctatttatacatgcctaaattcttttaaaatgtagagggatacctgtctgcataataaagctgatcatgttttgctacagtttgcaggtgaaaaaaaataaatattataaaatatgctattgtttttgtgttcttgctgcaatgcctttaccaaagtggccttaaatatgagtagtgaattgagaacatcttgaattcttaaaagacttcttagtgactttttataaaaaggccatgtagaaaatttattaaaactactatgactgctacattcaggaatatgccagtggtaaagcatttaaatgtagcttgtcagatttaccataatcctactaatttctttgcagcttattaattttgtgaaatttgtatatatgaagaatttgcatgtatgtgtatttacaaatttttctaagtatcttgaattctcagactgcaaaaggcctattttaactattgattttttttaaaaaaaattgtctttgaatgtattggaagtagacatgcattaactgtgacattattgcacctcagtttttttctttctttttttgggcaaactgatattatctataggatatttgtttatgtttgttttttgggggaaagaaactggaactcagtgttaccttaaagttacggaatactttgttttaaaggaaaagataataagtttagttatatctttttgttaatattcaaatgaacttgtttaagtatctatgtacagtaatgcctcattcatctagaggtaatctggcagtcttgtgaaaaccgaacacaactcagaaacttggaatcgttttttttaaaaatgcctctgagcaacccatataagtcacaaagtctgtgtgttagagcttatgcatttgtttttatgagagattttaataaatttaattatttgcttgtccagactatagcatattagctgtttagaagggatggcttgaaaggaaggagactgaaaaacactctgagagcatacactgtccaaggccattagtgtaaggaccgctacccagcctagaggacatcactatactacatcatctgatgattattctttattatgcctctaggtaattaagtaaaggtgaaattgcatacacagatatgtagtacatattttaaaagttttatcttaaattgattaaaactttttaaaaagctttggtattaaaagaggtaaacatcagtttcctcaaacattttattcatgttgaatgcctttttgcaatgatgactgagttgttatcatagtattttaaaacctgtatagtgttttagacttgttaaaacattgctgtctagtgtacatctagctaaaagtgtggtttatctaaaccgttttaataagcaagatgactgggaaatctctgccccttttctgagcagtatgcctcttcttttagaattaaatgaatgctgcacaggtccagatgtgtgttgatgtagacttgaaatgtctccacattttggaggacttcctcagcccttttcattgagggaaaatatatttgaatttctgttttagattgtatcgggtcccagttgattcatgtgtacaaagttatgctacctaattacagaccattacccaaatatcctaccaggctttccatctgaatagtaaattaaacagttgttatcaaaatgattttaaagactatttctttttctgggtaactattgaagtttgtaattaaatgggggctcttactgactttaaattagcgcttataaaataaaaatgtttagttcaagaagagacccaagctgggtatggtggtgtgagagcctgtgagtcctagctacctggaggtgaggtgggaacatcacttgagcccaggagttggaggctgcagtgcgctacgatcacaccactgcacaccagcctggggatagagtgagatcccatctctaaaaaatgaaaaaaagaagagaggtagctttaaagtggtttttctcatgatattcactgtttattattaaagaaaatcagctttcgttagacttttacatttagatttattcttagttttatatagaccatcaaaattatgttgagtactaaaaaggagaaaaaatcctggaaggtaacaaggctgaagaccttcaaatttcctggcttactggtttagtcacatcatttttcctgttcaggtatctgcagatatccctgttcaggaaagatcttttttcaggatggcaaacttttgacatagtttaaagacattttttccccattttttgaaatagagaatattttattatttttgtgaaaatagagttttggtaatcactttcttcctcaaaataagtccttctgttaatttgtaaaagcacattagtgctttacctgtgaaattccccgcccccctgcacacacacccactttagtacagttcctgtcaattggcaacatggagagggtgacctggctgctggtttaccactgtaccaacatctctggagcattttagtttcagaaccttaacactccccaacagctttgttgatgtagcttgtatctctgagaatttattgtattaaaattaatactgagatatttttaaaa

SEQ ID NO: 591132 - DNA, 145 bp, Homo sapiens
tagcagatcttgcggcggcgctccaccgtgtgtctatacattcactgccctgatctctcgcgttgcttctgtcttcgctctgtggatccggattgttgccaagtgataatctcaagacacctcccttagctactcaggaggccgg

SEQ ID NO: 591133 - DNA, 129 bp, Homo sapiens
aggtgctctagtaggatcccgggggtgtctagtttggctcatccagctgacgctgcaacttctctggtgccttctgtcgccgttcttctaggttctctttctctagcagtctgtgtcatactggctttg

SEQ ID NO: 591134 - DNA, 1662 bp, Homo sapiens
tggcggcggcggcggcggttgtcccggctgtgccggttggtgtggcccgtcagcccgcgtaccacagcgcccgggccgcgtcgagcccagtacagccaagccgctgcggccgggtccggcgcgggcggcgcgcgcagacggagggcggcggccgcggccagggcggcccgtgggaccgcgggcccccggcgcagcgctgcccggctcccggccctgccggcctcctcccttggcgccgcggccatggcggccagcgcgaagcggaagcaggaggagaagcacctgaagatgctgcgggacatgaccggcctcccgcacaaccgaaagtgcttcgactgcgaccagcgcggccccacctacgttaacatgacggtcggctccttcgtgtgtacctcctgctccggcagcctgcgaggattaaatccaccacacagggtgaaatctatctccatgacaacattcacacaacaggaaattgaattcttacaaaaacatggaaatgaagtctgtaaacagatttggctaggattatttgatgatagatcttcagcaattccagacttcagggatccacaaaaagtgaaagagtttctacaagaaaagtatgaaaagaaaagatggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcagctcagaattctgcaaatgcagattttgcaaactttgatgcatttggacagtctagtggttcgagtaattttggaggtttccccacagcaagtcactctccttttcagccccaaactacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtatcaagctttaagcaaaacaaatacaaatttgtgttaaacagtgctcttaatttggttgtatttattaaaatctgaacatgctacacttttctcagttgttgtatagaaattttgtctgcactgtcattttgagtaaaatgttcacttgacacattttagacctgaaatatcaactacaaaactgaagacatagggactgatttgtaaactttcagtcttactagttgagaaaaattttattttgtcctagaaggcgtgctttacttttctttggctataaagagccaagaaaccccattggcagagctgaatggaggattatttggtggtttctgtaatatatttacttcgaacaattttccgttaacatcttggtgggttttttatattta

SEQ ID NO: 591135 - DNA, 355 bp, Homo sapiens
accacaagttatagtactggggaaaaccattaccagtgctgtcactttactattggcacactttcgtgtaaaaagtgagcctaagaataatgaatgacctgtatcttaaactcaagtaaaggtatccttaaccataaacccaataccctcccatatactcttaagtccttaagcacaatttctgcacatcatttatgctctcaatttaaggaaaataagaccatgtttcattttcaattatcacatgtataaacctaatgtgtcccaaagctgcatgtctataatgtcattcttgaacacaggacctccttctcattataggtgaactcagtaaaaagctcctctgacatatcac

SEQ ID NO: 591136 - DNA, 609 bp, Homo sapiens
  misc_feature (609)..(609): n is a, c, g, or t
ccactttatctcttcgtgtcatccccatgtgccttctggcgaggatgaagtgcttaggacctatctatgtgtcccttctctttgtctcatgtatgaagctcggaccttatttccagcggcgatgtgttatgcgctcgagggatggcacaccaaggagatggaagatgtggcttcaatcgcgtctttacaacgcactttgagccatgaaagaaatgatcccaaagtccctttgactagtctgaattggcctctatgcattaagtaaatcctctcccaagtcaacgtccgccttcactatctgaatatcactccattgctaacacacattcatgatgacattgatatgtaacactagaattttgccaaactaccacttcgctcgtcagccctagattgacctactagacttgataaaacttggtttgtactaaactacaactctcctgataacaccctttatatatgtgcaggcaccacaatttcatggtctcggctttgcctatactatctgtcgccgccaaaaaccttcactggagtggcccataatgcgccgtgcagctggcttgctggcatacatttcctgatattctcgcacatactattgcattn

SEQ ID NO: 591137 - DNA, 269 bp, Homo sapiens
ttcccccgtctgcgggccagtttgctgggtccccagaaatgtcatttatagtcgcgccgatggccgccgccagctctgtgtcacttgcttcgtgtgcagcgcttgtccctgtcctctggggtcgggccctctggtgcatctgccttataggcggcatatgcggaggcctccgcgagctttgcgatgtgttccacggcctgctccagctccatctgcttggctaactgggtcgcttctggggacggcccacaggcagacacgtcttcttt

SEQ ID NO: 591138 - DNA, 500 bp, Homo sapiens
  misc_feature (420)..(420): n is a, c, g, or t
tccaacagttttgcagtaccttttgatgaagatgacaaagatgattctgtctggtttttagaccatgattatttggaaaacatgtatgggatgttcaagaaggtcaatgccagagaaaggatagttgggtggtaccacacaggccccaaactgcacaagaatgatatcgccatcaatgaactcatgaagagatactgccccaactcaagtattggtcattatcgacgtgaagccaaaggacctaggacttcccaccgaagcctacatctcagtggaggaagttcatgacgatgggacgccaacgtcaaaaacttttgagcatgtgactagcgagattggagcagaggaggcggaggaagtcggagtggagcacttactaagagacatcaaggacactacagtggggactctctcccagcngatcacaaaccaggtccatggcttgaagggactgaactcccagctcctggatatcaggagctacctggagaaggtagcca

SEQ ID NO: 591139 - DNA, 656 bp, Homo sapiens
  misc_feature (168)..(168): n is a, c, g, or t
gcccgtccccttctgcccactcccgcttataggacgatgccctgcatgctgcccagccacttcaggagtaagtcgggaggcgtggagggtgaccacaccttggccttttgggaactttcctttgtgtgggtgccccacctgccgcatgctccctcctctcctacccantggtttgcttaaagcttccctttcagctggtgggacgatcgcccaggctggagctggccccgcttggtggcctgggatttggcacactccctttccttggggtgagggacagagccccacgctgttgacatcagcctgctttttcccctttgcggctttcactggtgagtttttgttttccctgggaagcctgggccagcacctttgagccttggcccacaattagggttaggcctttttgcctgggatgggctcccacccttcccttagggatggcctggattcacgcccttttgtttccttttggggtcaaagcccttcctacctttggtgatggtttccacaggaacaacagcatttttcaccaaaatgggtggccccaaccttgctgggacttggatcccaggggcttattttttcaagtgtggaaagggcagggtccacgcctcccctgtagcttatgaaattaactaattgaaaattcaaaa

SEQ ID NO: 591140 - DNA, 1287 bp, Homo sapiens
gaaatctatatcgaagtatacctgcgctacctatgcagagagcctctattatgctatgaagggcgctgggacagatgatcataccctcatcagagtcatggtaatccaggagtgagattgatctgtactaacatcaggacggagtttaggaagaatttgccaccatctcttatatatccactgattaacgggagatacatctggggactataagaaacgctcttactgctgctctgtggacgaagactgacctaaccgtgtcacggggcatgacgctccctgactgatgtgcctgcaaccagccccactgccttccattcagacaccatttagctgcattcgtatgccagtgccataacacacattgccattatgtcatactagacatgcatcatgaccagacacatacacgtcatagaagaacaatagtgactgctctctcactagcatctcttagtgcgcagatctctctcgaccagctgctcagtactcaaagtgtaactaaatggtacctaagtctccatgcctggcacatttcaccatcatataatactactaaacaaggaagggatagaaggtggataatagacctatggttaacaacacctccccatccgtacttacacattcgtcacccaatgaatcgcttctacatccagacagctataagcccattgaccattgagaacccttgtcacactgttcactcaccctgcacggctagcggcaaacatgaatgtattagcacccgtgtttctcccatcatggccagcattggctcttcccaacaacgcattagggcgggacgaacgtaaccactctgagctggtaaccccacagcaaactgcagtgggatccatgctggcgatacgcatcgcatcgatccacgccatgactcagaagacacgatgcatcacaaaatatcaagccatacagagtccccacgagggctcagcgtcgaactgtaatctccaacctggcccatcgagagaatagaaccagcccaacaccacgcgcgccacacccagtaacctgaatcaatccaccccatacacacatcacccccacccaacacaaaacaccaccaactaatcaaaattcacaaaacaagcgtgcactcccctccaccatcatttaatcacacgcagaatcctgaacacaccacacgccttgacccaaccccgatacttaccaaactaacaaaccatatatccactctttcttaatctccgtcagctatctttcattctttttttttctattttttcctctccaatcaatcccaca

SEQ ID NO: 591141 - DNA, 835 bp, Homo sapiens
agtaggagaacgctgtctatcttgcctggacatgaggaaacagtaacacgcgcttcggaatagcagccaagtatcagattgaccctgacgacctgcttctcggctaaagtgaacaactccagcctgatagtgttaccagtgatatagctcagactgctaaatgccaggtattaatttgacactgtcagctcttctggatggccaagaacgttcaatgctggtggccacaagcttggtctaggactggaatttcacgcattattgaatactgtacaatagtttaatttgaaagctattgttgcagctatagctaccttgcagaactactagtgtgatcttttagatgttgtatgtctagggatgcgacgtattgctaggagatgttagcgctccaggttaaagtggattcagcttataagatgttacccttccagaggtacagaagaaatgctatttccgaaaaagaggtccgttcagtggtagactcgtgggagaactgggtggcccctttgatatgccaggtacttgttggatctagacacatggctgcaagtggaagcggataatactgtaggcactttgtcaacttcatattgagtacaatgaatgaaattgtgattatcctgagaatcgaaccttggttccctaaacctaattgatgagaggctcgctgctagatggtgtgtacaaactcacctggactggggacttttaaagacagatcttcatgacctgttcccaccccagttcatcatcatctctttaacatcaaaaggtctgcacggtgtggaactgtcctagcgtgcatgtggggttggaaaggcggatgtgatga

SEQ ID NO: 591142 - DNA, 136 bp, Homo sapiens
tcgaggatacattggatagcggatgacggctacctagagaacctttgccttttatgctgcaattaccccttgactcagacggtcccacttcccttacccagtccacaatatgtactcaccagatgcttgtatatta

SEQ ID NO: 591143 - DNA, 675 bp, Homo sapiens
  misc_feature (1)..(1): n is a, c, g, or t
  misc_feature (263)..(263): n is a, c, g, or t
nccattcacactttgctgcatcttcagtatgaaagtgtagtttaaaaaccgtggatttttcaatttcggggcacattatatatgtgtctaaaatcgatgtgtaattcactttcctcttcacagggatctcactttaatttgggaaatgtatgtgtataaaacatggaacactgtggaaacccactcttgaacttccctggacatgattcagagactgattgaggaaagggctgaatgtctggctttagaggatgtttgtggtncggcaatgggaagctgggaaaattggcctcaggaagtggcagcacctcaccttttcttagaggagggagtcggtacacagatccaatttgtctgcaatggaaaggaccgggtcctttacctgggcctcgccttcttaagtgcccaggtggttggccgttgccatggcaacagttaccttggttatggggttgtgcgtcacaaggttcatagtcctggaaatcatggcagttgggatggtgtccatggggatggtgtccatgggggtggtgtccatgaggatggtgtccatggggggtggtgtccatggggatgctgtcctatgggtatcatgttcatgaggatggtgtgcatggggatggtgtccgtgcggatgctgttcatgggaatgatgcttatggggatggaggtcac

SEQ ID NO: 591144 - DNA, 204 bp, Homo sapiens
actttttttttcccctttcctattttcctaaaaagggtgacccaggggtttccgttggctgtatggccaccttttttgctgaagcctttttttgtaaaccccattcccttgttccgttttgttgtaaactgccttcccctaaaaggccctgttgataatgcttttttatgggggttttataagggggttaaaataaaagcttta

SEQ ID NO: 591145 - DNA, 635 bp, Homo sapiens
tcagtcgtcccgaactgaaatgtgtttgtgtatatatatatatattttttttttttcttaatccattcatcacctgatggacacttaagttgattctgtatctgggctatggtaagtagtgctgcaataaacacaggggtgtagatagctcttggctttactgatttcctttctttggaatatatacccagcagggggatcgcgggataatatggtggatctattttaagtttatgggggcacctccatactgttttccatatggacggtactattttacatccccatcaatagtgtactagcacttccctttcttcacatcctcatcagaatcagtaattcttggtctttttaataatagccattttaccggggagataatatttcatgggggtttggatatttcgattatgattagtgatgtggagcatttttccatatatctgcgggccattggtatgtcttttttggagcaaggtctatccagatcactggcccattttaaaatggggtaatagggtattcggtcatggagtcgaggcctttatacattcgggttattaaaaccttgatgaagggatagttggcaaatattttctcctatacggtgggtggtctcttcactctgtggactg

SEQ ID NO: 591146 - DNA, 686 bp, Homo sapiens
gggtctctgagggtcccacagcgctccccatgccgctcataccgcctaagcaacgcctcccaatcactcagcactttgtgaaagaaccggtctccttcgaccccagcaggagacgccagctgtaagagggaacttccgagcctccaggggcggggacacccccactgagcactgatgatgaggggtgcccgttgggcagaagaagctctggacagcagcttcttggggtctggagaatgaactggatttgttgaccgatattctggactgtcctatccgttgtcccgtaagagcgcagtgcagtctgataccgagccagattttagactgctgtcatagaggtagaccgtggaccagctgcttcagcactggccaacataccaagatggcaaccagacgataagaaactaccagagccggagccccagcccctttccctgccatccctgcaaaatgcctcgtctttggatgccaccaggctcttcaaaggactccaaggtcccagcttgataccctcagagtccgaccaagaagtcacgtctccatcccagtcctcaacagcttctgcagagccaagcatctggggggaccccaaacctctcctctcacagagcccctattcttcatctcacccttccacatgcagtgagatctaaggccagaaaaccatcctggtctcatgcacg

SEQ ID NO: 591147 - DNA, 214 bp, Homo sapiens
aagtcggcccatgttacgtacacatgaatatcagtaaagggatatacgtactcttaaaataccctgataggttgaaaaatcacataccaatccatgattgagtgatacagtcctcacataaataaacagcctgttcctcccactgagaagcctttgagcagcaagtagaatccctaagggaatgagtcctaattgccacggggaggaacgggca

SEQ ID NO: 591148 - DNA, 228 bp, Homo sapiens
  misc_feature (6)..(6): n is a, c, g, or t
gaatcncgcctgacacatagaatgcataaacgaggggggtccttctgcagatactctaatcactacacagctttctctataaaactacccataagcctttaacctttagagaaaaatgaaaaaggttaatgcttggaagccgggggaggactgaccacttcataagccagtacgtctgagctgagtatgcccccagaatccagccactactgataattcacaacggta

SEQ ID NO: 591149 - DNA, 177 bp, Homo sapiens
ctgactcgacggatctccagagtacagacgtactgaactgtgttatacaaaaccccacttagttctgtcctgcaggataatggccaaaaataaacattgagttgtatcatcctctaaaggtattggtgacagctggcaaattagagtatttgtcaagtggccttcataaaattagga

SEQ ID NO: 591150 - DNA, 180 bp, Homo sapiens
acggcttagaggggaacaatcactttgtcaatacatgtactgaacctgaattactcatatagtgtataaccataaatctcacacaagataaaacaaaaacgacagaatctgtacgaccatacgagctctccatatttatgtaacaccttatacttaactagtatatcgaataaagtataa

SEQ ID NO: 591151 - DNA, 263 bp, Homo sapiens
acacgcatgggtgtgtacgtgtgcatttcagctccgcttttacagctgaagtcacagaataccacggaccatgttcatctgtgttccttacactgcagctgttccttattgtggtttactctgctcccttttacagtgaacgatgatgtcttgtgctgggctggccgggcgcatcacccatcggcgttgcacgccgagtgggtgttgtgagtgtcatttagtgcgatgagtaggggaagggagcctactagggtgtagaatag

SEQ ID NO: 591152 - DNA, 323 bp, Homo sapiens
ttatgataggagaagagattaaaaaaatgatagaagaggatggaagccaggcacagtcgcacgcctgtaatcccagcactctggaaggccaaggcaggtggatcacctgaggtcaggagtttgacgcagcctggccaacatggtgaaactccgtctctactaaaaatacaaaaattagccgggcatggtggcgcgtgtctgtagtgccagctacttgggaggctgaggcaggagaatcacctgaacccaggagctggaggttgcagttagccaagtacgtgctactgcactccagctggggtgacaagagcgaaatccgtctc

SEQ ID NO: 591153 - DNA, 133 bp, Homo sapiens
tcgagccggtcctgaagctctttgaccctctcaggactagttctaagtagtgcaagggctgattagagcaaagggcagcagcagtaattaagaattgccttacttcctgcgtgatgggcctgaaatataggaa

SEQ ID NO: 591154 - DNA, 116 bp, Homo sapiens
gtcatacgtgggcatatgatgtctatgctagtgaaagtttggctccatctctgtatcatgtgcttggtggacaaataagttagacacaaatcaaataataggccaagcagtcgtcg

SEQ ID NO: 591155 - DNA, 336 bp, Homo sapiens
gctgactctcatactgactgtgtttcatgcttacataaaaacgagaaattccatcatataaataatacgtacatgcttcatcccacactcaaacgtcctctgcgggcaccttgcctttgagtccttgcttccaagaagcacagcatctttgaccaagtgtgtgtgagtgtgtttaaaggaaccacaaagcaaagatagggtttctctttttttcagagtccatcatcctaagactttctgtgttctctcctgtgactgagctgagtggagcttgtttgttcctcttctgaaaacaaggatattgtcttttccctttaaggagtagagtcatcatta

SEQ ID NO: 591156 - DNA, 1288 bp, Homo sapiens
ggttggccatggctgggcctgggcctgggctcctgctgttcccgtgttgctggcctgaggacgatctcgtgctgcatcatcttgccagtgggctgctggacttgtgcccgctcactggcttgtccctgcggacacagctttcttgcctgccacttgcctaggaggccctagtgtgggctgccctgcgaacgccctgcctgctggtgactctgcctccacttgcctgccatgggtctgcctgccgcatgcaatgcctgccatcctagcgtgaatgaaacactgctacttgcaagtgagccttgtgctctgacaatggtacctgtctgccgacctgtactgccgatgattacgtgtgctgtggcgtcctgacaccgtgcccccaggctcgcccgctcgttgccaccgtgtgcttcccaaagtttactctcctcctaccacaggcttgactgggcacggtctgactgtgccacaccatgagtctgacccagggtccaggggaaatctttgcatgactgcgatgttgggagcaggttaaggatgaagagatggcaattcacagcaggaaaacgatttggctacaacgtgcatctcctttgatacagggaacgcccatttgggttgggagctccagtcgtctgctcatgcagcatttcggtttcataggacggctctttgcacgtgacgattccaggaatgcgcctgccctaattcacggacgcttcctggggaaccccaggaagcaacagctgaaaccgttgagggccattccctcggtcgccacacgggcgttcctttgccttctcttggtgtggtgggactctctatctcgccagttgggccttctcctcgccagatctgtcttcggtagaggtttccacggcaccacatggcttgcaccgggacaaccacctcgcgcacgagtctttctacccagtgaaccccttagcaaggaaacccctcgagcggagaaccacgcttcccaccgacaaaggcccgtccaccatggggacagagacaggggtctttcctttcgcactgccgtcacacttttcgcgttggctatgacaacctaccatggtgagagggccccggggcatatcccttcgatcagtggctcccagattgtggcctgcacacgaggagatcaccgccgctgggaaacatccagaggacgaagaccattctcccgggcttgcgctccacgcggtggtaccgatacaaattctaacaacctttaaagctttttcgagacgtccttcttacccgtgctcactcgatgctgacagtt

SEQ ID NO: 591157 - DNA, 1449 bp, Homo sapiens
  misc_feature (166)..(166): n is a, c, g, or t
  misc_feature (576)..(576): n is a, c, g, or t
  misc_feature (1159)..(1159): n is a, c, g, or t
ggagagaactagtctcgagttttttgtattttttcttctgggaaaatgagcatattctgctttttgtgaggatacgggacacaggaatgggtggaaaaaagggaagcaagcccccctggccatcagtcccctctctctcagggtggtgctcggaatgttccatgcntattggcgagaaggcgacttctaggatctctcgccggggataacctcagatcctgacataatgggctgctcgagtacagggctgcgtgcactcagactgtgcgtgtgagcaacgcggttgcagggagtcattataacatgaggatggaagggggcagtgatgcgggtggaaagatggctgcggagggtggctttagtggcaactcgtggtctattcacttgtgcgcggtctattggaaaccgaaatttggtgggaaaagaagaagagatcgcttcgccgagcgtagtggacgtgtgaatgtgcgcattgacgaacgatcgtaaacgaggttggtgcagcgtgagaccttggcgtcatgtaaagcggttggtacatattgttcacttggaggggagcccattgtcatcacnaagacttctgttgacactcacgggggaagaggtggacaccgagttctccctctatagttcaaaggcacccattggtgggattacttgggccccatgtttgggaacacacactatgttttcgcaagtgagacatgtttatttccaaacgcatcttagaattgcaagcatctccgccaaggtgtgggccttcgtatagcgatagagaatttggcccaggcagggggctgtggcacataggttatcggggaaggccgcacagagtgacgcagtagggggagcgcagaatgagcctcatataaaagcagaaagcgcgggagagattacggagggagaaatccagcggcttatgattttgccccagaaaaggaggggcgacacagaaacgcggccccagcggggtgcaacacaccccacatggcggtggaggcctgcagcgaggccgcccctcgaaggaatgttggactgcacggtctgaaccaacgaacatcggccacagcggcaagagcttcgtaaaagggacaacaggtttgggggtggaaaaacttccccccgccgtggatttcgcggacgaaccaacacggancgggaccgtaaataagaagacgtcttgggggggcacctttagtagaccccagggggaaccaacttccccaagcggtccccaaaataaaaaaaaggacacgttcaaaccccggattctgtgttgaaaatgtgttgaccccccggcctaattatgtagaacgggtttttgaacaggtgggcatagaaaaacggccactctccccatttgttatatatcaaaggagggagttatgaagagggttgcaccatccctatgggagaattttaaacccagcgtttcacaacccagaa

SEQ ID NO: 591158 - DNA, 330 bp, Homo sapiens
acatctcacgtggccatagataggtacgcctgtggtttggtgacgacctacagtagtgctgatctgagtcggctgcacttgggacacctcagtgagctgatatgggtgggctgggcttggagatacctcagtgggctgcaatggctgcgccagagattgagtactccctaatggcctgagatgggtcggttggacttggggacacctcagtgggctgaaatggctgagccaggattgagtactccccaaaaagactgagatggatagtctggacttggaaagaccccaaaggtttgagactggctgctctgggtacccagcccggtccgg

SEQ ID NO: 591159 - DNA, 290 bp, Homo sapiens
ccggaagctcgggactgtgaggcagtagaattgcttggacatgggaggcggaggctgcagtgagttgagatggtgccactgcacttcagcctgggcaacggagtgagactccatctcaaaaacaaacaaactaacaaaaaaaatgtaattgacatgaaaaatagctgtttagatataaggagaaataatagatactatattagcagaacctgatttagttgggtcacgggtggggcttagaagcgtttctgaggaagttacacttaagctgagacaggtagaaattattt

SEQ ID NO: 591160 - DNA, 277 bp, Homo sapiens
  misc_feature (169)..(169): n is a, c, g, or t
ggggccgcgaatctgcaggtcgcgccgtgcgatctcgaagccgtcggtggtttcgcgcatcgtcgccagccgctcgcgcgctgtgggcgacagcggcgcctggtacatcagcaggcagaccgactcggcgcttccccgccccacgcgcccccttaactggtggagttgngccagcccgaaacgttcggcgtgttcgatcaccatcagcgatgcattgggaacgtcgacgcccacttcgatcacggtggtggccaccagcacctgcagccggttggcg

SEQ ID NO: 591161 - DNA, 99 bp, Homo sapiens
ctttcccccccccctttcccccctttttttttttggcaagggcccccacccctggttttttttttccccaggaaaggggttccccccccccctttttta

SEQ ID NO: 591162 - DNA, 146 bp, Homo sapiens
acgcaggtagacggcggtacgaaccccaagtgatgttgtgatgtaaggtgaaatattagttggcggatgaagcagatcgtgaggaacagtgagccagtaactgacgtgcaagtccgtgttaagcctgtggctacaaacaaatgttg

SEQ ID NO: 591163 - DNA, 521 bp, Homo sapiens
cggacccgttcccgccaccctgaggtttaagtgggcactgctgttgcacccaccctgaacacccagggccatttctttgtggaggatctaatctcctgtgagaagcatgcccgggagcgagtcaccccccctgagggttatgaagtggtcactgtgttccccaagtgagccagcagatccgacccctgttttccagcaggcctttggtgcagctttttctttcagtgtttgggccctctcctttcttgaaagttttctgcctactttggttttccctctgcttgtaaaacattgagtcccctccccgccttggttaattgactccccccagctgtgggatgcccgcttttcccattaaagggaaaactgttgtgttcagtgtccccttgtcagcaaccctgggtcccttcgcccccccgtttttttttgctgcatttggacatcagcccaatttgaaccccatcaaatataacgggtttgcccctgattttgtttttaccccataaatgtataggccccca

SEQ ID NO: 591164 - DNA, 350 bp, Homo sapiens
  misc_feature (31)..(31): n is a, c, g, or t
atttttagtagatatggggtttcaccatgtngggcatggctggtcccgagcttctgacctcgagtgatctgcctgccttggcctcctaaagtgctgagattacagacgtgagccactgtgcccagcctgtttaaccagtattcttcatgaccttggattttatttatgattatataatgggaggtaatatttagggaaggcatagatcttagttgtaaatttggatctgagaacttttctggaataacttggtatgtcatctactctgtagatgaagaatcatgtgtaaattttttttgtcagtaaatcattccacagttttattctggctaaaattgttgcttttttca

SEQ ID NO: 591165 - DNA, 396 bp, Homo sapiens
caggactattggaaggcgaaggtgagatagatcatgaggtctaggagtacgaggacagcctggccaaaatggcgaaatcccatctactactaaaaataagaacattagccagtgtgtggtggcacatacctgtggtcccagctcctctggaggctgaggcaggagaatcacttaaacccaggaggcggagattgcagtgagccgagaccacggcattggactccaggctgggcaacagagcacgactccatctcaaaaacaaacaaaaaaaaaaagagtgtcaccgggggctacttggccagacacagagagcaaaggagacatccctaataatctgtcaaaattcattgtgggggctgagcacagtgaatcatgcttgtaggtctcagcactttg

SEQ ID NO: 591166 - DNA, 899 bp, Homo sapiens
  misc_feature (1)..(1): n is a, c, g, or t
  misc_feature (108)..(108): n is a, c, g, or t
  misc_feature (124)..(124): n is a, c, g, or t
  misc_feature (173)..(173): n is a, c, g, or t
  misc_feature (203)..(203): n is a, c, g, or t
  misc_feature (238)..(238): n is a, c, g, or t
  misc_feature (311)..(311): n is a, c, g, or t
  misc_feature (317)..(317): n is a, c, g, or t
  misc_feature (335)..(335): n is a, c, g, or t
  misc_feature (366)..(366): n is a, c, g, or t
  misc_feature (378)..(378): n is a, c, g, or t
  misc_feature (386)..(386): n is a, c, g, or t
  misc_feature (399)..(401): n is a, c, g, or t
  misc_feature (405)..(406): n is a, c, g, or t
  misc_feature (410)..(410): n is a, c, g, or t
  misc_feature (412)..(413): n is a, c, g, or t
  misc_feature (415)..(415): n is a, c, g, or t
  misc_feature (417)..(417): n is a, c, g, or t
  misc_feature (421)..(421): n is a, c, g, or t
  misc_feature (426)..(426): n is a, c, g, or t
  misc_feature (439)..(439): n is a, c, g, or t
  misc_feature (452)..(452): n is a, c, g, or t
  misc_feature (460)..(460): n is a, c, g, or t
  misc_feature (500)..(500): n is a, c, g, or t
  misc_feature (528)..(528): n is a, c, g, or t
  misc_feature (559)..(559): n is a, c, g, or t
  misc_feature (682)..(682): n is a, c, g, or t
  misc_feature (816)..(816): n is a, c, g, or t
  misc_feature (820)..(820): n is a, c, g, or t
  misc_feature (827)..(827): n is a, c, g, or t
  misc_feature (829)..(830): n is a, c, g, or t
  misc_feature (832)..(832): n is a, c, g, or t
  misc_feature (875)..(875): n is a, c, g, or t
nttattggcaaaaaagaaaagggaaacttttaaacaatttaacacagggcattgtagctgatcctgtcagaaaaaaaaagtaccattttaaaagtccatctaattgtncaaagatacacaatantgaatctgcatacgcgtttcctttatgaagtacagtgctcatgttttangcagtcttctaaacatacaaatacagaggnaattaaatcactcattaaaaactgtgtcaaatgangggtattttaaatataagtttgttgtttctggtaatagcacatgcccaaatgaaaaccaaaagatggaaaggnagatanacttcttacttgggtggncagttacaacatcaatcattttctgcaatgnccattatatttnccatttancatgacctactcnnncctnnctangnnangnggcnggggngggggggggggangtaggggcaagangcctttantgcaggaggttaactcctccagaatcagcatagggaatanacatcctgttgattctgggtggaaaganattgatgtagtcaatttcaactcgtgctganctgacttaattttttcagcgatgtgtttggtgtcattcttctaaatcaagtgtatttaattcttcttctagttcatccaaatcctctccagtgaaaagattttcatcaacagggacggcatcnatggctccattttccgttccctccctctcgttgtcctcttccaagtcacttctttcaccattttcagccctacctccagaagcttcacttaatttgttttcatctttatctgaagtatatgtgctgaatctttnaagnctggctncnntnatacctgtttcatctacatctcttgggatgtacaggcttaaanctatgtcatttacactcactgaat

SEQ ID NO: 591167 - DNA, 353 bp, Homo sapiens
  misc_feature (40)..(40): n is a, c, g, or t
  misc_feature (113)..(113): n is a, c, g, or t
  misc_feature (329)..(329): n is a, c, g, or t
  misc_feature (341)..(341): n is a, c, g, or t
cggctctgttgtgtgtaattagtaacagttgtagcaaatnatccttaaaaaatgttctaactaaacattagaggccaggcgcggtggctcaggcctgtagtcccagcactttntgaggccgaggcaggtggatcacaaggtcaggagattgagaccatcccggctaacatggtgaaacaccgtctctactaaaaatacaaaaaattagccaggtgtggtggcgtgcgcctgtagtctcagctactcaggaggctgaagcaggagaatcgcttgaacctgggaggcagaggttgcggtgagccaagattgcatcactgcactccagcctnggcgacagagtnaggttccgtttc

SEQ ID NO: 591168 - DNA, 939 bp, Homo sapiens
  misc_feature (11)..(11): n is a, c, g, or t
cggcatggacntagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggataactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagcccttcggtcacctgttggctacacagacccctccccttgtgtcagctcaggcagcttgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctcactttccaccaagtgtttagagtcatgtgagcctcgtgtcatttccggggtggccacaggctagatccccggtggttttgtgctcaaaataaaaagcctcagtgacccatgagaaa

SEQ ID NO: 591169 - DNA, 536 bp, Homo sapiens
gccctgcatgaaaaggggatcctggcatcccactgtctggcactggtctccagctagtgctacttactagcaatgtgaccctgcagcactcaagtcacacagcctctgtgtctcacgctcgcttctctcggtaaacctgcgtttcataactactatcattctgtcacaacggtcagttcgcgacgttttaaaaggaagtacgaaacactgagtgctgcagtctgttagaatctagcacacacgtaatcactcaagtacacagatcccgcctagtaacttaatttcctggtcacaccttttgaccttcagttgtgctgtagccacccctagtccgtcctgctgcctgcccttggaatcatttccatggggacactgttgggcacgggtactgtgtcccttccaactccggtgccaagcatgaggcctggcgcttagtggagcctcaagagtgtctactgagcaaatgtcaatgaatattaaactgaggctggaggagcgagggtgctgggggcaatgtcgcgacacttggggcagac

SEQ ID NO: 591170 - DNA, 1195 bp, Homo sapiens
gttgtgtgctgccgtcttgttctcggcttgggtggtgcgtctttgtcggtgctgttcgcccctgggtcgtgcgcctcttgtctgtcggtctgcgccgcagtgggtgtcttcgtggagtcgttgtgtttcgttgtgctgttggttctcgtctgcggttgggttgttggtcgttgggtctgttggtggccgtcgtgtggccggggtgtctttccctgtgtgtctggcttgtgatttcctcgtgctcgctttggtttggtcggtgtggttgtatggtctgccggtagcttttggctgcgttatgggcgtgtctgtgggatcctctgtcgttctgtcgcggtacttttgatcttggtgtgtgaggtcgccgttgtgtgtgtgggttccccattgtgtgccccgtcccttaacgttggtgtgcgtgtatcgcgggcctatggccctgggattttggtttctaacggtcgtcgatgtgcttcatgtccctgtgctgttatgtctcctgttactgtctggagtgtcattcaatgaggattatgccctgtatccgaaggcgcttgtttggatcaggttggttgttgtgttgctcctttggtgatgtggcgtgtctctgtgttacagtcgcgtccagtcacttggctatattggcttatgttgtctttgggtttaggtatggtcctaggtatgacggagcggttatggatctggatagtgacaagtcatcactggtcttatggtccggaggtgcatttagtgacgggctggacgagtgtcccctgttatggggttcatgggtctgggttgttactatactgataggcatcccatcgcgttccgcccacgcgtcctggcaagcccttcggtcacctgttggctacacagacccctccccttgtgtcagctcaggcagcttgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctcactttccaccaagtgtttagagtcatgtgagcctcgtgtcatttccggggtggccacaggctagatccccggtggttttgtgctcaaaataaaaagcctcagtgacccatgagaaa

SEQ ID NO: 591171 - DNA, 1412 bp, Homo sapiens
  misc_feature (11)..(11): n is a, c, g, or t
cggcatggacntagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggataactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagcccttcggtcacctgttggctacacagacccctccccttgtgtcagctcaggcagcttgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctcactttccaccaagtgtttagagtcatgtgagcctcgtgtcatttccggggtggccacaggctagatccccggtggttttgtgctcaaaataaaaagcctcagtgacccatgagaaaaaaaaaaaaaaaaaaaaaaaaaaaagagagccacaaaaaaaacaaaaaaaaaccaaaaacaacaatgtgtgtgggcgcggcgcatcggcgcccttgagagagaaggttttagaaaccacccgtggtgggggcgcgcgcggcggccccgaagcgatgagaggcaacacggggacaaaaagaggggtcccaagaggaaccactcgggggcaagagacaaaaagggggggggctccccacaataaaaacaccgcgccgggggaggggaccacgagggcgctcctcggagagcacactcccaagagaggacacaagagggggaacgcacaacaaaggggaggttaaaaacacaggaggggcgcacaacgaggaggcgcgaagatcacaaaaaaacaccccccctcaggcgtggtgggggggaacaacaaagaaaagaaaaaaaaaagacaaaacagagaaacaaagaaacagagaac

SEQ ID NO: 591172 - DNA, 118 bp, Homo sapiens
atgtgctccatcttaacgatatttggagtgtcagcactggtgctcacgtgtcgacggaactatgtacagtgaaggcatgcacctgcagtggtgaatacacgtctgaccatggctccat

SEQ ID NO: 591173 - DNA, 612 bp, Homo sapiens
  misc_feature (14)..(14): n is a, c, g, or t
  misc_feature (387)..(387): n is a, c, g, or t
  misc_feature (390)..(391): n is a, c, g, or t
  misc_feature (454)..(454): n is a, c, g, or t
  misc_feature (566)..(567): n is a, c, g, or t
aactaagatgtaantaggcctgatgtggaagagtgtttggagcaatgtcctacaccattttgctggtacagtctaccaagaggtcagaaggaagaacttatagttaactaactaatctgtttattgaattcatagaaggtgttagtaaaatgtgtgaagaacttctgaaaggaatgactgctatcgagtccgtatatcacatatgacatgattcaggtgcataatgttatagatgatctgggggacctcatctgcgtggtttaccgagctgatacctcgacataccagccttattacatagggctggcttaaagaggagatccaagtgctccttgatctgtaagggcacaggctgggaataattgttttggtagcagtctctggctncgnnaatttttttttaatccgacttttttggtttgaggctattttcctaggccagtttaccgtaacntcaatagggggggctcatcaggctttcttttcttaaaggagtttttggaaagccaaaattttagaaggggggctttattcaatggggttattttaaaaagaacctttgaagnntttgggaaaaggcagaaaggcataaccccccaaaataaaaaacac

SEQ ID NO: 591174 - DNA, 182 bp, Homo sapiens
gggttcttgagttttcccccccctagttccccctgaattttgtaacttccggtgttggcatcctctgttcctattcggcccttgctttgggtcatctcagtcatttgacttaaaaagggcccttcaaaaggcccctgttccctgcggcccttttcaatgaattaaaatttatttttgtttta

SEQ ID NO: 591175 - DNA, 172 bp, Homo sapiens
caatagaaagatgggatgtttgcgaggctgctatgtttcccctttcccccagtctctgagagcattggtaatttggacacctttattagtttgagataataattgggactcactgactgaggctggactgaagatttaaaacatggtgggtgcctagaacttcttgtcaatt

SEQ ID NO: 591176 - DNA, 487 bp, Homo sapiens
ggatcctccaactagtcaaggtatgttgcacatgacaatgtgacacatcatgaattacgagtaagcttaacaaatgcagtgacagcaaggtttctgaataataggatttattggaacccattaataattctaataatcctcataataaataacaacaataatgctacgttaatacatgagacaccatgtcacagacgatccactgagcgtgaggccatcgaagaatgtctgaatcaaagataaattccaagggctctcatgccaagagaatgattttatatttcagtgctctctacttcaatgctaccactcaaaacacttggaaaatacctcctgtgttcagggacagattattttgttacaaactcagtgatggcaaatctttggtaggtatcttggttctggattttggaaaacaataaaaggacttcattgtcctgtatggtgaataatataggcccccaaattggataacaccaatttggtt

SEQ ID NO: 591177 - DNA, 747 bp, Homo sapiens
  misc_feature (295)..(295): n is a, c, g, or t
  misc_feature (398)..(398): n is a, c, g, or t
tggaaatggcgggggtctcttttggtcccccagaatctagaagtgcaggtggcttatttcaaagggcgccgtcatagcgcacttacaacctttaaacctcctgtgggcctcaagcaatttctctccgtgccctcagcctttgggagttagcgtgggatttacaagttgcccgccaccacgccgtggctcgtgccaattactttctcatatctcagctcgtgctcagtgtttatacgtggtccttttctccctcccatattaacgagaagagttctgttctcctctctcctcgagngtgtgggtctcaaagtctccatgtgtgcaccttttctcgtgtttcacgaagctgtggagtttttgtggtgtctccacccacgtatatgaaaagagtggtggcncccgtgtctctcatcaacttctctctgtgacacgagctttactcagagcgctccagagctctcaaatatagcaagttctcttctcttattatttctccaaactcccagggtgcccccgaggatagctgtgccgttgggaatttacaactgtgcccccgaaaccccttcttcacagcccccagtggttaagagcctctgggccccgtgggagagctccccagggaccactccccggactgtggggacgctgctttgggtgtcacagcccccgggcttaaaagcctcttctccaagcctcttgtaggtaacctgaagggggttacagcccgggaatagcactccgggattc

SEQ ID NO: 591178 - DNA, 289 bp, Homo sapiens
cttttccctcactgatgcccatggtgctagaccccatatgaacattcagtttcttgaacacattattttattttatgactttgtttcttgcttatgtattcccctttctggcattttaaaaacagatgtgccctcttgtactaattattatttcatttctgtttaatatactcatcaaactatcacccttctgctaatttagagccactgctagactatgagctctttcatgggaggaactagatatggtagatatggtagtcagctactatataaggaaattgggaaa

SEQ ID NO: 591179 - DNA, 137 bp, Homo sapiens
agatctgagatcccgtactgtggtgtaccgtgacttgtgacctctggggcaggagctatttggatggagctgaaggatcaatgtctagttttcccctcagatcccacggtcaaactgcctccccttctgttttttgg

SEQ ID NO: 591180 - DNA, 356 bp, Homo sapiens
aggtcaaggcagctggatggcttgaggacaggatgttaacactagcctggccaacacggtgaaactgggtgttttctaaaaatacaaaaattacctgtgcatggtggtaggcgcctgtaatcccagttactcatgaggctgaggcagaaaaatcagttgaacctgggaggcaaaggttgtagtgagcccagatcgtgcctctgcaatccagcctgggcgacaaaccgaaacttcgtctccagaaatagagacagatagggtcccactctgtcacccaggctggagtgcagaggcccaaccacagctcactgcagcctcaaaatcccacacacaggcgatcctcccatcttacactc

SEQ ID NO: 591181 - DNA, 984 bp, Homo sapiens
gaaagtggccaatataatgttgagctacaagtgcagaaatgaagatgctcagtacagctttatcagagagtctgtagccgaaaaactatgtaaactagctgatggtgaaaagaccaccacagaagaatggctatgttctcttagaagaaggtacggaggaaacagcaatttcagcaacaagaaaataccagaggttaaacagaaatcaagcagccaatagaacataaaatagggagcatcatcagacagacaacacaaataaaacaatgctagaaactagaaccatatagaatatgccagaagcgtgcatgattgggtgcagttcattagttcacagccaactccacgaactaccacccagcagaggtgaaatcccttatccagtacttcagcccagtcattcaagaccacttaaggctggcttctgagaacttgccctcagtgcccacctccaaaatggacagcgatcaagtctgcaataagtgcccccaggaacttcaaggaagcaaacaagagatgagcgatttatttgaacattctgctccaatgctcagaggagccagactcctggcactggcttctggttgaagcagtgaaaacaacaggcccctatcctcagtgttctggctcatgtctccaggtggcagtgcatttcttgtctctgtgttggatccatcacttctgtggaggacaaatgtgcacctgaagccaagggacacaattcagacctccacagaaggacatacctggaaaacctgaggatcctaggcacgggggaacttcttaccaagacaaaagagcaaatccacaaaaggtacaagctcttagagatcccccgcacggggcggagtgcgcacaggaggcccacgaaaaaaaaggagcacctggagatcaagcgagacacaacccaagcacgtacgcggagagaggtcaacagacgggccacgggagccaagactccaacagacgaaaccagcccaaaag

SEQ ID NO: 591182 - DNA, 730 bp, Homo sapiens
ggagttcaagctccgggaagcagtttgttcgctatataaacatgtggataaacgacacgacgtttggctcgatgcaaagtctggagtctctgaagcgaatccatgaagtggcaggaagagatgagagaacaatagaatcaggggtggcaccagtgagccccgggatcagcagacagtgctcgtcagtctcagctgtgctcaggatgagcgtgtgtcccgtgtcttacctgcgcccctggttgcaccgagaaccagtggagctatgttccacattcctgcacgaagtcagggtccagaaagcccttcctccagaaccggagtttgtgtgacccccgagtatggctgcgagtgcttgtaagctgtctacagtcttcagacaacttttgtggggccccaaagtgtccgtgacctgaagaggtggaaaaacctcgtgtagaaatacgggcttgtgaacccaaagaaaggactgtagcgagccaatctgacggatatgctacttaccaggctggacctgtgctccggtacgggaaagcacattgttggaggaacagcagtatccttagaagtaaggaatggtctgaagaagttatgcaaagatggcggaaggagggatcaaatccaccaattagcattaagaaaaatataagctgctcccgagaaaggtgaagggagataggtggcacgaccgcaggcgcaagaaattcgacttaaaggaggctcttgatgagtc

SEQ ID NO: 591183 - DNA, 107 bp, Homo sapiens
agcagtgtccacaaacaggatggcttgctgatctaaaaagcttgaaatcatcgcacgtttttccactttgccacaaggcacacctacaccctcttatcccctatact

SEQ ID NO: 591184 - DNA, 127 bp, Homo sapiens
aattacaaaacaatcaaagctgatcatatgtttacatgtacttataacatgtcaccttcacttaagaatataaaatggtccccactacaacgtatattattaacttaacaacataacacttaatctc

SEQ ID NO: 591185 - DNA, 222 bp, Homo sapiens
gatgcaggagaagtcagagctctatgtataccatagtaactctagtgcattaggtttgttttttaattttaagttccaggcacatgtggaggatgtgcaggttgttacataggtagacatgtgctgtgatgttttgctgcacttatcaacctatcgcgtaggtattaagcccagcatgcattagccatttttcctgatgctattgaaacttctaaaactagg

SEQ ID NO: 591186 - DNA, 797 bp, Homo sapiens
  misc_feature (25)..(25): n is a, c, g, or t
  misc_feature (30)..(30): n is a, c, g, or t
  misc_feature (35)..(35): n is a, c, g, or t
  misc_feature (54)..(54): n is a, c, g, or t
  misc_feature (57)..(57): n is a, c, g, or t
  misc_feature (62)..(62): n is a, c, g, or t
  misc_feature (69)..(69): n is a, c, g, or t
  misc_feature (71)..(71): n is a, c, g, or t
  misc_feature (81)..(81): n is a, c, g, or t
  misc_feature (127)..(127): n is a, c, g, or t
  misc_feature (143)..(144): n is a, c, g, or t
  misc_feature (157)..(157): n is a, c, g, or t
  misc_feature (167)..(167): n is a, c, g, or t
  misc_feature (175)..(175): n is a, c, g, or t
  misc_feature (183)..(183): n is a, c, g, or t
  misc_feature (185)..(185): n is a, c, g, or t
  misc_feature (243)..(243): n is a, c, g, or t
  misc_feature (259)..(259): n is a, c, g, or t
  misc_feature (264)..(264): n is a, c, g, or t
  misc_feature (268)..(268): n is a, c, g, or t
  misc_feature (283)..(283): n is a, c, g, or t
  misc_feature (288)..(288): n is a, c, g, or t
  misc_feature (296)..(296): n is a, c, g, or t
  misc_feature (304)..(304): n is a, c, g, or t
  misc_feature (308)..(308): n is a, c, g, or t
  misc_feature (320)..(320): n is a, c, g, or t
  misc_feature (322)..(322): n is a, c, g, or t
  misc_feature (369)..(369): n is a, c, g, or t
  misc_feature (380)..(380): n is a, c, g, or t
  misc_feature (383)..(383): n is a, c, g, or t
  misc_feature (466)..(466): n is a, c, g, or t
  misc_feature (489)..(489): n is a, c, g, or t
  misc_feature (497)..(497): n is a, c, g, or t
  misc_feature (526)..(526): n is a, c, g, or t
  misc_feature (549)..(549): n is a, c, g, or t
  misc_feature (553)..(553): n is a, c, g, or t
  misc_feature (557)..(557): n is a, c, g, or t
  misc_feature (572)..(572): n is a, c, g, or t
  misc_feature (581)..(581): n is a, c, g, or t
  misc_feature (585)..(585): n is a, c, g, or t
  misc_feature (587)..(587): n is a, c, g, or t
  misc_feature (608)..(608): n is a, c, g, or t
  misc_feature (614)..(615): n is a, c, g, or t
  misc_feature (618)..(618): n is a, c, g, or t
  misc_feature (627)..(627): n is a, c, g, or t
  misc_feature (640)..(640): n is a, c, g, or t
  misc_feature (645)..(645): n is a, c, g, or t
  misc_feature (660)..(660): n is a, c, g, or t
  misc_feature (668)..(668): n is a, c, g, or t
  misc_feature (672)..(672): n is a, c, g, or t
  misc_feature (675)..(675): n is a, c, g, or t
  misc_feature (684)..(684): n is a, c, g, or t
  misc_feature (693)..(693): n is a, c, g, or t
  misc_feature (711)..(711): n is a, c, g, or t
  misc_feature (714)..(714): n is a, c, g, or t
  misc_feature (727)..(727): n is a, c, g, or t
  misc_feature (732)..(732): n is a, c, g, or t
  misc_feature (736)..(736): n is a, c, g, or t
  misc_feature (760)..(760): n is a, c, g, or t
taaggggggcggcttttattcaacngggcncaagncagggtacagggaagcccnggnggccnccacccncncccagggggnccaaaagccttcatacatctcaagggggggggcaaaaaaggggggnggggggggacgaaggnncaccattcaaaanaaaacaaaanaaaaaagnattaaggngnagattaaaaaaattttgcattacataatttacacgaaagcgatgctatcacccccccngggggggcttgggggngggcngggncattctccttagagngaagngggggggnttttaggntggnaaggggcttccngngacaacgcatctcaaatttgggatgactattaaaaaaacaacaatgngcaatcaaagnccncgcgccacattgtgaactttgggggatgctcgctccaaccgactgctgttaccttcaccgttccagtttttaaatcctgagtnaagccaaaaaaaaaaaaaaaccnaaacaaancaaaaaaaacaaataaagccatgccaatntcatcttgttttctgcgcaagtnaggntttntcaagaaagggggtnacgcaactnagtnanagtccgcctagaagcatttgngggggnnganggggggggngggctcgtcatantcctncttgctgatccacanctgctggnaggnggncagcgaggncagggtggngccgccgatccacacggngtncttgcgctcaggnggggnaatnatcttgatcttcattgtgctgggngcaggggagttatctccttctgcatcctgtcggcaat

SEQ ID NO: 591187 - DNA, 177 bp, Homo sapiens
ggttcccggggggggaaccggatttttccattttaaaatttcttttgaggggggcccccccccccggttaaaaccggttcaacttaattttttgggtccaggccccgaaagggaggtttacggtgggggccccttaaggtttatttttgggtttcctttaaaaaaatttggctttca

SEQ ID NO: 591188 - DNA, 184 bp, Homo sapiens
ggcataggactctgggtcacacgcctctggggacgtacgttcccatgtcgggagagccgtcataacgtccccgggattacagagaagagtggggggcagggcgcagcagctcaccccataaatctcagcactttggaaggccaaggcaggaggatcgcttgaacccgggagttcaagaccagcc

SEQ ID NO: 591189 - DNA, 112 bp, Homo sapiens
gagtcagacagtgccccgcatttcactgccaaaagtataaacgtcgggactcattcgtcacaggagagtacaccctgagcagtgaatcatgcatgccgtgacaggcctgatt

SEQ ID NO: 591190 - DNA, 443 bp, Homo sapiens
  misc_feature (231)..(231): n is a, c, g, or t
  misc_feature (244)..(244): n is a, c, g, or t
  misc_feature (257)..(257): n is a, c, g, or t
  misc_feature (269)..(269): n is a, c, g, or t
  misc_feature (285)..(285): n is a, c, g, or t
  misc_feature (324)..(324): n is a, c, g, or t
  misc_feature (344)..(344): n is a, c, g, or t
  misc_feature (369)..(369): n is a, c, g, or t
  misc_feature (389)..(389): n is a, c, g, or t
gagggagactccgtttcaaacaaacaaaacaaacaacaacaaaaaataaaaaatctttcagattaagctactcagttaaaaatgtaaagctggaaatgctcttccatcgacaatttctaaccgaagcatccttattctgtagtaattttcactgtgtcttgtcataacggaaacatcaaatattttatgtaatgattaacaaaaaatcataatatatgttaataactaaantatgtaaaaatangtattttcactcngatcagaaatanttgaactattaatcangatccagttatacctaaatgacttcttttgaaatgtcanttgatttcatacgaactaantttattctcatacatgttaagtccngtgaataacataattatggnctatatgatgaatagcacagtacagcagcttaaccatccttatagctttttatt

SEQ ID NO: 591191 - DNA, 136 bp, Homo sapiens
cgatacgggagaaacaacaaaggaaggaagaaagagaacagatgccctgcctgtaaacatgagtaaacagaagattcaaagctatattaagacaatactaatctgcttggacaacgcaaaactccttatccccccc

SEQ ID NO: 591192 - DNA, 200 bp, Homo sapiens
gactctaagcgatcccgtgtggttcttgcagaacagacacgcaggaccatcagaaactctgttactctgcctcatcctggcatggtcttctccatgggagaggagtgcctatgcacactatgttcctactgaacatcgtcgaggatgggctggccttggacaccacagagcagctggcggacctctggaaggaaaccacg

SEQ ID NO: 591193 - DNA, 906 bp, Homo sapiens
ggagtgtgtttaagagtagtgcttgtaccaacatgtcccgtggttccaggcgccggtttgaccgtcagatgaccattttttcacccgagggtcgggtctaccaagtagaatatgcttatagaaggctattaatcccagggatggccttacactcaggtagctgtcacgagggaaagactgtgcacgatatatttgtcatcacagaacgtaaagttaccttgacaagattattggactaccagcagcacgtgagctcacgttaatttcaagaatagactgacagaacagttggttgtggtgactgacgccggaagtgacagctgaacaggcagagttccctaagggtacacgtagggcatcgcataatgacggcggctaactggaaatacaagtatgggtatgagattccggtgggtgatgcggtgtaaaaagaattgggatatttctcagggtctacaacagcagaatgctgaagatgaggcctcgttggttgtagtaatgatggtaaatgggtatagatgaagagcaaggccctcaggtatatactgtgtgatccttggaggttactacttgtgggtttaaaaggcactgcagcgagggagttaagacaaagtgaggcaaccaggttcctgaaacgccacggtgaacgaagaaaatgggatgggcagttgagcgacaggggatactgcaattgaatgctgtgtaacggtccatcaatgaaccaaaaccgtcagaaaataacacgtggggggggccaggggaaatcctaggcgagatcggcaggaggccacgtgggggcaacctgtgctatcaggagcagaaaatggcgggtccacatcgggccctccggcgtggaccaccaaatcggggccgtggagagccccaccccagggggagcgaatacag

SEQ ID NO: 591194 - DNA, 136 bp, Homo sapiens
ccgtatccataatgtgtgccactaaatataggctttatgaagaaacataactgtgaaaatgtgtactcataaactgcagatcagtgaattattataagcagacacgatcctaaagctaacatcatccatttggttt

SEQ ID NO: 591195 - DNA, 603 bp, Homo sapiens
tgatctttttcaagcaataaataaaaccagacatattgacttctaaaaaaaaaaaaaaaaaaaaaaaaaaaaaaaaaaaaaaaaaaaaaaaaaaaaaaaaaaaaaaaagggggggggcaaaatccccccggggggccccatcccccccgttttttgttaacaggggggcccccactaagaggagatcgaattaaaatagaacagacaccagggcgcgccgatttataaaacaagccgtgctgcgtgcaaaacaacctgccctaatcgtggggaactactctttttgtgagaaaagccccaccaaacaactcgttggggggggagcgagagcacccatatcgtgtccgaagccccaaccctaccacctacagaacagaagattattaaacgccgcctcacggagcggcggaccaatatatataacactttctcagaacgtagtaaactacgtgcgggtacaacacacagcgccactattatccgcctcgggacgtaagagaagaatattccgggatcaccagggacgatatattatttaagaaacatattttcatctcacgggcggcgctttttgaatacaaacaggtcacaccaacgagcaca

SEQ ID NO: 591196 - DNA, 191 bp, Homo sapiens
tggactagcgagctgggtactagacctagaaggctctagacgcacttgtaaattacagccgctcagctatggctatacagttgttgctatcaatcatatcgtagacttaaaggaaaagaaacaggaaattgaaaaaccagtagctagtatctagaactcttcacaacattgccaatagtacagggttaagg

SEQ ID NO: 591197 - DNA, 510 bp, Homo sapiens
  misc_feature (474)..(474): n is a, c, g, or t
  misc_feature (481)..(481): n is a, c, g, or t
gttttttgggggggagaaaaaaccccccccaaaaaaaaagcctttttttagaaaaaaaagaaataaatcccccccccccccctttttttttttaaaaaaagaagcccccccccccccctggtggggagaaaaaaaaaaccccccccccctcctcaaaaaaaaaaaaaaaaaaaagaaggggggcaaaaaaaaaaaataagaagggccccctttcaaaaaaagaggcgccacacatttttttcccccccttttttaaaaaaaaaaaaaaccggcggtcccccccccggggaaaaaaacccccccccccaaaggggggggaaaaatttttttttacacaccccccttgtggggaaattttttttccaaaattgtgggaaaaagggccccccccccaaaattccagggggggggggccccaaacaccccccccccccccccccatttccccaaaattgggggggggcagccgggatncatagtntaagcgacgccaccgcgggagcccagttg

SEQ ID NO: 591198 - DNA, 1705 bp, Homo sapiens
gctctgttaaagctcgttcatcgctgtagataatatactctactcgctggcgtattctcgctagtttctctcaggctccctttctctcagtattcgcttttctcatgcgcgcctatatcgtgtatccagatcccgggttgatcatcatggcgaactgtaaaggctatacttctttctcgaagcagactactatctggggaaagatactcgagcgtctatattggagctcgccccgctttataaagggatgccaccattatacttctcttactgcggttgtgatctccaatccttctatcatcatcgcgaatagcccacataacgtctgcttgttggtgtatctcgtattacctgttctacaatggtctagaggtgcctagtggggttgcttccgcccggtagtatcccccggcggcatatttttttccgccccgggtggaattatgattctgaggttctcggtaggtcccttctatctgggatcatgctcctccccgggtcaaaggtgtgccccgttaacttccaatgttacgatataagggttagaatcatatgcgctccataggtgctgcaccattttggatcgctctgctgctttataatgccaggggggggggcccccctcttttccttccaacggtcccctgcttgccgccctgtacagttgggagtccgctttcgtccgggggcctccttaatgtccccacactggttgggagttcgtttcagcgcgtgttctcccaagcctttcccagctttaaatctcggggctttcgcgcgttctaaattaatgcgataaaggggccaccttgatccgttatgaactccctgatatctaatccatggcgttaaaaccgccaatgtaatttaacgcctatactttggactttgtggcccgtgccgtaagttgttataattcaatcctgtatgtagtaaatgtgcgatccaagttattcgccatatggggcgccacccctattcaaccatactcatctccttggttcctcatgtataaatggacgccttttccgaaattatcggggggaggtaaatgtctcctaatgtctagatgtaacgcgttcaggagaactgtgtttttttcgctatcggcaaaggatgttatgttgcacttgaggccctgttatttaccctagcgttcccaagtcgcttaaggctcgctcgtagcccctccccctaatttaataggtaagaggtcacccttgggctcacgcgctaatctatagggctattgcagcctcgcgggcttagagagtgcgccgctatgtatagttccctagcttcgcgtatagagcagctagtcgcggtagtgtacgtgcggcattcaggggaggtagtcaagtgcagccgtgaggcgtcagccattagttcgtgagactagagaagagcaagccgaaatccagaatgaattcaagcactgcttattagcaatttgtagctgggtcgtctatttttacacctccgtagcaagcgctgcagagtagcttgcgagtgctccgcttcagccattgtccgacggcatgctaacggctgcaagcatttgtttgtagccacaggcttgccacggacttgcacgtcacttattggctcaactttcctcactatctgcttcagtccgccaacgtaatatcttcagctttacatccaaacatcactttggcttcgaagccgcatcctgactactgga

SEQ ID NO: 591199 - DNA, 1384 bp, Homo sapiens
cttgtgcaaaggacttgcagattaaaaaaaaaaaaaaaaaaaaaaaaaaaaaaaaaaaaaaaaaaaccgtctttctttctccccagggcctctataacacccaaatttttattttgtggtatagaaagcccctttttacccaggggcagagattatatcagtttttatatcgcggggtgtggaaagggcttcccaagtaggggacacccatgcttctcgtaggggagcccgcagaaatgtcgctacacggggcggccttttttgatatccgacaaaagggggaaaaaacgtcatgagcccaattacctatttataaaaacaggtcgtcatttgaggatattgttgctccaatacgcttcacataatcacttctagaagctataaatataagcgcccgcgggagagagcaaacaaaaagagccgccatggggcgggggccaccaattatacatagtaggcaaaaggtgaggcgctccacagcaccactaaccagcatcgagagagaaacgcactcaccaccgaataaaaaaggcgccacagggagggccccccttcgaggcaacaaatcgacgagcacgaacggggagctactacacaaggggaagaaataaataggcgccagggcacaacaaggcaccataagggggggagagcatccctcccaaagagggaggcgctcccccatgtgatgaagcgcgcgggggacgaacaagacacaaagagagagaccaagggaggcctacaccatacgataggaacacttaggtgcgtcctacgcataaaagaggagagaaacacaaccaaaaaggtaatatggaaggtagccgcgccaaaagaaaaaaccatatgtggtgcgaactacagaaatctcccccccgcccgggtaggtaataaaactatagaacagacaaaccgcccctagtaagggagacacaacgttatatttacacaaagacaaccctcgtagtcagtaagtcggagcagaaacaacccacaaccgtaagaactcccatataacaaagagacacggggtaggagggggtggccataacgatccccccccacccagcctgagggaagaaaaatatacgcaaagaagacgaggaatccagacgagggagaccagcacaacaagacaagacaggagacttgacaaacaaaagacgactaggcagagagacggattcctcccccaaacaactgtagttggacagcgacagaacaacaccccggattaggggacaaaaaacaacacctttcaaccaaccaaataattattgagagacacgtaacaggtggccggacaaacaatacactgaaccaaagccacgagggacacagacaagacacttcgcgtgggagagagaaagacagaggtgcagac

SEQ ID NO: 591200 - DNA, 138 bp, Homo sapiens
attgtgatggtcctggagactctctgtaggcaggagggtgatgcatggcagaggcagctacagggcccggaggtgggaatgacactgacttggcctatgtgtagaaatgggctaacaaagtgtggctggagtggagcc

SEQ ID NO: 591201 - DNA, 114 bp, Homo sapiens
catagatatgcgcatctattgtccaaatagaattctgattcatctcgggggtgcacaccttcaattttaagaggagctccctgctccctttggttccggagaccccgcttatag

SEQ ID NO: 591202 - DNA, 234 bp, Homo sapiens
tagagagaaggcagattagtcgttgcttaggctgaaggtttcgggaggacaaaggggtgactcctaattagtatgggccttctgatttggcgtgatgtaaacgttgtaaagttgattgtggtaatcctggcacaactctgagtctactaaacaccactgaattgtatactgtgaatgtctgaactgtgtggtatgtagactttatctcaagttgttataaaaagctcagttcca

SEQ ID NO: 591203 - DNA, 239 bp, Homo sapiens
  misc_feature (230)..(231): n is a, c, g, or t
gacaggccagcactccaattcaggaaatacagagatcaccacaaacatgctccccgagaagagcaaccccaagacatgtaatcgtcagatttaccaaggctgaaatgaaggaaaatatattaagggcagccagagaggtcgggttacccacgaaagggaagcccatcccgtgttagtcttaccatggcggatctactctcagaacaccctgcaagtgccagaagagagtnngggggcct

SEQ ID NO: 591204 - DNA, 396 bp, Homo sapiens
  misc_feature (263)..(263): n is a, c, g, or t
  misc_feature (359)..(359): n is a, c, g, or t
tgaatcagagtaccagattacgggcatctcaaagggcctatgtcttattttcctttctgataggataactcttccatcccctgaagtctataagcaacttattcgcatgtccaatggacagggtgggtaattacttttcttccccattgaaaataaagatgggtattttgagttcaattgtagaaaactaatacccctacactgaatttttttaaatgcagatcttttttcctgacaaaaaactagggtcaacagtcaagacnactccactaactcttcagagtattagagttcatcatcagtgaatcttctgtggaatttttcatcagttggagtgcagtatcagaactattactacnaatgtactgaactgtgtcagtatcgttcgaccgcgac

SEQ ID NO: 591205 - DNA, 302 bp, Homo sapiens
  misc_feature (3)..(3): n is a, c, g, or t
ggntgaaaaactggcttttcctttctcgctgcctattttcactctcagagagaggcaggcaactggagctccactgggtcactctgagagggctgtggctctggttcttattaaaccagggccaggtgcagggctcacacctgtaatcccagcactttgggaaggtcacttgagctcaggagttcaagaccagcctgggcaacatagtgagaccttgtctctggaaaacaattagctgggcatgggggacacacctgtagtcccagctacttgggaggctgaggcgggaggatggctttagc

SEQ ID NO: 591206 - DNA, 154 bp, Homo sapiens
agggcattgagcaacggatataatcagataaatgtagtgtcacgtgatgtaaacagaagaattttaagaaaatttcccttaatttaacaattaagcaaaataataattatgcatttagagttcatatggtaatatttcaaggtaatgtgtgttt

SEQ ID NO: 591207 - DNA, 131 bp, Homo sapiens
tctaacagttcatagagcaagaaaataacaagccaggactagacacctatgttctcttggctgctggtccagtattcttggtactatgttccatatactgtcaacttagccagcttcccattcttaaacct

SEQ ID NO: 591208 - DNA, 191 bp, Homo sapiens
  misc_feature (13)..(13): n is a, c, g, or t
  misc_feature (22)..(24): n is a, c, g, or t
cggagttccagantccccaaannnatcttccacaacttcatggagaggctctgggcatacctgactatccagcagctgcgaggcaaaactgtctccgcatccgatgctgatcagcaggccctccggaaccaagcgctgaatttatcacttgcctaaagctttgtcacgcctctcacatctatgggtagtaa

SEQ ID NO: 591209 - DNA, 226 bp, Homo sapiens
ctaattggttcttcgatgacgctaattggttctcccctctactgtctgagtaaacaaaacttcatgtacaaataatggacgtgaaataattctcatagtctttttaaatgtagtaaacttcccacttaacacaaaggccaatctaatgtgatttaaacccctcatgatgccgcagcaggtgtttcagggaagggaggccctagatcgtcatcgaagaaccaattag

SEQ ID NO: 591210 - DNA, 710 bp, Homo sapiens
gctgcttactgcaactcgctccggccgctgggcgtagctgcgactcggcggatcccggcggcgcgtccttgttctaacccggcgcgcatgaccgtcgcgcggccgagcgtgcccgcggtcgctgcccctcctcggggagctgccccggtgctgctgctggtgctgttgtgcctgccggccgtgtggggtgacttgtggcccttcccccagatgtacctaatgccccagccaagcttgggaaaggccgtacaagttttcccgaggatactgtataacgtacaactgtgaagaaagctttgtgaaaatccctggcgagaaggactcaggtgatctgccttaagggcagtcaactggtcagatatggaacgcagttctgcaatcgtaagctgcgaaggttgccaacaaggctaaattctgcatccctcaaacagccttatatcactcagaattatttcccagtcgggtactgtgtggggaatatgagttgccgtccaggttacagaaagagaacccttcgtctatcaccaaaataccttgcccttcaggaatttacaaatggtcccacagccagttcgaactttgtacacgcgacagtcatgccctaatccggggagaaatacgaaatggtcagattgatgtccaggtggcatattatttgggtggacaccatctccttcttcagttccccagggtacacattaatgggctcc

SEQ ID NO: 591211 - DNA, 100 bp, Homo sapiens
cacgtaggttcagatataggacatggatatcttgtgggggggaacaagtattcagactaccacagatgcatactcatctctctctctgtatctgaggaga

SEQ ID NO: 591212 - DNA, 303 bp, Homo sapiens
taaaacacaagaagatgcaaatgtgatagtctcagtgcaacttggagttagctgttgatatgaggcttagtggttgtgagaaagtaggacgttctgtgggatgagaaaaatatgagaagatacacccattttactcaacgtgcctggcaaggttccctagataagtagtgtacaatcaaatgcatattggaacgaactctggaacgtaatctacggcagcttagactcttaagcatccaagatgtgtgactggtggggcaacacgttgacgtttaaagcaacctgattatcaagcagaactct

SEQ ID NO: 591213 - DNA, 802 bp, Homo sapiens
taacagtcttgaaaatgctttattggaaatgtgtgacttatggtgcagatgtgtgtttggaaagaccacagcttgaaaactggatttttggaaacttctcaacaaccaaatgaaaaaaaatgaaaatccctaatggggcttgacttctagtgtaaccagaagcctgggtgtaaagtttccctttaaacattatccattacagaactaaagaaaacaaagctattggtgatttgggaaatcggtgggagtttggaagtttcagaggaagaagcaacagttttctcaaacattgtagggtggacttctttttggggttacatttgggatgaacatgggacttcacagttctcggaaagaacaccgggaggggtgtccaagtctggtatgcttgtcatgttgaaaaaacggagatacacggacaggaaaggaacaaggttgacaggagaaagagaggagacttggaaaagggctcagagaaaagagaacgggaccgagacatgattaggttaagtctagttataaatttatcagaagctgtgcgcacctttttaaaagtcctaaatttactttccaaaaagggggggtcccagaccccgaaacccggtgtccctgcctttggagctatggtgaaagtctatgcacaaaaactgaaacgggacactaacaattaaccgggccttccaaacccaaaacaaaccaaaaaagcttgacattttttttaccataggattactacatataggcataatgggtgcatgattcattaagaggcttaattttaagccagaaaaataacacacaa

SEQ ID NO: 591214 - DNA, 273 bp, Homo sapiens
atctagaggatcctcctgctgctccctcttcacagtaaaattctgtagataaaaactagcatttaaaaccatactccagggcaggttcagtggctcacacctgtaatcccagcattttgggaggctgaggtgggcggatcacctggggtcaggagttcgagaccagcctggccagtatggtgaaacctcgtctctactaaaaataatgaaaaatagctgagcatggtggcacatgcctgtaatcccagctgctcaggaggctgaggcaggggt

SEQ ID NO: 591215 - DNA, 496 bp, Homo sapiens
aggcggaccacagaggcgtgattggcatgaagacggtggattatgcggagataattccaaaaaggaatgacctgaggctggtttgtgcaggtctacccaagaacagcccaggatgtcgttaaaggctgatgctctctgttagttggtaaacagctctcatggtgccctctcccccactgtacccctccctgtccacgcaccagcaattcaatagttaacccctggatccctgtgccaccagtgggggcccaggacatcagccaccccaaagctcacttatctgggtctggcttgcaggcagcccactttggccttttacagttattgttacactttactttttcctacaattttctaatctagagtgaaatggccaccagagagtataaacgccagagtgtgatgagaaaaagaggatgtcggctcctcatcctagtgcagcatggcctccagagcttattaaggccatgggaatctgcagacccattcagcctct

SEQ ID NO: 591216 - DNA, 246 bp, Homo sapiens
atgggggcccctggggggtttggaaactccccccaaccctaggacccggaccgggggccgggggggcctttggccccctccccgggtttaaacaggcccgtgggggggggttttggggggttaccaaggggggcggtaaggggccaaactgccccccggggtagggcccccccccgcccccccccagggggggcgggccaggccggccccccccccccccttttaataaaggggggccccttttta

SEQ ID NO: 591217 - DNA, 270 bp, Homo sapiens
  misc_feature (67)..(67): n is a, c, g, or t
  misc_feature (101)..(101): n is a, c, g, or t
  misc_feature (136)..(136): n is a, c, g, or t
  misc_feature (225)..(225): n is a, c, g, or t
  misc_feature (246)..(246): n is a, c, g, or t
cagaccttcaactgagataggaatctggtgctggatataggcgtctatggcaccccagctgcatgtnaacagcagcagcaagccctccttgaagggtgaanggcattcacagtctccagttttctctacaattttnataaatgttgtccgtgattcaaccagagtttccagcagaggccaagctgggtggatcacttgaggtcaggagtttgagaccagcctggncaacatggtgaaacacatctntactaaagatacaaaaaattagcg

SEQ ID NO: 591218 - DNA, 964 bp, Homo sapiens
gaccagcttccatacctccccggctaccgctcggttcctaggacaccccgcagcccctgcccaggtgccatggccgcattgtacacgccctggactgcggctataactaggcatagggctagagcccctatgggctggccatacatgccgtagacatccagaccctgacgagtgcttagctggagatctagggctcagctatcccactaggcatatcgagaattctgctagagcacagtagcccgcctagtagccaaccagagggcatccacatctagtgataggaactagaggctagagaatactagccacactagaccctgctgcgagcagcagggcctcataccgaaagctaccccaagtacaataactgctggctggcccgcacagaccccaaggatagtggcacgagtagagagcaagacggagatatgaaactccttctcagcgggacacggtaccactacccgcctggatggggcccgtagcgccagctgggcaactggcaagtaccaccagcctgataatccagcgagctgtggatagagaggtaaaccaggctgcatagcagggccgaaacatgtaatgagcatccattcagcatgggtcctagtagcgctccccactgtacccgccatcgagctgcagctacactgactcagacatatgtcgctccaacagcatgcgtattactggaccacgactgcggaacaccctgcgctacagagccccagggcaaatggtcacatttggaaaagaggacttgacacaccgagagcccaaggcccctggcacccgcgaccaggggacagccccgctcacgcaaagtagaacggcgccaacccagaacgcacaccccgaaatggccaaggaaaacccgaacaaacagggaagaacagaaccaacaggaagcgacaacggcgggaaactccagagaggacaaagagcttgcgccaaggcatgc

SEQ ID NO: 591219 - DNA, 136 bp, Homo sapiens
ctgttatcctttcattcattggatttatttgaggtaggataacgggtaataattttgtttgttatctttggtaacactgtgaaaactttgccagttgatgtgaagctgtgcagttataaactaacgttctatatgc

SEQ ID NO: 591220 - DNA, 342 bp, Homo sapiens
  misc_feature (160)..(160): n is a, c, g, or t
ctcaattggacgaaggaaagccacccaagctgtccttatgccaggagtgccgacaggtcaggaggttgggccagcggacaggagcatttcacactcactaacctaacttgtgaagctgtatgggaccatcttcaactggccttatgaggagaaccagatngcttatgggagaatccacaggacggagaggagcgatagggaacgtggctggggaggaggctatagccccttcctttctgggctccggtataggcagccagggctccaggtcctggtcgtgacctcacaatgacagcacagtttttgcagcttaaagatcacccatctgcccctacctagcta

SEQ ID NO: 591221 - DNA, 350 bp, Homo sapiens
gtaaggttaagtgacctgtcctatcagggccacaaagccagttaaacttttttattaactgagtcacttaaaaatcatttatttaaaaacctattttgttccaggaactattctgggtactggaaataaaacagtggagacagagagaggggaaataaaaaacaagacaaaaatgattgctttggtggagtttatatattccactggaagaaggtagataataaataaaagtgaaaaagtacattataaggtgggaggaaggcttgagcctaggaggttgaggttgcagtgggccgagattgtgccactgcactctagactgggcaacagggcaagacgttgtctcaaaa

SEQ ID NO: 591222 - DNA, 570 bp, Homo sapiens
  misc_feature (316)..(316): n is a, c, g, or t
  misc_feature (323)..(323): n is a, c, g, or t
  misc_feature (377)..(377): n is a, c, g, or t
  misc_feature (381)..(381): n is a, c, g, or t
ggccggccggtggctgcaccacactgggtcccacgctggatccagcggcctgctaaggaaccgggggccggacgggagcacagaggcaagccaatcactaaacatatcaacacagacccaagacagctcagaatataaaataacaatccactttataaaccagaatggtgaaacattaacaaccaaaggaaaaatgggtaattctctgctaaatgttaaggttaaaaataatctagatattgatggctttggtgcatgtaagggaaccctgacttgttcaacctatcacctcatctttaaatatcacatatatganaaattanatacaatcactgataaggaaaatgacatactcaatctggcatatagactaacanacanatcacagttggactaccaaatctatttaacaaaatctatagacaatatgactgttcaaatgcctaaaacaatggctaataccaaacaatccattgatatagacaatacctgctaaactataacaaataggaatattgtcatagaaatttacctatgtttataattattatgtcttaaaaggattaaatt

SEQ ID NO: 591223 - DNA, 186 bp, Homo sapiens
cccgacgggtgctccaatttcatgtggggatcagtggtttgtgagattccctcaaccagaagatggaggtgcatcgccggccctggttagtgaagctcgcgggatcagcgttggatcacgattgccggcgttcgtgaactgcagttctcgccacatctgcctcttctcacagatcacgaggggtac

SEQ ID NO: 591224 - DNA, 163 bp, Homo sapiens
tatctgtggtgtcgtgtacgagtatgtatttacacttcactgttgcttgactaactgcccagatgtgagagttgaaccttgttgagagctcccatgtggtttagttctcctgcggtaatatttgagtttctgaccctacaaacctcaactcacttaggcacaa

SEQ ID NO: 591225 - DNA, 628 bp, Homo sapiens
acgtcccaaccgtcccaacccggtgtgtgccagtgtcgaatctccgatcccagcaccagcaggaaggatcaccgggtgaccaaaatgtgtgcctcctcctgtgacttcgttaaacgacactttttctcagacaatttgatggggtttattaactttgggatcttaaaggtccacgtggactcctgcaaaaaggatttttgcaatggggcggcaggggcagggcacagcccctgggccctggccggggggttcctgttcagcctggggcctgccctcctttggggtgggccctgatgtttcctccttcccacgggggttttgagcttgttcccctgagcctgtgggtgccctttccccagcctggggtggttgggggtgggggcacccttggcccagctccgtggctgtggcctgtggttttcactcctcccccgaggtgaagcctccctgtttttccgccagttttgagtcccaggcaggtggacatttccaggaaaccaggccatttgggcaggaggcctggggatgagggtggggggggacccccaggtcccggaggggaagtgaagcaacagcccagctggaagggggttttttgcggaaaaaaaaagtcccttttgagtcctga

SEQ ID NO: 591226 - DNA, 841 bp, Homo sapiens
ggttggtgccaagatgtgctggccgccgaggtgacctggtgtggctgacggcgagcgtgtggcatgacctgtgcttccgtaaccactgtcgtgttcgttgcgtgctcctggtgagggactcgaaagaaccatgagtccaacctgaagctgagaaaccgagcttcttctgtcgttgccttctgtctgcctgcctgccgctagttgcgtgacgagaaacgtggtcttgtggcctcgtgctggagatgcttttccttgtgggactggaggaagacatgctccttcttgagtcgttcgccttcggggccccagctggcgtgctggcgaagagcccgcccgtgtcccagtaccagaggattcgctttgcataaagtccacgcccttgtttgaaagtctagtcaaggtcttgttaaggcccaacacagacggtcatgtagcacttataggaactaaaaggacttatggtacttagaattacctaagaggattgggggcaatgatgtctggacttgtgaggggctgcgacggagtgggagcagtgtagtacttgtaggtaggcaggtccaggtatgcggggggcgggtgtagtgaggccagggtcggaggtcggtgggagtggttggcgcggtgcgtggagtggtagtccggggtgagagtccgtgtgagtcgccgggcggtagggcgggctggtggggcgggtcggggagtatggttgtggttcaagaaagttgaacgtccaggtacggtgagagcccggggtgacggcgcagggttgccgtggcatagggtacttgcagcaaggccgaccgcaggggcgaggtctgggacatcggatcaggtatgg

SEQ ID NO: 591227 - DNA, 800 bp, Homo sapiens
atgcccataaatcaagcagtagtttttggctttcatatcttattatttaagacatatatttcataaggttatagctgtcataaattgcaattcttctgatggatctgggcaaagtaaattgaaaacctttggaaaaggattcaccattctagatgccattagtaacaattgtgatttagggaagaaggtcaaagtgtcaaccttaacagaagttttgacaagttgattccagctctcctggatgacttttagaggttcaagacatcagtggagcaagtcactgcagatgtggtaaaaacagcgcaagaattagaatgagaagtggagcctgaagatgggactgaactgcttcatctcataataaacctcgaacttataaaaaattgtttcttatggatgagccaagaaagtggtttcttgagatagaatctacccctggtaaagatgctgtgaacactgttgaaatgacaaccaaagatttagaatatggtttctgcttagccagttgagcagtggcaagatttgagagaaccgactccaattttcaaagaagttctactatgagtaaaatgctatcaaatagcatcacatgctatagagaaatcttgttaaaggaaaagtcaatgatgtgacaaatttcattcgtgtcttactttaaaaagtcgcacagcaccttaactttagcaaccacaagtttatcagtcatcagcatcaaatcgaggcagatattccccagaattactgaaggtcagatgaccttacagttttagcaatacatttaaattagatttttttgacct

SEQ ID NO: 591228 - DNA, 1345 bp, Homo sapiens
gaactgcatatgataccttcagcttgaagcttgctggtctcgctttctggtgctgagactaattatatgcaaagaaagatgcaatatggggagattactcctagcagatgaaacactgttaacactagaagtgctacatgaagtctagattgaatgtatgttgatcatagatgctcattggactctttccataggcacattgactgctcaaacagtctcagtagcagggtcgagtgctcatagagaactcgagtgtatataagcctagcgtagcctgcttcaccatttacggcttttccgtatcctatgtacaccagatgctcgtttcctgcgaatccacaggacgctgaaccatcttcctgtctgtgcctctgcttagggagtcacctcaatgcgaactttcttccgacgaccccacgatggcagactcctgcttgcgggctcaaggagcactaggctatacacgtcgcgccacaacggcacccatctgagtgccacattcagccgatttcgacgccgatgacctttccggatctacacgcaatatcgttcagggtccttccccaacttcatctgcgaacggcacttgttgaccgacatccaactcgggcactcacacgattggacttacattatgagaatttcatgcagctctggtgtcgcaatacccacgttgtagaccgtaacacaacattattcagggcgtaggtgaaagcaaacaggggggtcaattttgaaccaatgtacagaggcttcggcgcttttacacgagaggtgagcaagttctgtgggtagcggagttccgtgtccccgcagtgaggcataggcgatatgttcatcgctcccagggaattggttggactatcgcaaacttccgacagtcgagcgcggaaaacagggcattgcgatcctcgggcgcatgaaatccagttggtccgaatctttcttcactttttccccctgttgcccagcacgagaacgcgcattctccacgcgcaaggaggactttttgcgactggcataggcggtgccaaattgtttcagaaaggacagattttacggcatgtcccccacggcaggcccagtgccgttaaccagcgattcattgtatcccccacaagacaatcctttgtgagacgcctgcttgcaaccgcggcctgacaagtgtcatacgaactccctctagagctgccacaccgccggttaaggaaaacatcctggactcaagcggtcttcctttggcagtcccacagactcgctctcgtgcccacttgtttaccatcagcggtacgtggtgtccccccagtctgcacgcggcgagtctctgcttcctgacgtcagtggc

SEQ ID NO: 591229 - DNA, 126 bp, Homo sapiens
aagactgtggatcaggcgaagacgtggcagttcgtccctttccctctttacagtgaatggctgcccacagtcacaagcagtttatagttgacatattcttctagatccggtgtgtagccacagtcg

SEQ ID NO: 591230 - DNA, 248 bp, Homo sapiens
ccagtcatattaaattagggccccctctacccttaattacctctttaaagggtctatttccatatagcctgaggtgtaatgggagttagggctgtagcatataaattgcaggggaacaaaattcaattcataacgctttgtttgaattttttaatccccatgatacctctccctccctttgtccccatgtaacttgtttttggggctttaccagatgggtgaagagtaaatcctttttccctttggca

SEQ ID NO: 591231 - DNA, 244 bp, Homo sapiens
cactgcgaaacacgttcggtcggaagccgttgcttttccctgtgacggcatcatcaatacctgatacctgtctggtgcagccccggcggccaggaagaaaacatgcagccctatagcgacttcgggcatcaccagcgccagcggtgtcctgaacatggggatcaaggtaaactcttccacgacatgcagcacctggttcttggtgtagtccccgtcactgacaatcgcattgtctgcgtccgaa

SEQ ID NO: 591232 - DNA, 707 bp, Homo sapiens
cacagcggctcacgaggtcaggagatggagaccatcctggccaacatggtgaaaccccttctactaaaaacagaaaaattagccgagtgtggtggcgcgggcctgtagtcccagctaatcggcaggctgaggcaggacaatcgattgaacccgggaggcagaggttgcagggagatcgtaccattgccagcccgggcaacaagatcaagactccatctcaaaaaaaaaaaaaagaggggaaaaatgtgggcctaggggggggagaaatcggtttaaaccgcgggagagtttgaggggcgcgaactggaattggggttcttggccatggggtttccaggccaggggtgacaggggaggggtggtcttaaaaaaaaaaaaaaaaaaaaaaaattttgggggcgcgcgcctgggcgcccccgaaaaacgttctcaaacacaatccggttggggcgcgcgggggcgcccaatgggtgtagggaaccaggggccaaaacgggaggcccaagagaaacccggggcaaagaaaaaggggcggggagttctccccccaatatgaaaaaagcgcccgggggggagaaaccgcagggggtttctgtggaacaaacttccaagagggggaggctcaggaggcgccatacaggggggccttataacgaagggaggccaagggaagccgagtgtcaaattaccggggcgatgcgcgggct

SEQ ID NO: 591233 - DNA, 139 bp, Homo sapiens
tggagttttgccgtgactcgccacccagctgggctccgcctggtctctgccctggcaacccaccccgcacccaccaaggggcagctgccttttccagtaagtttggcgtggcagcgcctatgtcgctcccatcctgcgc

SEQ ID NO: 591234 - DNA, 569 bp, Homo sapiens
aaatccgaatccaaggttcccaaatcggcccgcacatccaaacaacccgaagaaacttggggcgaatacgcgagtacttcccgcagccttaccgtttaaaataaactcttcggcgtctcgaactataactaaggcgaagcgaagtagtctggggcgcgcatgccgttaactatggggcgatgtagacccgagctagcactagggtccctcgtagaccggccttgactgcggaatgaaagattctagaaaggaccacatactcctcgaagagagactatttgaattttccagtctttttactcgaaaaccgggcgctaggaacgcatgctacccggcccgctagacacctagaaccgttccctccttttccacgtacctcctacctcctaaactgttcctctccgcccgaggaactaaaggtcccgactagttccctagcgaagaccagcttcgcgcgcgaatagctctcgaacgttaactcgtattttcgaccgaaagtgggccgtcccttcttaaaactttggatccctaaaagactttccctatgaatctcctaaatattagagagc

SEQ ID NO: 591235 - DNA, 186 bp, Homo sapiens
catagaaaaggtgtagtaaaaatgtaatatgacaatcttatatggaactgccgccgtatatgtggttctcgttgcctaaaatgtcatcctgcagcacaggactgtacttctgtgggtcagctttactctgaaatgtctgtgtcttaacctgtaatattcaacctggacagtgaagaacttagtaca

SEQ ID NO: 591236 - DNA, 892 bp, Homo sapiens
cggccgatctctgtttattaagatcagacatgcgaacggtcatacttactgctgaaaggcagacactgaaatgggccatgaaaggggggggaaaggctctgactatcagttcgagggattgaacctcacatcaaacctatatacaagcgtgtgtgtagctagcattaaaaagcaaaggactatttcatgtcatgactgcttgacggctccctcttcatatgcattccctgtgccattctgtacataggatgaaccagaaccaaggccatacaaatgaccacaatatttggcatcatcaatatgatcttcaaagaacatttctctcattttgaaaaaggccattcctgtgagcaatgaatcagatcctgcctgatgttgtggtcctatccgttccagctctaactgttctgccacctcctgtaatccacctttgagatttttgcagctctttctgaggtacttcacatcataaatgacaggaaaaaacaatcgaaggatctcaaagaagtcaagttctttttcaggcaagttagagttggttaggattttgataaagaaccaaagtcgtaaccgcttttaaatgacaaccttttgacccttaccaaaggacactccagagtcataaaaagtctgcaaggactgggttcaattccctcctcccaatgttttaaaccggaaaccgatgtggtagtagccccaaaaatcccggggcaacatggcctcctgtgagcggggggtaataaagaaagcacctgcgcttaagttccaaacgtggggtaagaaccctgactcgtttgcaattaaccgggaaaggcctttgggcaaaaaatcactggattatcccctgggatatctccaaggcttcaaaagaacattgagggcttaagccagg

SEQ ID NO: 591237 - DNA, 844 bp, Homo sapiens
cggttgtttctcttccttcgcctaattgcctcccggctctcgtcagcctcccgccggcgtctccttaacagcgaacaccatgccttcaattaagttgcgagagtgtctgatggcatgagatatttgaagtggatgtgtgaacattgccaacacagactctgtgcacctattaagcacgcatgtggacagatttgggaatggatgatgaaggagatgatgacccagttcctctatcaaatgtgaatgcagcaatattaaaaaaggtcattcagtggtgcacccaccacaaggatgagcctcctcctcctgaagatgatgagaacagagaaaagcgaagagatgatatccctgttgggaccaagaattcctgaaagttgaccagaggaacactgtttttgaactgcattctggctgaatagtaacttagacatcaaaggtttgcttgagtgttacatgcaagacggttgcaatatgatcaaggggaaaactcctgaggagattcgcaagacttcaatatcaaaaatgagttgactggaagaggaggaagcccaggtacgcctgagagaaaccagtggtgtgacgagcaggtgacctggttgtggctggacactggtaaccactggtacggatggtccccctactagttgactggtctggttctcaatggcattctttgacacaccgtgtaacatggcgcgggcacgtccttggttatgggaaaatggtccatggggtgtttttggcccgatcccacgcttgggccattcctcaatgggggaacagcttggggggcaaaaaacaggggcccaagagagggggccccctgagaaggggacatcgcaag

SEQ ID NO: 591238 - DNA, 327 bp, Homo sapiens
  misc_feature (7)..(7): n is a, c, g, or t
  misc_feature (65)..(65): n is a, c, g, or t
  misc_feature (73)..(73): n is a, c, g, or t
gtggggnggtacttttgatagccttgtagtctgatcattgtggaactgagggtaagattgagagngcaagccncagacctggaaaggcatgatattgctatcaattatcctttccactgggagtctcattatacggatgagagaatgttttgatggtggcagctagcttgcttaaagattgaccaggattatgtggtggttctgccagagtacctggactataatgaatatttaagaaaatgtttcttgctgggcatggtggcttgtgcctgtaatcccagctacttgggacactgaagtgggagaatcacttgaggccaggagttt

SEQ ID NO: 591239 - DNA, 809 bp, Homo sapiens
gagccccgtccctcacctcgagttgtctcgccttcctggaccaaaccaatgtacatcttacacatattgattgatgtctcatgtctccctaaaatgtataaaaccaagctgtgccctgaccaccttggacacatgtggtcaggacttcctgaggctgtgtcacgggcgtgtgtcctcaaccttggcaaaataaactttctaaattggttgagacctgtctcggatactttgggttcacataaggaaacaggaagcagagatctggtgtctatttctttttccaagcacaatgtaagcacagttctaggctgtgtttgtcttgtgagtccttcctggctcccctcaggcactggctttctctcctctctcctgccttctctttctggatccaccctccaaatgttggagttccttagggtttgattcttggaactcttctgtgtttatgtgttctccctagatagcatcatccgtaagtgacttaaatagcactcataatgcttaaaaaaaaaaaatttccatttctagcctggacgtctctgaatttcagaataaggtaaatgaagaattcacctttatacaccttaagtttgaaatgccggtgatttatccaacagcctccttggttttgggttttagccggatcaccggcatctcatttaactcaacgtatgcacatctgaattctactggactcttcctaaacttgcactctgctccatctcagccaatgggaccacccagtttcctgagctaagtgccttctttgacacctttcttttcaacacccaccttacctgtctggcacc

SEQ ID NO: 591240 - DNA, 884 bp, Homo sapiens
agcgggagtggctggtagtgcccgtgtttgctctggttcgacggtggccgtgtagttgactccgcggctgttcatctccctggtatttcccgtcctaacgtcgctcgtcctttcagtcaggatgtctagcccgtggcccggctatcggcatcgacctgggcaccacctattctgtgcgtcggggtcttccaacatggcaacggtggagatcatctgccaaggaccatggacaatcgcaccacccccagctacgtggccttcacggtactaccagagcgcctcatcggcgacgccgccaagtaaccaggtggccatgaatccccgatactagactatcatcattcgactgccaagcaggctgattggacggacatattcgaggatgccacagtgcatctcggatatgaaacactggcccgttccgggatggctgagcgaggcgaggcaaagcccaaagctgcaagtagagctacaagggggcagaccacagaccttcttcccaagaagagatatcctccatggtcctcacgaagattgaaggagatcgcggaagcctacctggggcggcaaggctgcaccagcgcggtccataacggtcccggcctatcttcacacgactcgaagccgccaaggccaccacaggacgacaggcaccaatcacccgcgcctcactgtgcctgcgccatcactcacacgacccccacggccggaccagccaatcgacccttacgcgcactggaaccaccgacagcgcgcatgacacctccgccgcgcgaacaacaaaccgtatcatccctccttcgacccctgcacaagtcacgccccttctcaaccgctgctcacaataccctcacccacacccaagcactggcacaatccaccca

SEQ ID NO: 591241 - DNA, 364 bp, Homo sapiens
  misc_feature (237)..(238): n is a, c, g, or t
catcggcaccactcatcgccagtcgcctccacatcactatcactgtcatcaccttcacatcaccattaccaccattacattcatcaccattgtcatcacatcaccttcatcactatcatcaccatcatcagcaccttgatcaccatcatcaccaccaccaccattatcactatcaccttcatcatcaccaccatcatatcacattatcatcaccatcttcaccatctcatcatcacnntcacttcatcaccatcatcatctcatcacctccaccatcattatcaccatcatcaccatcacaaccatcatcaccattttcaccatgaccatcatgatcatcaccttcattatcaccatcatcttc

SEQ ID NO: 591242 - DNA, 518 bp, Homo sapiens
gagccccgtccctcacctcgagttgtctcgccttcctggaccaaaccaatgtacatcttacacatattgattgatgtctcatgtctccctaaaatgtataaaaccaagctgtgccctgaccaccttggacacatgtggtcaggacttcctgaggctgtgtcacgggcgtgtgtcctcaaccttggcaaaataaactttctaaattggttgagacctgtctcggatactttgggttcacataaggaaacaggaagcagagatctggtgtctatttctttttccaagcacaatgtaagcacagttctaggctgtgtttgtcttgtgagtccttcctggctcccctcaggcactggctttctctcctctctcctgccttctctttctggatccaccctccaaatgttggagttccttagggtttgattcttggaactcttctgtgtttatgtgttctccctagatagcattatgagtgctatttaagtcacttacggatgatgctatctagggagaacgtc

SEQ ID NO: 591243 - DNA, 438 bp, Homo sapiens
ttagagatcccccggagccttaccctgaggctgggagttgagaccagcctggcaaaatggcgaaaccctatctctactaaaaagacaaaaattagctgggcatgatggcgggtgctgtggtcccggctactcgggaggctgaggcgggagaatcgcttgagcctgggaagtggaggttgcggtgagccgggatcgcgccactgcactccagcctcagcctgggcaagaaggcaagaagagcagaactccatcttaaaaaaaaaaaaaaaagggaaaaggaaaaggaaaaggaaccaaggaaatggcttgaggcttgaagggaggagaactggcaaccacttctgtggtgatcgggtgggaatagctgtctcataaggggaatggggatagcatttcggatatggatagagattgattgtatatgggacctaggacggt

SEQ ID NO: 591244 - DNA, 273 bp, Homo sapiens
cctgagctattcagcagaaaggaccttggaagcacggaggatggggatggcacttatgactttttgacagacaaaaaggatgaaaaggcagagcccccaaaaaaaaaggccccttatgagggcaggaaaaaaacgaccgtgtaccgagggctggtccaaaagcgcgggaaaaagcagttgggctcgttgaaaaaaaagttcaagagtcatccccgcaaacccaaaagcttcagctcctgtaaacagtcaggttaataaaagcccatgccgtga

SEQ ID NO: 591245 - DNA, 955 bp, Homo sapiens
cgtacgcggaggcgtgggtcgtggatgccgtggtgcttgtacctgaccctcgttcacgtgacatgccttctgagtcgatctctcacgagaaagcgctgacatcaggcatctccatgtaacagtaggtgatcccatcttgaagtgccagtgtcctacgtgatcagcaggcacctaacctatgggcactacgaagcggacctggtcagatagagatcatcaccttctgtatactcagactaagacgcccagattcaccatgagacgctccgagacttcacagccttgaacgagagacacattacaacttgagcggagttggataaggcgtctgagtgtgattgagaaccatatcatagatcttcagtgagcagtgcaacatcctagtaggcattgagtcccagtcgcgatcacatacggtagcgaccacagcctaccgtcatgaggcgaggagcctcccgcccagctccgccaggggtccgaggttcccggaggcaacacctctgtgctagacgacagacctagcccccactccagggagcttggcactgccggaccagctccgacgcccgcaactcgggacatgcggcccaaataacacgcgtacgcgacccaacccaccacctcacccccgaacactcccgagccacacgctccacgcccccgttacaaagagaaacacccgaacacgtagcacacatcgcgtaatcggcacgcaccgccatagcacctcagcgcacacgagaatagcagatccgggcacacgaggaaacaggaccagcggaagtcgagcacgcagcccgaacacacgcaccatcaccgccgcgggccaccagacgactccccgccaccctgcacacacaggagcccaccggtcgcccgaattggcacgacgcgcacaacgcggccctacatccgacgcgcgacaccggctccacacgccctccggcatacgctg

SEQ ID NO: 591246 - DNA, 133 bp, Homo sapiens
ggagggtaatgacaaactctctggtgtggctctacctggaaacaggtatggacacaatgacctcccttgactatgcgtggctgaggtcctaatcggagacttccttactccctcatcctcctctgtgctgtcc

SEQ ID NO: 591247 - DNA, 114 bp, Homo sapiens
ggcacaaacccactttattcagcattgagccagcccacacgctgggcagttcaaactcacagacatcgcaccacaggtcgggtacttatttgggctgaaaggcttcatttggaa

SEQ ID NO: 591248 - DNA, 170 bp, Homo sapiens
tggcacctaagatcccggacactacgtatgttgcatagaactatacgtgagtcagctcatctcaccttatagatatctactctctttgatcagacgtagagatagacgtgcacacacgatggataactgagcacggaatacgtctcggccatttgacgaaaacactagta

SEQ ID NO: 591249 - DNA, 2333 bp, Homo sapiens
  misc_feature (1391)..(1391): n is a, c, g, or t
gggaccaccttcttttggcttcaacctctcccactcttgacatctgagtagctcagggaagctcttccaggtccgactgttcatatgtaaaggagactggccgctgggctcaggaccgggattatccgagctctgcagaagtgcaccgctattgctttgggagggaaaaaaaaaaaatcacacggtttccagtgaaaaagtgacagagggtggtggcctttggaaccgtcgtcccgtctctccctgaacccgaaacttgcatgctatggaacacccgctctttggctgcctgcgcagccctcacgccacggcgcaaggcttgcacccgttctcccaatcctctctcgccctccatggaagatctgaccatatgtcttaccccgagctctctacttcttcctcatcttgcataatcgcgggataccccaacgaagagggcatgtttgccagccagcatcacagggggcaccaccaccaccaccaccaccaccatcaccaccatcagcagcagcagcaccaggctctgcaaaccaactggcacctcccgcagatgtcttccccaccgagtgcggctcggcacagcctctgcctccagcccgactctggagggcccccagagttggggagcagcccgcccgtcctgtgctccaactcttccagcttgggctccagcaccccgactggggccgcgtgcgcgccgggggactacggccgccaggcactgtcacctgcggaggcggagaagcgaagcggcggcaagaggaaaagcgacagctcagactcccaggaaggaaattacaagtcagaagtcaacagcaaacccaggaaagaaaggacagcatttaccaaagagcaaatcagagaacttgaagcagaatttgcccatcataattatctcaccagactgaggcgatacgagatagcagtgaatctggatctcactgaaagacaggtgaaagtctggttccaaaacaggcggatgaagtggaagagggtaaagggtggacagcaaggagctgcggctcgggaaaaggaactggtgaatgtgaaaaagggaacacttctcccatcagagctgtcgggaattggtgcagccaccctccagcaaacaggggactctatagcaaatgaagacagtcacgacagtgaccacagctcagagcatgcgcacttatgatataaacagaggaccagctccattctcaggaaagaaatgttgtggatggcaagcctttacccaaatatcgtttacacagagagatgactatggcagtgatgtttaatattattaaatccaggcatttcgaatctgtttttcattgatttattagagggtttacacaaagagcttccacagtgaagatggagaaggtgaacttgctttgaatatnccagatttgtttggtcatgcgtatggcagtgagcaggtatgtgttttcttttcttcacgaaaattaaattgctatcaagagcaaactatgaacattatattcaagatgtctccagagtgaagatgccgaggatgaacttgcattgaacattccagatgtgtgagatcatgtgtattgcagtgggcaggtatttgcttttgcttgcactgaaaattaaattgctatcaagaataaaccatgaaacattttatcctgaacagccacagtgcctgaattcactcaagtggataaaaaagtgtattttaactctgtatattacccttaagtcattttcctgtcttcactaatttagcaatgcattcatattagctgatgaaataggcactcacaatgacaaccagagccagtttcttgtctttttatacattttgtcatcccagagactcggtatttgcttactgtgtttcaagtagaggaaatcgtggtcttgaactattctgtaccacagcaaacaatctatgttgctttactatcaactgctgtaatcgtttataaaacttacctagctccttcccttcttctatcatagctttaaacattagaattcataggcaaatcagttaaaacattaggatcataggcaaatcagttaccttgcagaaagagctttgtatgacagacattgtcttattttatttctgtaaaatattagctgtatgaatatgatttaattaacaagaaaacatttcttcctgattgacaacagtgttagcaaggtgcaaagcgaaactggttgctcaagttgatagaaaacaaaattctgaatatcttcaaattaattcggtaaaaacacattattttttcatatgtgatgtattcatgcagaacaactatcttgtattttgtttttaaaatgtgtttaataaatgatcctttgtaaat

SEQ ID NO: 591250 - DNA, 939 bp, Homo sapiens
  misc_feature (390)..(390): n is a, c, g, or t
ctgtattccatcctgggcaacagagccagaccctgcctcaaaaaaaaaaaaaaaaaaaaaaagggccgggcccgggggttcacccttgttatccccagcctttgggggggttggggggggaaaaacactttggagggtcaggactttttggagaccaggcctggtgccaagcatttggtagaaacccccggtcttcttaccaaaatataacaaattaaaaatttatccaggggcggtggtggcgcattgtcgccatattagcggccccagcgttactcagggaaggctaaaaggcagcagaaggaattattgttgtcgcattccgctggggaggttgataagggtgtgtgccgggtgagagccccagagaaatcacaccaccacatctcncacatctcccacatggttgtctgggaacccaaccagagagtgtggagacacccactctgtgtgttccacaacacaaacacaacagacgaagacacaagacaagagaagatgagagagaacagcattgtgctctttttgtgggggctcccacagtgtggcagcggtggtctctccaccccttcttttattcctctgagacccattggggggggggagcgtacgagagcggccggagagaggactatggtcgtgtgagggcgcccacgaagattgttttcccaaatcacgggccgggggggccccaccctgtgtgccggagagcccccctatctctcttcccaacatcacgtcgacaaattatttcggcgccgggaagacgacggaggagacggttgtcgccccgtttgagtgtccccccggattatctaccgcgagcgaacgcggggcgggggcgggacacatcccgttggaccccggcggcgaggatcgaagagcgagaagcgaagcggcgtggttttattccccggctggtggcttcccgcgccgtta

SEQ ID NO: 591251 - DNA, 113 bp, Homo sapiens
ggtgctgtctagaggatcccgtgctggtgtataggtttggtcctagcctttctattagctctaagtaagagacagctgaaccctcgtggagctttaatttattaatgcaaact

SEQ ID NO: 591252 - DNA, 803 bp, Homo sapiens
  misc_feature (1)..(1): n is a, c, g, or t
  misc_feature (32)..(32): n is a, c, g, or t
  misc_feature (203)..(203): n is a, c, g, or t
  misc_feature (265)..(265): n is a, c, g, or t
  misc_feature (271)..(272): n is a, c, g, or t
  misc_feature (316)..(316): n is a, c, g, or t
  misc_feature (331)..(331): n is a, c, g, or t
  misc_feature (333)..(333): n is a, c, g, or t
  misc_feature (386)..(386): n is a, c, g, or t
  misc_feature (395)..(395): n is a, c, g, or t
  misc_feature (402)..(402): n is a, c, g, or t
  misc_feature (412)..(412): n is a, c, g, or t
  misc_feature (420)..(420): n is a, c, g, or t
  misc_feature (455)..(455): n is a, c, g, or t
  misc_feature (459)..(459): n is a, c, g, or t
  misc_feature (487)..(487): n is a, c, g, or t
  misc_feature (516)..(516): n is a, c, g, or t
  misc_feature (527)..(527): n is a, c, g, or t
  misc_feature (530)..(530): n is a, c, g, or t
  misc_feature (563)..(563): n is a, c, g, or t
  misc_feature (574)..(574): n is a, c, g, or t
  misc_feature (622)..(622): n is a, c, g, or t
  misc_feature (636)..(636): n is a, c, g, or t
  misc_feature (699)..(699): n is a, c, g, or t
  misc_feature (713)..(713): n is a, c, g, or t
  misc_feature (798)..(798): n is a, c, g, or t
ncccctaaaagcccaaatggggtaggataagnctcatatcgacattgtcgtcattggcacgacgtagattcgggcatagtccaccactactggccatctgatctatatatgcggtggcatcgacagagaagaaccattgaaaaatttgtgtaggaggctgctgagatgggaaagggctccttcacgtatgcctgggtcttggntaaacatgaagctgagcgtgaacgtggtatcaccattgatatctccttgtggggatttgagnccagcnngtactatgtgcctatcattgttgccccaggacacagagactttntcaaaaacatgattncngggacatctcagcgctgccctgtgctgtcctgattgttgctgctggtgttggngaatttgangctggtntctccaagantgggcggncccgggagcatgcccttctggcttacacactgggngtgnaacaactaattgtcggtgttaacaaaanggtttccactgagccaccctacagccagnggagagtatgnggngattgttaaggagagtcagcacttacattaagnaaattggctanaaccccgacacagtagcatttgtgccaatttctggttggaatggtganaacatgctggagcnaagtgctaacatgccttggttcaagggatggaaagtcacccgtaagatggcaatgccagtggnaccacgctgcttgnggctctggactgcatcctaccaccaactcgtccaactgacaagcccttgcgcctgcctctccaggatgtctacaaaattggtggnattgg

SEQ ID NO: 591253 - DNA, 1448 bp, Homo sapiens
  misc_feature (448)..(448): n is a, c, g, or t
  misc_feature (461)..(461): n is a, c, g, or t
cgatgaaggaaatgatggtaaagcttgaactaccttctcattgtgtctaaattagactcacttataaacacgcttggcagtgctattgtgaagtggctaactcgcatatgcactaacggcgtatgggaacaggaaaaatagaggacacagggtgatggggaccaatggacctcattcaactgatggttgactttagacgagaaagagtgcccacagttcattgagctgccgagtgtcaactcagaattatcactagaattctccctctatagggcgatcgacgtatcagcgggacatcatggttagtcagcaagaattagtcttcagacgagaataagaataagcgaaccgaatgcgaaggtgaacgaagatatcaaagtagatcacacgagcagcgaaagtaaggcacattcgcagatcccttccacgcggcaaggggagacccacnaagatgtcccctntcccacaagggacatagtaaagggtcgttatcgtggtggtttctatatccgcttatctagattctattacaggactcaaggctctgtgcgctagtacctgtcttaaacatcctgaaggagtgttggagtacagcggccgcagcattaccccaggtgagtattactcgtgtagacgtggacagttcaggggccactggtggtattgtaccacgtaagactggtgatatttcctagcttgggtatattagctaaataggagacactggaagttgttaacacgaagacctttagtccatggcgttcgtatggagagtgaatggtggagatcactgttgaccatgaaacgtaccacggaccattaaaactttcctaaacgtgttggaagcacacacgtgggtctcgtactcttttcatccaagtctcaattgggcacaaaacattcaaatttgtaacaaccacactttaaggatggcctttttaaggttggtggccaacgtcctcccttgatgcacgggtccttgggttctttgggtgagccaggaaggcttaaagccacctttgggtatctggtgactgggtcgaggtattggtgccacatctatgtgtgcggaaaccgatctacaattgggaccgcagaaaccacagaattaaagggatccggaattggagcccctaatatttactccacccgacaagtttgaacaaattatattcctgtccccatattgggagtaaactatggaccggcacaaacgactacttgggcgggtgtaatcggtccacgcgaaaacgggggatctttccaagcagccccttccgggatagcagaacaggtggtttatcgcacaatctgctcaccacgacacgcgtcagaaacaagtagttattagcaaccggggtagacagacactaaccatgatatcacgcgccacgaatatatacgccacaatgagagggtcataggtagtcacacaatcagcgatgcga

SEQ ID NO: 591254 - DNA, 1200 bp, Homo sapiens
gaaagcaagtgcgagtgtggctggcgcgggaaagttcgggaacgcgcgcgtgccgtgtctcggagcagcgccagtgacacgtgtcctggggttttgctgcgtgtggtcactggctcccagtatctgtctgagtgccctgtgtggctggacgcacgcactggtacatgagcacccgtcaccgagtgcgcttattgttcgacggggcgatcacagacatctcatgggtgtcagctaggcgtgatcccccactaaggttacctatgtgagatttgctacaagcacacggactttcatccaaggaacctcttcacttgcgtggaccaaggctgtgaagcctatatgtaccattgttgcgtccagtccctgtagagaagacgatccatcctgccgaggaccccatttccgaggcccgccagatgattgggctcaacccagaggtactttgcctccgtttcttgccttggagcaagcaatcccttcatgcttcgtggggaccttcaaggacagctgggtgtcatggccctgatgtttcacccgaaagtggggccagtatatacattgacaacgacatgtgactatattacttacttatattgaggatacacgccacggattccgggcgccttcacgacaagcagttaaagtgccattgcacccggacacgggtggcactgctgcgacgaacgccgtgtccggtgccagggtgcatgtgtccccccatggttgaatttgggaattggctagcgcatagtgcataggggggggaccgcgcgttgtaaaaacgcacagttaccgggaggaaggcctaggtcgatacggaaaagggccccgatcttgaccctcggtcttccaattgacgtggacacctgaaaatgtcgttacccctggtcgcggtgtctatatatgttgggcttgtggtacccctggcaccgttttcggcgtaggcacaaaaccactgtgtggaagttcgggcgcacggaacatcttgatagaaagagccaccaggaagggttggcgcccctggtggagagggaaggaaaacgagccctatgcgaaagagcttttgcgccggagacgtcattttatggctctacgagtgagcaacagccccttttgcactatgagctgagcagaaagtgcagcggaacacgtttgaaaagtggagtcaggcacaacaagccggcagtggcgtcatttgtc

SEQ ID NO: 591255 - DNA, 894 bp, Homo sapiens
  misc_feature (21)..(21): n is a, c, g, or t
  misc_feature (82)..(82): n is a, c, g, or t
  misc_feature (117)..(117): n is a, c, g, or t
  misc_feature (125)..(125): n is a, c, g, or t
  misc_feature (136)..(136): n is a, c, g, or t
  misc_feature (159)..(159): n is a, c, g, or t
  misc_feature (210)..(210): n is a, c, g, or t
  misc_feature (227)..(228): n is a, c, g, or t
  misc_feature (230)..(230): n is a, c, g, or t
  misc_feature (247)..(247): n is a, c, g, or t
  misc_feature (285)..(285): n is a, c, g, or t
  misc_feature (302)..(302): n is a, c, g, or t
  misc_feature (411)..(411): n is a, c, g, or t
  misc_feature (421)..(421): n is a, c, g, or t
  misc_feature (435)..(435): n is a, c, g, or t
  misc_feature (459)..(459): n is a, c, g, or t
  misc_feature (509)..(509): n is a, c, g, or t
  misc_feature (512)..(512): n is a, c, g, or t
  misc_feature (593)..(593): n is a, c, g, or t
  misc_feature (616)..(616): n is a, c, g, or t
  misc_feature (630)..(630): n is a, c, g, or t
  misc_feature (756)..(756): n is a, c, g, or t
  misc_feature (798)..(798): n is a, c, g, or t
  misc_feature (810)..(810): n is a, c, g, or t
  misc_feature (841)..(841): n is a, c, g, or t
  misc_feature (848)..(848): n is a, c, g, or t
  misc_feature (886)..(886): n is a, c, g, or t
tgcccaataccaaatcgccgnttccccaaaagcccttttccctgtatcaagaatgtgctttagagtatgtgagcaacctgtnttcagtgtagtacaaaggcagagtgagggggcttnttttcctnccaaccccacnccccgttcagcacagccgccatntgcaaggaaggcctaatcatgttacaatcactgcccactgaccctctcccngcgggcctcccccttcnnantcaggcacccccaaaantctgccaacagactcagtcttattacagctttgaccantggttggaacccatttntagagctttgctaataattagtgtggtcaagagccgtctgagcctaatgagtcccggctgcattaggttaagagactcttccagagccagcgccaggtcttgaatggcncccccccccnggatacacaccccncaggtccccaggacctggatgacnccccccccactgtggcagtgtattgcctgttaattgctgctaattctaantcngatgatgactcctactccattgtttaccccaaagcatcagctaggctggagtgatttgttacaaatgagcaaaagatgagnccttgcttccctcagaaataaangagctcagctgccncgttgcattggcttttgcctccaactttccactccagaatcagagtagcttcatttcccttctggagaacaattgtcagaggagtatgagacccctccccttccatccttcactctagcagtcctngcttttctcatcactcccttacatgcctgtgacagtgctacntgaggacacaanctttttagactttcttgcttgatattacagngtctatngtgcataggtgaggtttgccggaatagtaatttatagnataattct

SEQ ID NO: 591256 - DNA, 197 bp, Homo sapiens
gggggggggggttttttttttttaaaaaggggtttttttggggcccgggggggggtttttttttccccccccccccgggggcccggggaggggccccccctttccctggggggcccctttttttttttcccccccggggcccttttagggggcccccttttttttttcccccaaaaaaaccctttgcccccggggga

SEQ ID NO: 591257 - DNA, 410 bp, Homo sapiens
acgtttatctcaagaaaataatcagcaaatctgcaaactggatccaacagtacattaaaaagattatataccatagaccaacatttatcccaggacatgcaagagtggttcaacataaggaaatcaatcaatgtgatacaccacattatcatctcaacagacacggaaaagatatttgaaaaaattcaatacccttttaagattaaaaaaaaaaaaaaaaaaaaaaaaaaattgtaatcccctccctgggctaaattttccatttttggaaaaacatgggtgctaaaccattggtgtgtgtcgtcgtgtgtgtgtatatagatgtgtgtctggtatcgtgtgtgtgtatccttggaccaatactgtgtgcaggtgttaaacacttcaactcaattaaaattgtttggaaa

SEQ ID NO: 591258 - DNA, 1239 bp, Homo sapiens
ccccaggcacactgcatcgcgcgcggacgctccggccccggcgaggctggctgcaaactcgcgggcacgcacgggcgcccgggcagagccgacgggacctcgagggcgaggggactgctgcgcgcaacgcgcccagccttccatcccgaaccgacacctggcacagcccagcgcacgcccgagctgtctcggacgggcgccccaggaggaccccaagacctgagcccaagaagacccgcagctggccggcgagcaggccggcgcggctctcccctctttactaccacacgagaccgaaggccaccgagatgccagtgagacgagagtgaacccagtgcccgcttaaaaaccagacggcgctggggacaaatcctttgttaattacacccgggacccaggcttggaaatcacgcaaaggctccggactacagacgcccatacaggacacttcggagaacccggataccagcgtttctcttccccggcaccttccctgagtctagctcacaagggtggataacccctagagacagcaaccaatcacgccccactccgcgcgaacaagaaacctccgaccggagccgccacaccggacggggctcgaccaaccggctaaccccggtccttggcactccatccacacgcgccaggaactagaaaaccccggagccacaccccaacaggccgcacaccccgtaacacaaacttacaccaggacacactcctcttcctcacataattcttgcactacagacccacccctcttccaggcttgaattgactccctagacttctcgggcagacccagaacccctaaccccaccctttggtgaccacccccgacaaccaacgccacttccctcagatgggcgcctaccctccccatgtcattcccatgcaacttatgtcaccgcaacggcccacacaccagaacgaaacgccccctgagcaaaaggaaaggcaaagcgcggacgcaacacaccacacccactgagacaccccaaaaacccgtgcaatcaccacgacgccagcaacccgccgcacccggggccaatgaacgacacccagcagacactgcaatcgcacaaggcgatagaaccacacaccccgtcgccaccgcaccttgctcgtccatcactgacctcactgccggccacccactactgccacgccgccgcgtccgcagacacaccgcacacagcaccacaccgacccaaaccgcgcctacgcactaccccc

SEQ ID NO: 591259 - DNA, 285 bp, Homo sapiens
  misc_feature (118)..(118): n is a, c, g, or t
  misc_feature (132)..(132): n is a, c, g, or t
  misc_feature (284)..(285): n is a, c, g, or t
ctagaggaccccggtgtacgagtaagggagaagaataagaaaaacaggactttggtataaaataattaagtatagactaaagagatattaagaatctcaatttggctctaagatggtnctcagtaattatanaaatcctgtgagtctttctgggaaatcctgttgccatattaacctgtggtcctttcagagggtagttggtggatctattctttactggtatttttggcattatttcatgggggaaatgtgggagtggcttactctgtacacacggtgtaccnn

SEQ ID NO: 591260 - DNA, 302 bp, Homo sapiens
gccgaggtcacatggcagagagtcaccatgtggctcctcgcatattcgtggccatctacaacccatccatgggcgtgtccgtgctggctccctaccgcgagcgtgtggaattcctgcggacctccttcaccgatagcactatccgcctctcccgccatgagctggaggatgagggtgtctacatctgcgagtttgctaccttccctacggacaatcgagaaagccagctcaatctcacggtgatagccaaacccaccaattggatagagggtacccaggcagtgcgtcgagccaagaagggg

SEQ ID NO: 591261 - DNA, 1053 bp, Homo sapiens
gggctcggaagaggccaaggtgccagttccgtatcggtcgtcccgcaatccttggttcatccgcacagcacgccggcttcctaccatgccgacgaaagcttcgaccccaaccgagagtcaagatggtcgtactagccgtgacgcgtgcaaccgggacggtgacacgtctgcgtgccaacttctgccctggcccctcatagatcggcctccctgtgtgttctgtctccgatatctaggttggttgagtgactaagttgcgcaacgggcgaaacgagtctgagctgtgacatgtggctctaggatgtgaatttagcaggtgaacaacttgcaccagtatcgaagataccaagatcaagtgacccatgaagttagatggctagggttgcggctttcctagccgtacttggctccttgtagtctagtctagaatggccctctagatggaagccaaccaaagtagtacagataaaagaacaccagaaaaaacattaaacacagtgggaatatcacttttgatgcagattggtcaagcagttggctctgacagatgcggctacctgatccttagccagatgaactctctggaacctattaaacgagatcctggggacgtgcccagtcatgtgggctgtaatgttgagtggccgccatcctcagtgacatcatcgagtgacagtcaacagtggtgctgtgtgaatgcccagccagttaagcacataaggaaaaccatttcaatacaaggattcattttgacaaacctcgggtgcacatcccacagcagcaagcacatatcacaagagagcaacctgtcacggggcgctgcatagtgaggcgggtgcgggaaccaacaggtggttttcatggtgcgctgtgggcaaaaagtgattgcggggacccccagatttcacgtgtgggaaccacaaggcggtgccaatcgcgacagggtgcaccataaaggggggaggcgacaaaaagccgcgaaagcgcgaggaaacgcggattaggacacgccgcacaaactggcacaaaaggcacacaggagccacagtagaa

SEQ ID NO: 591262 - DNA, 245 bp, Homo sapiens
aactatgtgtagccatgcgcccagccctgtgagcccccacttatatttattttttttagagaaatagaagtctcgcatggtggcccaggctgaagtgcaagggaacgatctcggctacactgaaacctccgcctccgtgggattcaagcgattctcctgccattaccctcccgagttagctggaatttacatggtgcccacctatttgcccaggctaatttttttggtatttttataattaagaa

SEQ ID NO: 591263 - DNA, 371 bp, Homo sapiens
ggtcgacctgggcaaagacatctgtaccaggacaccagaagatcagctctctccttctggatgtggttatactgcacacaacacagagaactcctgtggctatctttctgagtcagaggatgaagtggaggatgtcagagctcagaaatgggaataacctgagtccttgctgacatcattgagctgctttatcaaccaaccctggagctcacccttcctttgaacttcctgttatgtgagataatgaggttcgttattatttaagccaatatgagtcaggttttctgttacttgtagccaaaagcatcctggctgatacactccattagaccataattacctcaagggcaagggaatacagatactatcac

SEQ ID NO: 591264 - DNA, 167 bp, Homo sapiens
cggaccaactatgcgtggggaagacacaggagaagctctcatagtcctcggattgctgcactccccgccgtttctgcaggagctgggggcacacggggccagcaccacctcacacgtggcacctgtgtagggcagcaggcagttgcacttgtaccctggcaacgtcg

SEQ ID NO: 591265 - DNA, 397 bp, Homo sapiens
gagcatggagattatagagaggcagtgactacaccctgacacacgctagcacactcgttgacgtggactcctatcaggaaggtcacaatctgagtcaacacctttacgaggtctgaagcggtggaagcaaacttactctgcccgtacaaatccttgtagtcaatgttaatcgcaaagagtatggagtccggacctgctgccagtggtaggaagcatacgggacctctcttcatccatcacaaaagaccagtcttcataacaagtactgcagactgaaagagaaaaggaaatcgttcttagcagtggttctctgatgtccattaaccaggaaattccattagacggctccctggaagatctgcacctggtcaccccaggagggatatgatttgtctga

SEQ ID NO: 591266 - DNA, 722 bp, Homo sapiens
ccgattattcttccggagaggagttctcggttagaagagtcaccgcaacatatttgggccgtttcccacgtagcataccgcttttggtggctctccgctgggagaacgcgttagaaggtggagatgaagctctatggggaccccacgaagttgggagagagataattatctctatatataaaatgggggcacctcgctctggttatttggcgcagtgtatatactcgaaataccagagaagccaacatttttctagttgtgatggaagaaagctgtattctttataggggagaatattattgttgaggatggccaagcgctacccctcgcctccccaggtatttttgggcctccggggcccaatgcttgttggatgtagaaacatcttgggaggagtcccccaagaatagtctagaagaattatgggagttgtacaccccttatgcgccacgactgcacactagagccaccccctccccacggaatgggtccgacatacctggagaattaccgcacccaaccctctctttatgcgcgtggagtattttgtgaacccctgaggaacacaaatggttaaaattggggggggaaaaagcccccacacccaatttggagcaggaccaaaaccaacacatgatttttgtaactcctggttaatttagatattttgacctggtttttgaattaaatattttttttggagttggaaaaaaaataattaa

SEQ ID NO: 591267 - DNA, 958 bp, Homo sapiens
gagtggcggcagcggcggcgacggcagtaacagcggcagttacagcggggacgcgagccgggcggtgacggtgtgggaggtggtctcactcttggggaaaaactgctggcccaccgtcgtcgcgctgaaggttggttctgtaccctgctcccgagtgtgcttagcgatggcctggaaatccggcggccgcccacgcccactcggaggctaaatccacaatctccgcaaaaattggcactcatcaaagcaccagattaaaggttatctgaaagtgattgctggataacagaacccgctccccacatttatgcaaatattgttaaccccaatactattggtattcctcccacaaatccaatagggttccccaagcaacaaatcaggtgcttccaacaagaagtgctattggcaatatcgcgctaggaaacttctctatttggactccagtttgcatggaacggagctaaaacgctcctgtggatgtcaggaccccgaaatgtgggaaatcccttaacgtgcattgtgtggcacggtattgggtccggagatgtcacctgcacaaagtcatagggacttggactccaccttttaaagagctaggtaagagtgactccaggtaaaatacgttgtccagggacggacgactccaacactttcctgtccttcaggggaagaggtaccaggctttgttgtgcgcggattgacacgactgggatatgctgaaagaagcccctttattgatgccattccatgtgggaagcctgcgcccctgtttgtaccccagggcgctaattggcatcagtaaagcccgaggaaagatgggtatggctggtggccctgcggggaaaccacatgttcgcggcgcttacagctccaggaggcgggctaaaagaagcccccaaggggggaaaccgggccttaacatataaaagcgcgccggggagaaatactcggccat

SEQ ID NO: 591268 - DNA, 891 bp, Homo sapiens
aactcatcaaaggatagaagagaggaatgagaaaagatacaggaggaagaaataagcgccgggtggccgccgtgctcaccagagtgtgcagcagaagtggggatgggaaggaccccggcggcccattggcaacttgggggaaaacgccttctcgtgtagcgagtctttaagcttgggaagcccccacaccctggggtgccgcccaccccggaaagggcgccgatttacaaaggaccggtgtgccaacgcagcagtccgccgcgtgggttaaacaaaacaagcggccacacaaggctaagaaaaaagaaggcccgggccaaattgagcatatttccacaaaaagggtttaggctatctttttcgtggcgaaacacgctgccccctttaccgcccgcctgtctagtaacaggtcttttgttggaccccgacaacttaggaggcttcgagacctatccgaaacatagaggggtctttttaagcaaaattgtcacagagagagtcaagtgtgtgcgtagcacaacgtcgttcagatcctcccgtctttggtgcaaaattggaccatcgtgcctggagggctccaacacgcggcaggaaatttcaaagggtacatgattgtcataagacccagagggagagattatttgtttcctttttcaattaataggtgaactcccccccgccgatggctcgcattccttgtatgccgacccactttgtgcgcttagtttggtggcccgggagcggggacacggctaggggtcttttatgcgcccagagcacattaagtccagcgccaccgataccacgataggttccacaagtcccaaacaatcccctatggaaacacattgtcgccccaaccccacttttaaataccccccccaaataaca

SEQ ID NO: 591269 - DNA, 558 bp, Homo sapiens
  misc_feature (58)..(58): n is a, c, g, or t
ggactattatgcattttccactgcacccagccccatttaagagagttttatatttagnatctcatacgccctacaccatgattttaatatactgcgaatcttaggattccagctcaatcataatgccaggagctaaggcctttcacgtcaacattctccctattatatcaaaccacctgactgcagtcccctgtttacgtataagcctctcctccctccctctctccctcttcatcctcctcctttctctacccctccatccctctataccccacactcctccattctccttccttactttcttcattcccccctcttatcatactcctccttcctccatctacttcctcccctccccactcactctcaccctccttctttcccatctccccatctcaactcccactcacccttctccaacctcatcccttcctttctctcctctcatcactctctgtacttcatcactctcccctccttcttctctactaatctctcttcttacctcattttctcttcttcctcctctcccccctctccctcgcccctcttttcccg

SEQ ID NO: 591270 - DNA, 433 bp, Homo sapiens
  misc_feature (289)..(289): n is a, c, g, or t
  misc_feature (373)..(373): n is a, c, g, or t
  misc_feature (388)..(388): n is a, c, g, or t
agtttgctgatccctcaccttgcctctttcttcaaaatctccagtgttgagtattctccagtttccaagagacctgctttggaccactcatttagaaagttcttacgttctaaaaaaaataaaatttggttttccgtagactgctcctgctggtacttgttcaacttgagtatgttgagtaactaaaaataaatcaaatcgctcttccacatattgggcggccctttatatcttaggaacaacactatgatcatgactccagggcaggaatcttgcaggaatcctgggngtggattaaacttttcacgggggcctttcatttgtcaccaggaagggggaggcattaacactttttggcacagcttaaattgtngggcccacctagggnttttctggggggcgcccaaggaggcaataaggagggaagttttta

SEQ ID NO: 591271 - DNA, 194 bp, Homo sapiens
ggagtatatttagtagagacagatttcaccatgttggccaggctggctctgaactctttacctcaggtgatccagcccactctgcctcccaaagtgctgggattacaggcgtgagccaccacgctggcctaagctgggattgtgagcacatgggaatgtaaagctgtgggtggattgctgtgcgtggcagaaat

SEQ ID NO: 591272 - DNA, 531 bp, Homo sapiens
  misc_feature (452)..(452): n is a, c, g, or t
  misc_feature (492)..(492): n is a, c, g, or t
  misc_feature (511)..(511): n is a, c, g, or t
cgtgagtcagggtgggggtgcggaattggctgctagcggtgactttgacacagggttacggaggaatcctcactcagatgcatttggacgtctttgtggggaaatgacgtggcgcctgggatgtactttacgattctaataaagaggagaaagacacaacagtattggctgaatgttgacagctgttgaagccgggaggttggtgtgcttgaaagttccccaaatcttttatttgcagcatgagtatgagtttcttcgtgctcacggaagattgtagagagcagctgtcggtcatggagtcacagggctgccttaccaggacaccaccggcagccccacagacaacacaggtttattctctccagctctgcaggctggaagtccgaggtagaggtgccaacagggtccgtttccggcgagcgcctcctggttcagaggcatcctcatgtcangagggggctttggtgtcaccttttcccttgtgaagggccngaatcccatgacccctatnaccccattgaagccaaaatc

SEQ ID NO: 591273 - DNA, 284 bp, Homo sapiens
tgtactaaacattctactactcactctcactgaccaagaactatcaaagctcctgagccaacaactctaagtatgactagctgacacaatagctttgatagtagaagatacctctttacgtgatctccactatatgactcccgtaaagcccatgtcgaaggcccatcatcgctggggtcaatagtacttgccgcaggccgtcttaaaatctatggcggctatgagtatagatacgcccatcacacgtcagttactcaagcccctctggacgaaagatcacgata

SEQ ID NO: 591274 - DNA, 148 bp, Homo sapiens
gagcagccaggcactagccaggctctccatgaagtatattataagctagtctgccatgcggctctgggactggccactagtgtggcactgtaggcgggctgtgatacaggtacttgagacacctttctgtcctgatgctagctgatac

SEQ ID NO: 591275 - DNA, 1008 bp, Homo sapiens
gctactgcacatgggtacttagctagcaggctacctttagattctgagaattccagttaactgctgtaagaagtgtatcaatgctatttgcacccgaggaaggatgtggatggattgagctatggcatcaatgctgggagacttgctacgagagtgacctcacttgactgtttcattgccttgtacgcctaacgggatagctctggcaactcatcaaagagacagtggagtgccgatatgccgtagaggcatgctgtgcttaggttgtgtgcgacagtacaaatagttcgtgggaccccggatgcatgacgtgtggcatatctgtgggaaacaatgccatcagtgaccacctgttcctactcacgaaggatctgcaccatactgggatgaccggagagtacatagtacacaccggttgaccaatccctggtgctgtgtatcgcaaattctggatcaatgtcgcttcgaataatgcgctataaatagagagcgaggtgcgatacgagaatgcatgggagggcacataagtctattcggaattgctgggacattccaaaattactgatcccaagtaatagactttaaaaatagaccctgacaatgtgggcccatcgaagaggaaggcactacgtagtgaggtagaactcgtttgaggcagaatttacgtcactccctaagaaccgcataaaagaacatacgtagggcgaagaaggacattccaaatacgacgtttccctttggtggctcctcggcttgatggtagcataatggaggcgtttccgcaccttagaagcgccgcgctcaagggggcaattagttcggcccattaaattcgaaccggacgacggtttcgaaaggcgaaatcattcgcaaggttggcccataacagcgtggattagacacccaaagaagaagggaacaatgtgtgttaaaacatcgcgacaagggaaacattacgactccgtgtcattagaagtttcacatactcggtcatcaggcaaagacacg

SEQ ID NO: 591276 - DNA, 884 bp, Homo sapiens
gggggtcgtatgacgcacttttccagctcgagccctcacgaggccgtgggtacgaccggaagccgcagatgctgatcccattttcaatgaagaatgcttccagttacttgtaactgccaggtcccagcagctggctttaaaaaaccagtaaaaaatgggctcattttacagtcaatttccaatgatgtctatcaaaatctggctgtggaagactggatccattgaccatatgaatctagaaggcaaaccaattctattcttttggcagaattctccctctgtttgtaatttggtaggcatcaaaatccttggcagggaatgtaacctgaatctaatgagagaagaaggtataaacatggtcggagaacgaagtggaggaggaacagtcttaccatgatatgggtaatatcaatttgactttcttttacaagcaagaaaaaagtatgatagagtggaaactctgaaattaattgtgagagttctgaatgctgtccaaaccccagtggatgtggagggtaccaaaagatttggccttttacttgatggacagtttaaaatcttcaggaaccagttctaaagatcggcgagtagtgctatcaaccattgcacttattatgtagtactgatgggacgtcctgtcttctttgtaaagagccttaccaggtatcggagcatgcactgtaggatacttcttagtgaaatcttgggaacggtcccattggctgggaggcaagaagcggcgcacagtccgtgctatctaatgaaccatcccataaccacgtgaaccgctggaatacgaccaagattgggcgtcggacccataaatcttggttagccgacattctacaggacttcacctgcgacacaatgggcaaaccacgagg

SEQ ID NO: 591277 - DNA, 522 bp, Homo sapiens
  misc_feature (1)..(1): n is a, c, g, or t
  misc_feature (98)..(98): n is a, c, g, or t
  misc_feature (100)..(100): n is a, c, g, or t
  misc_feature (105)..(105): n is a, c, g, or t
  misc_feature (107)..(107): n is a, c, g, or t
  misc_feature (140)..(140): n is a, c, g, or t
  misc_feature (143)..(143): n is a, c, g, or t
  misc_feature (149)..(149): n is a, c, g, or t
  misc_feature (152)..(153): n is a, c, g, or t
  misc_feature (155)..(155): n is a, c, g, or t
  misc_feature (157)..(157): n is a, c, g, or t
  misc_feature (161)..(161): n is a, c, g, or t
  misc_feature (190)..(190): n is a, c, g, or t
  misc_feature (262)..(262): n is a, c, g, or t
  misc_feature (271)..(271): n is a, c, g, or t
  misc_feature (273)..(276): n is a, c, g, or t
  misc_feature (301)..(301): n is a, c, g, or t
  misc_feature (303)..(303): n is a, c, g, or t
  misc_feature (313)..(313): n is a, c, g, or t
  misc_feature (315)..(315): n is a, c, g, or t
  misc_feature (321)..(321): n is a, c, g, or t
  misc_feature (328)..(329): n is a, c, g, or t
  misc_feature (362)..(362): n is a, c, g, or t
  misc_feature (365)..(365): n is a, c, g, or t
  misc_feature (380)..(380): n is a, c, g, or t
  misc_feature (417)..(417): n is a, c, g, or t
  misc_feature (420)..(420): n is a, c, g, or t
  misc_feature (502)..(502): n is a, c, g, or t
ntgtggggtgggtggggcaggcaggcccctatctccacacgtccagggagtagcggcccttggtcatcagtttcttgatgtagtccaccgcctgttcntnttccntngccccgagctcagccacgatgtcgtagaaggtnttnttttcnttnntngncatnttccgtgcatccccacagacgtagatgtnggctccgccttcgatcaacttccacaggtgctctcggtcttgctttagcaggtgctggacgtagaccttgtnggattgctntnnnntgttggccacgttgtgctgggtgancnctccgccccngnggaacngcgccanncctcccggtacaggtagtcctcatccgagcggnggnagctaagatacagcngcgtctcccccacctccttgctctgctgtcgcagccnggnccgctcctgggatgaagcctatgaagggtgccaccccggtgccggggcccaccatgatgacaggggtggtggccttgaaggncaggcggaactgggacttgc

SEQ ID NO: 591278 - DNA, 112 bp, Homo sapiens
atacgaggattgtagatggatctggcgaaatcagtcacattaattcccatgaggtgggcaactttctgagcagctgctgtcatctgggcatggagcgccctggtcccgtgct

SEQ ID NO: 591279 - DNA, 166 bp, Homo sapiens
ccggacctctactcattccacttcactccactccactcaattccattccactcgattccattccattcctttgtttccacaggatctctctctatcacacaggcgggagttcaggatctcgacaagaacagtttcagggctgtgtggggataacacatgactagag

SEQ ID NO: 591280 - DNA, 127 bp, Homo sapiens
ttttcccgggggggggggggccccaggatttgggggtttattcccccgcggccggtttttcgggcctttttttttcccccttggtttggccccctgggcccaattaggttggttttttcccccccca

SEQ ID NO: 591281 - DNA, 549 bp, Homo sapiens
actacatacttccgcatgttgcccaggctggtctcaaactcctcggttcaagagatcctctcgcctcagcctcctaaagtgccgggattacaggcatgagccactgtatccggccccactttttctgtaaaggatcagatccgtagctatttacacatcgtgggctatccagtctctgtgcaactactcagatctgtcactgtaacgagaaagcaattatagacagtacataaacgagtgaatgcggccgttttctggtaaaactttattcataaaaacaggtagcaggctggatttggtctgcagtttgtagtttgttaacccctgtccaactcattgaatgacagtagtacaccggaagagacatagtgagcctgggagccttaatgagagagctagctgtcttctaaggatttttgtatgacatctgtgtatttggttcacccatttgccaaataagtactatcatttctctcttcttgatcaagaaataacaggtttcacatgatgctttagaaaagaatatagttgtgcatatatgagttgtat

SEQ ID NO: 591282 - DNA, 745 bp, Homo sapiens
atgctggtcatggacgccccgaaccgtcctcctgctgctctcgagcggccctggaccctgaccgagacctgggccggctcccactccatgcaggtatttcagacaaccagcgcatgtcccggcccggccgcgggagagcccacgcattcatcatcagatgggctacagtggacgacacgcagtacagtgaggttcgacagcagacgccgcgagtccgagagaggagccgcgggcgccgtggatagagcaggcggggccggcgtatcgggaccggaacacacagatcttcaagaccaaacacacagactgaccgagagagcctgcggaacctgctgcggctactacaaccagagcgaggccgggctcatcacacacctccagagcatgtacggctgcgacgatggggccggacgggcagcctcctccgcgggcatcaccagtacgcctacgacggcacaggcttacatcgaccctgaaccgaggacctgacgctccatggaccgcggccggacaccgacgagctcagatcagccagcgcaacgtggacaaggcgagcccgtggtgcgcggacgcaatgcgaacacgacagcccctacccaggcgaaggagaccccgagcagtctgcacagcctggcctacagccaaaactacacatgagcacgacaccggaaaagccgccaccacctgaacgccgcgccgcgaaccccacacaacagaacacacacgtgaccccacccaccaccca

SEQ ID NO: 591283 - DNA, 1185 bp, Homo sapiens
  misc_feature (151)..(151): n is a, c, g, or t
  misc_feature (162)..(162): n is a, c, g, or t
  misc_feature (165)..(165): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (211)..(211): n is a, c, g, or t
  misc_feature (232)..(232): n is a, c, g, or t
  misc_feature (236)..(236): n is a, c, g, or t
  misc_feature (240)..(240): n is a, c, g, or t
  misc_feature (273)..(273): n is a, c, g, or t
  misc_feature (275)..(275): n is a, c, g, or t
  misc_feature (277)..(277): n is a, c, g, or t
taacattctgccctctgaagggtaaaaatttgatttttgaggaatttcttactgcccattttcaaacacagtcacataagaaagcacaaacgctcttctcccctcatcctaaaaataaataacaaggacataaattgttttttgttttaantcatgacactnggnggtttagcnccngcntccaaaatgaacaaaaacggaaaaaaaagcntttactatatatttcagattncttnggtnggggttctccccatgtggtattaatatttcgtngntnaatatatatattaccaaaacagtaaaaaccaggaaaaaaaatagaaacctagcggtggctgaaactggagaggctactctctggtcttccgtgcaggaattcccaggttctcagcttgctggcaaaaattggtggacatttccttttggtagatgtttcttaaagaataacagtaaacattccaatgtccaaatctgggttagtcttccacttaatggctgggatgtaccttgggtgtgggttaaggttgtggcctgctttaggcttaatttctgaatggtcattaattcttaaggtcacctgccgatggctgacaggtgcctgaggagcctggtgtaactcagaactgctctgctgggtggctggaccagggttctccagtgggtgcttcacctgccttggcctcttggccatcttgtgaaggagcgtacggaggacgcgggctcaacgccggacatcgtaggcaccgccgatatccacggcgcacaccagacggatcggttgggaccactggggtggacttgcagataccctctaatctacagcctctccaactgctgaggcagctcgtggaccaggaagtccctgtaacggactctgagcggataagatggaatacgcaagaaccgcgctcccagaaagatgtgcacaccactgagggacttccaacacataatctctgtgcaacaatcaccagccggaatatacggcagcgcaacggagaacacaccaccgttaacccacagccacaacgcccgtcccacgacgagaacgggcgcaccccccacccagaatacagcacaaacacagagaggcgaactagacacgcacccaacaaaatactcacagcacacacacaaaactacaccacgacaccacaatccacacaccccaaaaaccgcaccaca

SEQ ID NO: 591284 - DNA, 390 bp, Homo sapiens
tcaatcctagtgggttcatgtcgatacttatgagtacacttctccacagaaacaatactatgaatcggtgctcgagttcccaggccagcctccctcaacaggttcaactctaatatacctaacctgtgatactgaaggtgcctgcctgagttatgggtctctgagacagggtagtgtgagtagtttggaggaaggacagtgcaactttccaccccttttcctaagaacaatgtctttctccttttaatttttccactcattttcacctcctaatgcccttgagatccaggtacactcctgggagtatagttcacctctcccaactgagaaccttcccactgggctccatcctccctcctgaggttcttcatattccagagtcacccaacc

SEQ ID NO: 591285 - DNA, 150 bp, Homo sapiens
gcactcaatatcatctcacagctctgagtgccctgggccagattacttcctccacccctccctatctcacctgcccatgccgtgtgctgtggccctgcaacttggaactgttggtcagattttctgccaataaacatcttgtgtgtttgc

SEQ ID NO: 591286 - DNA, 398 bp, Homo sapiens
  misc_feature (30)..(30): n is a, c, g, or t
gaatacccagtaagccagcgggcagcaacnctggacgctgatgctgtatggccagcaaacccagaaggtagtgtaagtctggaccgcagcataatggctctgactcagcacacatcactgccaacagggaggtaagctgtgcactgtccacaggtggccaagagggatggccacaccacatgagctagtccctgcgtcctacagaaacacacacctaaaagggtggcctttagggctttgataaacagcacctctacataaaaccaaaaactctataatagagttccacatgtggccagaggtaacattgaagaacttgtaattatgccttagggaatcggaagggaaatactcacaggtataaggaggacatttttgtctctaattagcagcaagaa

SEQ ID NO: 591287 - DNA, 748 bp, Homo sapiens
gagagagagagactagttcgagtttattattatgattttttgggagctaagggttatacacagctattattttataattctattacaccttaaacctcccggagggccgggtggacaggtggcttgggcaataatacctctaatcaaccaacaggtgcaactggcaggtaaggtggacaaagatgtaagatattccagggcatatctaaaggggtataggtatctagaggagtataggagagagccccgcacaccacaccttctatatcagagagacacacagaggagctggcggggcgccaagctggtgagagtggtgcgtcccacacctggtgaaatacccgagcacacttaggcggagagggcccgaggaaaggcggaaactccaacttggggaggggttacagagggagagttgtggagagacacgcgagccggtggggagagaacgtagtggggcacacaccgctatatctctcgacactatacaaaacactcacaaaagagtatacagcggtggaggtgcgagggaggagagagtgagtagccgtaggatccacctcacccagagacacttcaccgtgcggggagagagcggccgtgagagggcagaagaggaaaaaatagtggccggtgacacacccacagagggagagggaccacagaagagggatagtgcaaagaggggggcccggaaagaaattcaacggcccaagtggggacaccccccacagccccgtgggggtga

SEQ ID NO: 591288 - DNA, 1331 bp, Homo sapiens
cagtgtccccatgcaccccggtggatggcactgcggacttcctgtgccagccctgctcacagattgtcttgtgcacgagatgtgccgcctatgacccccgactcgtggaccagccccgtgcctgcctctggtctgaagctgtgctgtgccctggaggccgggcctggacgggactgctggcctggtgtggacaataacctgcgtggagctggagtgcagcgcggaggggtgcgagaaggaggcgctagcccgtgctgcgggagccaggcggcccgggatggggactcaggtggaggaggcggctgaagaggcgtcctccgggccctgcttggccccaagaagcagggagtgtgctggaggcagctacgagcccccacgttggaggctgccgaaaaagctgctcgggaggaggtttggcggagctttgaggggaccgggacgcaaggttggccagggtccgtggaggccggcactttcggccccgccggggtacgttcaagccttggggggcggagatggccggaagattccttctccccgtggcacagggggccagaatacagcaaagagggcgaggaatacaaggccaagtcttggcagtggattgacccccccttggtgacaacacagggaccccgggacaccccctttgactgtgattacacacaggaagttctgggaagcatacacaatcgactggggaatcccgttggaaacaacgaaacgacttggccacaaccatttcctttacggagccttggtcccatttctgaaggagaagccaatgcacaaggccgccccaagcaaaagggcatgcgtcggaggaacacacagaccgggtagacgtgggatacccccaaaagggggacgagtgaagggaaagaatgccaaggaaggccctgagaagggaagggacttacaaggccgaaaaagacttggagaaaaaacacggggcatggtaaatatatcagagcccccacaaagggcccggaaaaaatttggggccccaaaacagcgccaaagaaaggcggtgaaacaagacgcgcagaaagaaccccccgagagaaaaagctgggggagcgccccaaacccgctgtttcgacggcaacgaaacaggtggtgacctagaaacgcccccagacagagagcgagagggaggggggcgcccagcagccccaaccaagagggggaggtgtagcagccagccaaccagacaagaagaaaacgaccacaaggacggagagggcgagactaagaaacccacggggaggacaagaaacaggacaccggagacagcgaaacaaacgaggcagacaggtcgagcacacagg

SEQ ID NO: 591289 - DNA, 120 bp, Homo sapiens
  misc_feature (17)..(17): n is a, c, g, or t
  misc_feature (55)..(55): n is a, c, g, or t
  misc_feature (116)..(116): n is a, c, g, or t
gcggcaggcggccggtntggtgtgtcccgggtgtggggaggcgacagagccctgncacttgagggttgagggggcctcccaagcgcgggcgaaccgtctagcctccggagccaagnccgt

SEQ ID NO: 591290 - DNA, 107 bp, Homo sapiens
tccaggggcgtctcctcactccagcggctactcactccagcggttactcctcactccacgcggctactcactccaggcggctactcctctactggtcgcgtctcgga

SEQ ID NO: 591291 - DNA, 461 bp, Homo sapiens
atcttagaggatccccttcaaatgcgcacagaaagttcacggttacctcgcctattctgaggctggcaaaaggctcatattgagcacgtatagacatcactatgccccaggagttgtgtattaaaagtacagctttggtcagtgcagcttctaacccttatagctcttgaataggtctattctcaaactacaaaaagatctcagctgacttataaggtcatggtcacaggacaccgagacaaccatcgtgcactggtggctgagactgtggactgggtctttctcgcaatttctgtgcccttttctgaaatgggcacagcaaattcgttattaatattgatgcgacaatactcttcgtttctgacatcttttgagctcagaagtttgtttaagtctgtatcattcaaccctttcgtttgactataaagaaataggaagccattgagagtgtgatgctctga

SEQ ID NO: 591292 - DNA, 364 bp, Homo sapiens
ctcttttaaggaagtccctaatttagaaacaccccccaacttcccaatcataattagcaaaccattggaaggaagttgcttgaatgttggggggaggaaaatctattggctctcgtgggtctcttcatctcagaaatgccaatcaggtcaaggttggcaccattttgtatgtgtgtgatgcttctcccaaaggtatattaactatataagagagttgtgccaaaccgaaataataaagttcggacccggggcccccgttcatagttctagctgcttggaaggttgaggagggaggatggcttgaacacaggtgttcaaggccagcctgggcaacataacaagatcctgtctctcaaaaaaaaaa

SEQ ID NO: 591293 - DNA, 238 bp, Homo sapiens
ctcctctgacagctgattcttgaggacagcaaacattctcctggaaagccaggttcaatgagggctcctagaaacctgcggtgtctgagccacatcagcagcctcattggcctccaaggaggggccacaggctttcacccgtgcctccattttgtgtatgcggctttcaaagtcagactctggagatgcaaaggttccaatctggaaagtgaccttttctaaggaaggtttctcccgg

SEQ ID NO: 591294 - DNA, 123 bp, Homo sapiens
cggcgcgctgagctggagtcctaggcacagctctaagcttccttattccgagccgatgctggagcagccaggtcgaccttctaggtatctgatccacatctactgcgttatcgtccgagcgga

SEQ ID NO: 591295 - DNA, 425 bp, Homo sapiens
gagtgtgtttgattatctgaggcagggggatgagtgtatttgattttctgaggcaggggcatgactgtaagtgattttctgaggtagggggctgactctgagtgattttctgatttcatgtctgctctgatgccctagacacatgcagttggaaagccatctcagaattacctgagggcaaagaatcgaccctgctagtcatggaaggggacacaaaatactcagattatgaagtgaataggaaggtggaaataattagtattgattaaatttaatttgtccatactaaaattcatgtaatagatcaaaatgtaaaatacagcatttaatttgttataagtaatatcttgtgcccatcttatattttcaaagcatccacaccagtttaagatatatttgaggttcagatttcaaaatgtcgacgc

SEQ ID NO: 591296 - DNA, 513 bp, Homo sapiens
agtcggtacacctgcctatgtagtactcacactgtgtgtagattttgtttcttttgttaagcagcacttatagtagactgcatttccaaatgtgttgagcactcagagtgtagtccacaggagttcttttaatgaatatcagttttaatttatagactggcatgggctttaaaatattctgtacaatatactgcactgtgttgcacagacactaattgcttttctccattcatatttttatgagtagaatctgggcttttaaatttctcttcttattctttgaagcatgttgcatactaccctggtgggatggctggttctgtcaacatgaaggggatatttcaaacttgctactagttgttcaacacccattaatggtcagtgtgaacccttaccaagaatgtgggaacttgcttgtgcctaaaaggaggaattggcactagaatgtgtgactctttggggactgcataggttcgttaattgacctatagctaaaccttaatgtgtatgtgt

SEQ ID NO: 591297 - DNA, 234 bp, Homo sapiens
agacagattgattttaacaacatgttccgtaagtcctaacttaatggcactggaaaatctttctgttaagaaaaggaaaactatttggaccttcaacaggctctttataagcaaaggcattttcgtgccccagcagaacagtcttgttataagggagatttataacgggacttccagagaagcaatgagttcagttaaatttctaaacactagaagcaaacgcaacggtgaact

SEQ ID NO: 591298 - DNA, 337 bp, Homo sapiens
  misc_feature (14)..(14): n is a, c, g, or t
agcgcccgatcaanggggggcttgcgccgggaacaattgatgccccaggcttttaaggacctgccaaagggggtggaccctgcccgcagggagttttttttctcagactttgacttccaaaatatttttgggaaatccaaggaggaattttccagcatggccccgtggaggcagcggcaggaaaaaaaacagttgggttttttttgaacccaagcccttttgactgcccctatcccctggaccccaacatacctacaatgttgggggggccctgcttcccctcccctcaaaggcttttggtcatcctttgggtgtcagtaaaagcaggcagcccata

SEQ ID NO: 591299 - DNA, 416 bp, Homo sapiens
ggattgtcatagcagcgttatagataatagcccaggagtagaaacaatccagacatacatcaattgacgaatggataacaaaatgtggcatatcatacaatgaaatattattcagctctaaaaaggaataagtactgatacatgctataacctggatgaatcttgaaatcacattatgctaagtgaaagaagcattataaaagaccatatattctatgattctattcatattaaatgtcccaaataggcaaatttatagggacaaaaaataaattagaggttgccagggccaggggagaagaggagggagtttggattctgactgattatgggtatggtgtttctttatggggtgatacaactgttctcaaagttgttgtgctagtttcacactctttgaatatacaaaaaaaaaa

SEQ ID NO: 591300 - DNA, 497 bp, Homo sapiens
gagcggtgccccccacccaccctgcacccctcgccctccccccaccacagaatctaagacctttcagcttcgagccagggggcgggggatcccgagcaaaagccttccgtggacatcaggccccgtggcctcaagggctcccagggcaaacctaattccccccaaaacgtgaagtcggggaagctgcggctacacattccacaaagtgctggcacttacacccacaacccggaaggctgtggaccgattcctctagggtggtgacctcccattagcaaacggtgtcatggtttggaatgttcattatcgccaagaacctggttagaggcataaagaccttttttcaccgttacctaattttttcccctttcaagaattttttttttttttggtgtgttgtacagcagtataatttttcacttatttattccatcagtagatatggtttgtacaatgtacaattgtttcatttcagaaaataaaaatttcaaatcatg

SEQ ID NO: 591301 - DNA, 552 bp, Homo sapiens
gagcggtgccccccacccaccctgcacccctcgccctccccccaccacagaatctaagacctttcagcttcgagccagggggcgggggatcccgagcaaaagccttccgtggacatcaggccccgtggcctcaagggctcccagggcaaacctaattccccccaaaacgtgaagtcggggaagctgcggctacacattccacaaagtgctggcacttacacccacaacccggaaggctgtggaccgattcctctagggtggtgacctcccattagcaaacggtgtcatggtttggaatgttcattatcgccaagaacctggttagaggcataaagaccttttttcaccgttacctaattttttcccctttcaagaattttttttttttttggtgtgttgtacagcagtataatttttcacttatttattccatcagtagatatggtttgtacaatgtacaattgtttcatttcagaaaataaaaatttcaaatcatgtccccgtacatcgttagaagcttgaattcgagcagtagtagtagtaggcggccgc

SEQ ID NO: 591302 - DNA, 1029 bp, Homo sapiens
  misc_feature (691)..(691): n is a, c, g, or t
ggttgttctggggtcctctggggtcctctccgagcttgatggacactctggggtcctctccgagcttgatctgagaggacccagagtgtccatcactgttgttctgacgtcggtgcaggagcagacagagaagactctgactccgagtgagctgaccaagctgaggcgctgctgtgcaatggctattgggcctttgagtgcctcacgtgtaccgagactacaattgacatgatctgtggcatctgtgcgtgtggcaccccaaagtggaaatggctcagagcgagtgacgagaatgtcgctagcactgaagagcagtggaggtcgacctgggccctgagcttcctgggagtcaagatgagcgtaaaagtgcgagggaaaccagagtgcacacagatagcgagacaagaagttcacaacagaagcaacggctgcggcacaacataacatagcgcaagaacatcccggaatcaaacacagaagacagaagtagccggaaagaacagcagagaccccacaagaactaagacacaacgaagcaaatgaagccggacgcacgcagggcagagaggccactagagacgcaacaacaccacaccgcacgggcctaaggcgcacaagacacgaggaacccaggcaacaacatgagaaaacgccaaagagacgaaacaaaaagcacaacaccgaacgggcnacgcaagacaacacagagattgacaagaaggcagacccagccggagaaagcacgcaccaggcaaccaacagagcagctgcggcaggggaggcgcaaccacacataacaccgcacgcacaagaagaacgaagcaacgggaagcaaagcacaaagtcagaccaagcccgatgacagcgcagccactaacagacgcacactgagacaacagatgagcagaacaacaaaacacaagagcacaccgagtcgacgagcccaaacggcgcaacaaccgagagaaccagagggagcactacagacagcacaggagagaacacaaaccaggggacagcagcaccccg

SEQ ID NO: 591303 - DNA, 399 bp, Homo sapiens
gttaaatcctttccccaaattaatccattatattcctaaattaagttaagtggttccagaatattccttggcctccttatcagctcctaaggattcaggtaaatctataaaaaaatcatttctgggcccaggcacggtggctcacacctgtaatcccagcactttgggaggccgaggtgggcggatcacaaggtcaggagttcgagaccagtctggccaatatggtgaaaccccatctctactagaaatacaaaaattagctgggcgtggtggtgtgtggctgtaatcacagctacttgggaggctgaggcagaagaatcgcttgaacccaggaggcggggttgcagtgagccgagatcatgccattgctctagcctgggtgacagagtgagattccat

SEQ ID NO: 591304 - DNA, 107 bp, Homo sapiens
tggcagtatcagcaagaaacagaagaggcagttaagggcccacaaatttatactgggaagaaattgccaaagagtaccagaatgaagaagattccttgggcgggtct

SEQ ID NO: 591305 - DNA, 353 bp, Homo sapiens
  misc_feature (245)..(245): n is a, c, g, or t
aagtcctcctgcttttgggggctgcttcccagagtcccccgggtgctcacctgccgaggtcaggagctgacaagccttgtgccggtgacacctgcatgcctcactcctgtcatcccaggacacttgaggcccaagaggtggagtggtgactgtgtttggtcactatggagcctcccagtgtgcgtcaggatctgtgggcaggggacagggcgttggttggggccgaggctggcacgcccctctgncctcaccgtcttggtgacctggcctcgggccctcccccaagtctcttctgtgcaagggccgcctcggcctcggcagctggttcctgtcctgttttctgtgtctgacag

SEQ ID NO: 591306 - DNA, 274 bp, Homo sapiens
tacacgttctagtaacacctagaagtctagtatagggtctcatacacactaaaatcatgtagtcagctcgttttcacggaggttccaggacagacccatttcattttatgcttggataggttaggcaagggaattcataattctatgtaggtaagactagagatccacgatttcattgctaggtattacagctagagaggtatgtttccaaggttctaagaagactctacacataccctattaggttcctaggtacctacttactatacatact

SEQ ID NO: 591307 - DNA, 190 bp, Homo sapiens
  misc_feature (6)..(6): n is a, c, g, or t
  misc_feature (50)..(50): n is a, c, g, or t
  misc_feature (99)..(99): n is a, c, g, or t
  misc_feature (150)..(150): n is a, c, g, or t
  misc_feature (183)..(183): n is a, c, g, or t
  misc_feature (185)..(185): n is a, c, g, or t
gcagtnccctgctctgttggtggttggggacagctcgcctgcagtggatnccgtggtggagtgcactaaaaattggacccaacaaagaccactctcctnaagatggcggactgtggcggcctcccgcagatctcccagccggccaagctngctgaggccttcaagtacttcgtgcagggcatngnataca

SEQ ID NO: 591308 - DNA, 593 bp, Homo sapiens
  misc_feature (541)..(541): n is a, c, g, or t
tcccccgggctgcaggttttttgtttgtttgtttttaatacagaccaggttttaccatgctggccacgttggtctcgaactcctgacctcaagtaatctgcctgcttcggcctcccaaagtgctgggattacaggtgtgagccaccgtgcccagccttccagtttgcatatcttgctgataggtttaattagctgaatgagcccaatttgataatgcagctgggcaatattgctttcctgctgcagagagggtcatagatgtgacatctatcctcggtatccaaggcagctggatacgttctggtttggaattttgactgatctggtaagaggtgggggctgaggaatctctccagattttaggtttagtgttttgtttcgtttcttttcgagactgagtctcgctctgtcgcccggctggagtgcagtggcgcaatctcagctcactgcaacctccgcctcccgggttcaagcgattctcctgcctcagcctcccaagtagctgggattacaggcagctgccaccacacctggctaattnttgtattttagtagagacgggtttcaccatgatggtcaggctggtctcgctc

SEQ ID NO: 591309 - DNA, 102 bp, Homo sapiens
tgccaacgtcactgagggccctgccccagcggccctggccccagtctctattaacctaaaatgtagctccctagcggtgcctaggaaccgccgctgcctgct

SEQ ID NO: 591310 - DNA, 777 bp, Homo sapiens
  misc_feature (526)..(526): n is a, c, g, or t
  misc_feature (588)..(588): n is a, c, g, or t
  misc_feature (607)..(607): n is a, c, g, or t
  misc_feature (623)..(624): n is a, c, g, or t
  misc_feature (626)..(627): n is a, c, g, or t
  misc_feature (632)..(632): n is a, c, g, or t
  misc_feature (634)..(634): n is a, c, g, or t
  misc_feature (636)..(636): n is a, c, g, or t
  misc_feature (644)..(644): n is a, c, g, or t
  misc_feature (651)..(651): n is a, c, g, or t
  misc_feature (670)..(670): n is a, c, g, or t
gtagcttactcggaagacctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataattncaaggtcttccatcaaatacagatcttccagctaatccatgtcttccagaaaaatctgtgtnttccaccaaatccaagtcnttccagtaaagctagnncnnccagnanantctagatnttccagncaatcagtgtcttccaganagaaatccaggtcttccagcatctctgtgtcttccagcatcttcatgtcttccaacaactacccagtcttccatcacactggctcaatatccatgtcgtccaaccca

SEQ ID NO: 591311 - DNA, 392 bp, Homo sapiens
gcgtcgacctgcaacctgcaactggtagatgccgtaagaaaatgcataaaaaattagtgctagattttgaaatcgttattaaaaggatcataaaaatcaaagcatccctgtctcagttctgtccatttgatttataaggaggctaaaaatggaaatgtaggtttcaacgggaccaggtgtggtagctcatacctgtaatcttagcactttgggaggccaaggccggggaatcacttgggcccaagagtttgaggctaacctgggcaacatagtgagaccccgtctccaaaaaaagaaaaattaaaaaattagctggccatggtagtgtgcacctgtggttccagctactcggaggctgaggtgggaggatcactggagcccagtaggttgag

SEQ ID NO: 591312 - DNA, 677 bp, Homo sapiens
  misc_feature (526)..(526): n is a, c, g, or t
gtagcttactcggaagacctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataattncaaggtcttccatcaaatacagatcttccagctaatccatgtcttccagcgacttcaagtcttccaataatctcaaggtcttccagataatcctgagcttccagaaaatccacatcttccagaaaatccttgtcttccctcaaatccatag

SEQ ID NO: 591313 - DNA, 439 bp, Homo sapiens
agtgactgtttcttctcttactaacagcagctcctgactgcgatgctcatgtacatttatcttcaaaagtacacgcaagtgcacaaaatcatttaaaacaatttctgactttccatcttctctgtgttattcatcttaataacatcattttgtactttttttgtttgaaacaatttgagaatttatagaaaaagttgcaacaaatactagatgaactttatgtcgtttcatccagatttcctcaacattgttaaatactttgtaatctcaatcgttccttttacatagtatttgtttgccatccaatatgctgtttttcttctacttctggaggcatttaaggagtaacttggcagacatgaatgtccctttatgcctaagagactatgctactagcattttctaaggaacaaagacattctcttatctattcacacaa

SEQ ID NO: 591314 - DNA, 262 bp, Homo sapiens
  misc_feature (113)..(113): n is a, c, g, or t
  misc_feature (252)..(252): n is a, c, g, or t
ccactgcccagggtctctccagccatccacatcacagctgccccgatcccaaggtggagattgtcaggtacatatcggccaaagaagactgggcgtggggagagcctggcctnccaacgaccagatgggcagcacagggtgtaaccggacccagcttgtatggccaactgccatcagcccctacctgcctggcatccagatcgtcaccccagggcctctgggcatttgaaaaaaagaagccagatcccctgnagcttgggta

SEQ ID NO: 591315 - DNA, 272 bp, Homo sapiens
atttgatcaatcaacctaaagggttcccttaagtccaaggaaagactatcacgatgtctacaactgaagaagagaaggggaaagggcattctaatcattgccttgtttacattgatgctgttgctgcattcttgccattgaaactactcttgcagtctggtaactgattaacctttgccaccaggatgccctttctgttttagatccctcaaacttcaatgttgatccattaacaaggctttccacaattactactattgttttttattctc

SEQ ID NO: 591316 - DNA, 557 bp, Homo sapiens
  misc_feature (210)..(210): n is a, c, g, or t
  misc_feature (372)..(372): n is a, c, g, or t
  misc_feature (412)..(412): n is a, c, g, or t
gtagtctggtgcatcattatgttgacaatacaagaaaaacatcaaaacatatctatgtaccaactagaattgtcctggaatgatatcgagtcgagtatactgtagtagtgtatagttgtcttgaatctgtactagttagtgtatacaggctgcatcgtacaatcgctatgatgacgagtattgcgcaagtattcagcatgttatcgcatntgactttgacttggctagggcgcgtttaataaggataagggcgcgtaggaatatatcacgagatatggtggtatatgatttcttgtcgatcgcggtgtattctagttatctcttacgtgtaccgtgcgcattttatacgccgctttttcattagaggtcganccaatagtggatgtggataaatttctgagatagggctganttagagagggcgtggtttcagagaaataacgtggtaaggctgagtttaaatgattggtgcgatatgggggcgcggaaatttgagtaggttaattttaaatgggaggtacttagtaaggggtcgatatttagttatcttgtggcgt

SEQ ID NO: 591317 - DNA, 148 bp, Homo sapiens
cacagttgaagatcccatttggcccaggtgttcaacccggggtgggcccttttggaggagtttggcggagcaaggtcaaaaatgtcgggcacaccaagtgctcagtggcgggacgtgagaatatcacaccccggggggaaaatgtcgc

SEQ ID NO: 591318 - DNA, 187 bp, Homo sapiens
tttgaaaagaagaacaagtcaattgtgtgtgtggaccctcaagctgaatggatacacagaatgatggaagtcttgagacagtcagtcagcgcataacaaggggtttcagattccaacctgctctgaagagttcccctttctgagcagtcaccataggactagctgaattatgagagctcctagacaa

SEQ ID NO: 591319 - DNA, 108 bp, Homo sapiens
tccgggaaccggttttaccgggcgtcgggtttccacgggcaaacgtttaaaaccggggaacgggttaacccggggacacggtttccccggcgacccgttttacccggg

SEQ ID NO: 591320 - DNA, 100 bp, Homo sapiens
gttacttctgcacccacagcataatttaaacattcaacgtacctgggccggtgcactcaactttatctttactagacgaagagcttggcatattcctact

SEQ ID NO: 591321 - DNA, 105 bp, Homo sapiens
agaacatttactgaagtcaaagtggtgccgccctacatctactcaatgctggttcgaataattacatcagcagctctatcgcatcactggtagcatatcctcgtt

SEQ ID NO: 591322 - DNA, 804 bp, Homo sapiens
gaggacattccctgttgagggcgtcgcgacgtgaggcgactgtgtggagacggaatttcccaacgcgctacaatactctgttctggagaagtggatctttctcttacgtgcatctatacgaggcatgggcaagtgcagcagtatgccggcattgttatgcatgagcacaatacaacatcgcttgaatgaaggaagatgggagtaaagaacaatgctaccatatggatgcattctgtgcatggaagttggcatcagtgtaattaggccaggcagtgagctatacaattctagtatcattgagatgagatctgaggatgtatactcatgctggacgtctgttatagcggacacagcacgtggatacgtatgcaagtattcctcgcctgagtgagccccatgacaaactgacgtctcattatctatgaagggtcctgtctacagatgctgctatgaactactattagcgtgtggtttacagatacatgcaagcctctgatggttgtgtctatattccaattcactagcttgccttgctcttttaataattgcatatgcctcatacaccttacacctttatgccacaacaatgtacgggcctataaatatatgttaacattggaccattgattctttctttattaattctagctttggcgggcttggctccaatgcttgtttgtactctgcgccaggttttttccacagtgtggcccttaggcggggcctcatctgcgttacatgttggcccatcaaggggaaccgctctttacaccaacaatggccaccgttgttaggcccccaatc

SEQ ID NO: 591323 - DNA, 314 bp, Homo sapiens
tcgcttagagtgcatgctgagataagcaatcatatttgttattgcggcgggcatgtggctccagcctataatcccagcactttggtcaggagttcaaggccagcctggccaatatagtgaaactccatctctactaaaatacaagaaattacctgggcatggtggcagttgctggtgatcctcagcctcctgagtagctgggattacaggcatgcaccaccacgcccggctaattttgtatttttcgtagagatggggtttctccacattggttcaggctgttctcgaactcccaacctcaggtgatccacccg

SEQ ID NO: 591324 - DNA, 804 bp, Homo sapiens
tctgcgcgctcaccgacttcatagggtgccgaattcttttatccccaggcttgccatggctagtcgaggggctcggcagcgcctgaagggcagcgtgggccagcagtggggatacgagccccggctgctggacaagtctgcgggagctgctgggcagcctgagaggcgggcggcgcggagcaccggaccgacgttatctggggaacaacagcagagacaagtcgtgtggcaccgtgaaggatctattgctttcgaagtgtctgctttcagacaaggttatgtgctgctctcctggagcaacgatctctggactgttgatgaaacattcaacgtactgggagccgaacacactacctcatctatggggaagggttacagacttgggaatattccccagtcatatggccatatcgtctacctatgcttacctgtagcttcatgcgctggccatgctgcgttttcattgcataggaattctacatagactaataagattcttgtgttagactttgtgcgatgtcttctggcgtttcgtgagcttgtatttgtgaacctttacttgaacaaggctgtgtgcgagaagtttgggttgcacgtgagctcgagatgatgctatgccttcttggttctcagaactggcatgtctagcgtcatcatcagcgtgccttcctagtagcttctgtatgtacactacgttgatagccatgactggatggtctatggacaagacttccattgctgtgctgggagtagcagctggggctatctaaggctgggcattcagtgcagctcttggttaaccca

SEQ ID NO: 591325 - DNA, 217 bp, Homo sapiens
agtattagcaggatctaagaggcacaagggagggccattgcgaggtatcgggagtaggaagccaggtaccgctccacgaagggttgcccgaagccccctgcacgggtcgagcgggctgtggctgggtgctggtgggcagacacgcatcagagcactgtccgtgcccgtggtagcgcaggtgcacggaagctctcagtgctgagctctgggaccgtgc

SEQ ID NO: 591326 - DNA, 424 bp, Homo sapiens
agactgagccctggctctcttacactttcgcaggaattgattccgagatacctagttaaagagtgctgagggtccagatgtgagaggactcccacttgctccctggttggtagccattttggcaggttgtgaaaactgaggggcaggctttagctagggtcttgagggatcgagtcttaactctgtgccagcagggtcctttgtttctccatctgaggagatgcgagcagactttgcctcaggtttctgcctccaggaaggtcccttgtttcttctgtcgggcttttgatcacagtaaggaaagttaatataaataaacagtgatcatccttcaaaggggatgtcatggtcgtgccatagaatcaacttgataattaacatacagtatttgcattaaaaccaaatgacattcattttgacaaaa

SEQ ID NO: 591327 - DNA, 757 bp, Homo sapiens
agcggagcacctggagggcatgaggaggcggcagcggggtgtcctgtcctctccatgaagccgcagcaggcgccggtgtccggaaaggtgttcattctagcgagactagctagtcatgtgtgcacacgctgccagttccacgaccagatgttccctggcggagctgcgagaaccggattgatatggcagcagtttgaatgaaacagttcgaactctaagttaacctttatgcagaagcagagaagctcggcggccagtcatatctcgaaggcttgtataggggtctgtcgtaactagcatagtaccattcttccgtatgcatggaaaacgtcattagtgagaacggttctgaagaaaggtctccaatgtacattcaagagcagaatgagaagatctatgctccactaaggcctcctcctgtacagaccgctattgagcgacggactgcgagttacttgatcacttaccatttatgaagacagaggcatgagcagtggaacgataaaccgaagaattgaagatcccacttccagccgggcgccgtcatgtatcgagtggccgaccgtagagtgtccctaccttcactctccagagcatcattcctttctatcatgctggcagagccacggtgcctatttacttccaaggactcactttctaaaattccacaactggagtgacctctagtcgctcagatccactttgtgtctccaaattgtgtaaggactctgtaatctttagattagtttgctgagaa

SEQ ID NO: 591328 - DNA, 288 bp, Homo sapiens
cacgaggttttttaaattttttgtagagatgaggtctcactgtgttgcccacggtgatctcgaactcctatcctcaagcgatcctcctgcttcggtctcccaaagtgttgggattacaggcatgagccaccactcctggccaggagtttatatgtatactgtggatactagatcctcatgtgatttgcaaaaactttatttatttatttatttatttttgaaatggaatcttgctctgtcgccaggctggagtgcaatggcgtgatctcgggtcactgcaactaccac

SEQ ID NO: 591329 - DNA, 357 bp, Homo sapiens
cgccaatgtgtgtagcgccggggcccgaagtcgttgcctgtgaataccacctgtgcatgctcatggaatgggaagatgccaagtgccttccagtaagatttggtgtctatttccacttggtatatcccttccccagaggcaaatggctcccaggtgtcatcagcagcctttctgaacacatgcacggccacattaatgccaggactgcctcggacagcatctagacctttgaccatcagagcacactgtggattcaccggtgcctgtagggacagcctcagacacaaatcacagtacagcgagacagaggaggagcagactatgagaagccatcctgacgagctcgtgccgattcct

SEQ ID NO: 591330 - DNA, 355 bp, Homo sapiens
  misc_feature (168)..(168): n is a, c, g, or t
ggcaccgcctcttcagaatcccacgtgttcttttccaggctccaacttaagagcctggtttccagtgacttggccctgagaacaaacagtgctgagatgaagcctgtggctccatgagcaagctgaacgtggccagaaggcaatcacaacattcttttctgtcttggnttttttttttttcctttttttttttttaaaatttaagcttggaggacaaaaacattgctgggggagggggagacccccaggttgaccccccggggcccagttttgccgataaagctccgggcggccaggtaacctcacacatagagaagggggaaaaagaccagaaaggcgggaaccaaaaccaaaa

SEQ ID NO: 591331 - DNA, 184 bp, Homo sapiens
agtgaccaggcgcagatgagatctgtctcaaacgcaacaggaaaaaccgctctcctttaaatggatgtagtggtacacacctgtagtcccagttactcaggctgagaggaggattcagtgcgcctgggaggtccaggctgaagtgagtcatgatggcaccactgcactccagcctgggtgaccg

SEQ ID NO: 591332 - DNA, 308 bp, Homo sapiens
gtgtgaactcccttgaatcctaggattacattgcaaataatgaaatcttacatcagtccagtatgtgttagataactatgtaatttgcagcccctatttagaagaatttttggcaacaagataatggttaatattaaatcaaaatcaaaacaaaaaaaagtttaacctacccattcaatcacaataaatatacccacaaaattgaagtacattctcaagtaatgtaagtatttttaatggactaatctatattcaacatctaccagcccctaagaaaaacttggatatatgtgtaatataaataacac

SEQ ID NO: 591333 - DNA, 368 bp, Homo sapiens
  misc_feature (185)..(185): n is a, c, g, or t
  misc_feature (203)..(203): n is a, c, g, or t
  misc_feature (227)..(227): n is a, c, g, or t
  misc_feature (256)..(256): n is a, c, g, or t
  misc_feature (276)..(276): n is a, c, g, or t
  misc_feature (342)..(342): n is a, c, g, or t
tggtacagcgtacctggagggatgcaagacttcaattaccttagcagcaactgttttgagatcaccgtggagcttagctgtgagaagttcccacctgagagactctgaagacctactgggaggataacactccctcattagctaccttgagcagatacaccgaggagttaaaggatttgcccganacctttaaggtaacccanttgcgaatgccaccatcttcgtgnaaggaatagaccacgatgttaccattccnaaaggatggtgattactggnagaatgcttatcctggaaactattaacttacaggcttagcttcaggctatcttggcaataccggtngcaggttcttacgcctgctgctgggg

SEQ ID NO: 591334 - DNA, 277 bp, Homo sapiens
cagaagaagtggatgggataccgagattaggatgatgtgattgaagaatgttataacacatggaggagttattcatatttatgttgactacacaattcacgctcagggcaatgtgtatgtgtaagtgcccatcaattgctgcagctattgctgctgtcaatgcattgcatggtcaagtggtttgctggtacaatgataacagcagcatatgttacctcttccaacttaccacaacctggtttcctgattctatgacagctggccgtttcacttccga

SEQ ID NO: 591335 - DNA, 953 bp, Homo sapiens
agtaatagatgtataagcacgagcatattgcattctccggtagcatactcatcgctatccccatcggtgtctcggtattgatgctgagtcgccagactccacggaagcgaggatggaatgactgtgctgcagttgttcctgaggacataggatacattgctttgttttcactctgtagggtggtcctgatctggaatagtagttaatcaaaagttctagtctagctagaatattatgtgatctaaacagatgttgtattcgtaccggttgggtgaagcttgaaattcacaattaatgttgcgtaattgaaatatggagggtggtatttggccaactaatggtgaggggcattccatgacagcttgagttgcgccctttatttctctaggtgtgaacaccctctttatgaacaataaagctatgccaatacacatgggttgtcacaggtaaatcgactaatgcgatctgccgataggaacttctagaggtgatcgtttcccagaaaatgacgttgccctcgggcaataataccgggaagtgccgccgaccgggtataactcgggcacatacccccgtattgcaaatattgcccacatgtgaaacattcgtagtcattcgggtggggcttcgattcactgtatcgttcgtgacacatgcagtagttacttcagggtaactttgacaatagccttgtgggggacaaggtctttacgttaacgaaatgcgaaaaagggtcctatatagggtagatgtgaaacccttcgataaacctgtgtgagtgactggttgtggattggccctccatcacgtagccatgaccatttcaacgaacccgttttacgttgcatccttcgaccagcgaagggatgggatcgaaggcccaccaaaagctggttccccagacaccctcggggctcctaggagatttccaacaacctgatgaacaaaggcct

SEQ ID NO: 591336 - DNA, 1119 bp, Homo sapiens
gccatctcctactcctcagtagtacccattctgaatcgccaatggacatacctaatgctataccgaacgaaaaattctaggctatatacaagctacgcagataggccccaacggttgtaggcccctacgggactactacaacccgttcgctgacgccataaaactcttcaccaaagagcccctaaagacccgccacatctaccatcaccctctacatcaccgccccgagccttagctctcaccatcgactcttctactatgaacccccctccccatacccaaccccctggatcaacctcaacctaggacctcctatttattctagccacctctagcctagacacagtatactcaatcctctgatcagaggtgagcatcaaactacaaactacgcacctagatcggcgcactagcagagcagtcagcaccaaaacaatactcatatgaagtcaccctagccatcattactactatcaaacattactacactacacgtggctcctttaagcctctccacccttatcacaacacacagaaccaacctctgattactcctgccatcatgacccttggccataatatgatttatcatacacactagcagagaccaacagaaccccttcgaccttgccgaaggggagtccgaactagatctccaggcttcaagcatcgaatacgccgcagggcccattcggcctattcatccatagccgaattacaccaaaatctatcatcctacaacacccttccacatcacaatcttacctaagaaacacctatgacgaactataccctgaacctctacacacaaattatgtcaccagaccctactcctacctcctgttcttatgacactacacagataaccccacatccagtacaacaatcacacaactacactggcaaactcttccacaaaacctcacaaatacatgcaagtcaccgaaccttaaatacggattcccctaatcacaacaaaaacacagcttcaaggcgggcacatcaacacacactcagtgcgcaccctcgcactgagaggcaagagggctacgcgaccatacgcaaacaaaccaagaagagcatcacagagcattagacaaaagaatcgagaacgaacac

SEQ ID NO: 591337 - DNA, 1040 bp, Homo sapiens
gctgatggacagctgggtccgagaggactgtgcaggtctcaattacgcagtcttggtcagatggggcaggccccttcgtcagagcggcgctgatggagtcacaagtcccctggggtactggaccagtggacagactttcttcgatgccatattaacccacagctcaaaatgccaagtctccgtggttcctctcggccgagggatcggagaggctgtctgccagtggtgcgtcagatctgtggccgcatggctgcggggccctgcacccacatgccctgcctgcccttgtgcgtgtgaagcggcgtgtgccctcaagaatgctggcccgctgctcgtgggagttgccatgtgctgtggcgctgcattggagggcgcggcactacgtgggtggcacggcatggagctggtcgcaccagtggtgattagcttaacgccaaggaagagcacagccaggtttccggcttggtggaggaaatatgggctcctggttgggcggggtccgtctctgcctaccgtctaggatctggtggagggttggtgatgggtgaaggatgcctgcgatgttcgtgggcgtccgtgccctctctcctcggtagtggggtacacggacctcagtggtgttgtccttctggcgtgtgtaacgtggtatcgaatcgggttctatggaggctacgtgtgtgtcgcgggagtctatgctgctgtgctgattgactgatggaggtggacggggtcgacccctgtgcggaccgtcggataagagagccagtcctgagtggtggatgtggaaggccagtggagtgaattacctggagcaacgtccggcatgtttgtcgtgcggaatagacgtgaactccaggggaatgtgacaagggagcccaggcataaattttcgcaagcgcgtggcaacacgtgtccgggcaaacacacatagtctaacggaaagaccacagacgcgtagaggccacgcccggtacacactttcgggtggacggaactcgcacaaacacccagctacacactggggggggccccacacagag

SEQ ID NO: 591338 - DNA, 352 bp, Homo sapiens
tagagttcgcagctgctgccatggcggaggccctgtcgaatacctccagcgggtttaagtgggaagacttccagcgcatcgcaaacaagcccggtgttcattacgcattggccggattctccgcggactcaaccggcgacaacggtgtaggggttgtacaggcagtcattaggcgctgaacaatccccagtccaccaccagcccctgcaacgagtgtcacggcgctggcttctgcatgtcgatcgtgcaggaagaaatgcgctgtccatgcaatgcacctattcagctcagcaagggaacgccatgaataacctctgtagcggatacctgtcgcgagaaaccctaaccgggt

SEQ ID NO: 591339 - DNA, 108 bp, Homo sapiens
tcttttgcaagttgatcaacaagctcaattcaccaccatggcaatacgggagctcaaagtgtgccttctcagaggaacggggactaataacgatggtgtagagtaccg

SEQ ID NO: 591340 - DNA, 421 bp, Homo sapiens
ccgtaacctttcagggaactgacctggacaagttgtggaaattgggccttaaatttaaaaattaccgtttttccttaaccggagggaaattagggaattggaattccggcggggaaggggggtccttgaaaggggcccaagggaaccctgaattcatacccacgtcaaatttgcacatttcctggggtggttccactttggtggatttgccttagtttggtttttcatttaccttaagggggcccggtggggtatgtttttgtgctgtggtttggtatttatacaggtacaaatttaaggccttaagttaacaatttgcattggttacaatttgggtatttcctttcctcctgtagccctactttggttttgctttaaaaaggtttttggatccttttaaaaattttttttccttaaatta

SEQ ID NO: 591341 - DNA, 407 bp, Homo sapiens
gtggtgttgggtcaagtgagtatccacacgaaaaaaatttttacctgaagtcttttatcattgcatttgccaacaaacaaacaaacaaatccaagtggattatagctctaaatgtgaataaaacgttaagacaattacatacaagaatgtcttcatacattagggtaagcaaagatttcataaatggggcacagaaatttctactcataaagaaaatgactaagaactacattaaaattaagaacttatgtacatcaaaaggtatcaccaagaaagtacaaaagcaagtcacagagtgagagaagatacttgaagcatatagcattgacaatggcttgtatacagaacatataaaaaagttctacaaatcaagtttttaaaaagagaactcaatttaaaaaaaaaaa

SEQ ID NO: 591342 - DNA, 297 bp, Homo sapiens
cgatcgcggcgatctcggcctccttgagggcgatgcggaagtcgccgtaggccgcgaagatcgcgcgttcccgctcaacctgcgtcgccgcatccttcatcaccgccttgtaggtcgcggagatccggtcgaaccggtcggagatgtcgccgcgggtgaccttcatgatcatcagcgcgatgcgctcggaaagatcgatccagcagtcggcgagatgctcggtgagcatcttgagatcgtcgatgacggaatcgaagtcgcccgcgatcccgccgaaccgctcgccgacagtctctc

SEQ ID NO: 591343 - DNA, 179 bp, Homo sapiens
ctcctgaactcaatgagttcatgtataccaaacgctgagcaagcgagatatagtcaaagttgtcataagcatctattgatgttcgccagagccatgataatcttcttcatgtaatacacaagcattgttcaatgcattcattcaccagcatttgttagttcatggtatctgaactcgaa

SEQ ID NO: 591344 - DNA, 556 bp, Homo sapiens
agcaggccgcactaaaaaaaagagggggaatgtgacacgaggagaggtaaaaagagttaagaaaagtgggaaaaaaagaaaggttcctggtgtggaaaacaataaaaaaatctgggtggttgggggaaaagcatgaagtgtgtcggtgggaaaacattaaaaaggactagagagaaaatcatttcaaggattcaggggtggtggtgggagaggtaaaaaatggataggacagaaaggtggggagaggagggagccgcaatgtgcaatcaggagagaatacagaaatttaacggaaacctagagaaagaaatttggaagtttcaccatggaaattcggaatatataccggaatctcaaaggaataacatatggggtagaaatgtgaggtaagaacatacaaaaaggaagagtttaatgttataggaataaatagagaaggagagaaatagctctaaagaaatcactcagtctctctctctctctctctctctctctctctctctctctctctctctctctctctctctctctctctctctctctcactctctctccg

SEQ ID NO: 591345 - DNA, 229 bp, Homo sapiens
actcgagctctgtaccggtaagattcgtgtcatctagatgggtttacgacctccatgttggagtcacgacatgccgattgtgttgcgagcctctcattaactggttcgttgtgttcaatgagttcctgttgtacgtgatctgagttcagaccggagtagtccagggtcggtgtctatctagttcaaattcctccctgttctgaaaggactctacggaaacgaatgttca

SEQ ID NO: 591346 - DNA, 270 bp, Homo sapiens
  misc_feature (15)..(15): n is a, c, g, or t
tgggggggccctttnaaaaggggtttaacccatttttgtaggtaaaaaaccccctctaaacccccaaaggggttcgggggggcccaaccgggaaggggggacgggcccccttgggctttaaaaaggcaggtgttttttttttaccggctttttctttttaacccttcccggggggggggggggcgggggttttttttttttttttttttttttcccccccccggggaaggggttggggtttttttcggggaaaaaaaaaaggtttcccca

SEQ ID NO: 591347 - DNA, 218 bp, Homo sapiens
aaatgggaagacaccagtcattcacaaaagtcgggagcaccacacaaacctgactaaggcccaggaaccatataggagcctgaaacaggtcccctgcacattcatcattaaactatacaggatcaagctgtacatgagttcattacaaaagagtcaactttacaaaattctgtacacacatttgaaaaactcacaacattcccatcaatatatcacaa

SEQ ID NO: 591348 - DNA, 166 bp, Homo sapiens
  misc_feature (34)..(34): n is a, c, g, or t
ggtgtggcctcggggggcagcggcacccatcccnctccacatcccacagccccaggcatccatttggtccacccatcctcaccaacaggcacctcaacccaccagggggttttttttttttttttttttttttttttttttttttttttttttttttttttttttt

SEQ ID NO: 591349 - DNA, 780 bp, Homo sapiens
tgagctgtggcctcctggctgggagctggcggctgtgtgaccccagcgggggcggagtgggaagaggggatgcagtgtgcgtgggagcaacggagcctgggaggagggctgtgtgggcgtggcctgtctctttaagtgtgccctgagtgttcgctgtgcgctgcgctgagtgggacggccgtggagtgctgcggcctgtgcctcgcactcaaagcctgcgcagcgcgcccctgggctctggcctgaccctggcggggatctagtgggtgggcgacttcgcggtgaccgtggctgcatgtatcctgggagttacttgatcatcttctatgaacgaaacatgaagttacgactatgtaagcttgtagcttactctagaccatcctgatgttcctgacatggcttccagaatcactgagctgtaacaaaagcactcagtgctagtgatgtgagcaaatgcctcattcagtgagctctgcccagtgccggacgggagacggcaattgctacctggtgtacatgcagttgcatgctggtcgtctatggggcccttatgggaacagtgtgctagtgactgtgtaggtactgtgtacatactacgaacatatacgtgacacacgctccaacattcagagagcgccagtggaggatgctgaattgaaccagaatcccttctctcttaccggggcactcacagcaaggcagattcctcagtatgcagtttggaaaccatcgtacctagtccccttgttgcacatcgaaaattattcacatcactgacga

SEQ ID NO: 591350 - DNA, 105 bp, Homo sapiens
gcccaaacccacttccacctttacttaccagacaacccttgagccacaccatttacccaaattaaaggattaggccgattaggaaatttgaaaccttgcgcgcaa

SEQ ID NO: 591351 - DNA, 232 bp, Homo sapiens
ggaccgacacatacttccggactacatacttccgaatcgtgagctgggttaaacccgtcgtgagacaggttagtattaccctactgatgatgtgttgtattgccaatgggtaatcctgctcacgtacgagaggaaccagcaggttcagcacatttggtcgtagtgtgcttgtgctgcaggagccaaatgggagcgacagctaccatactgtggggattattgactgaagcgc

SEQ ID NO: 591352 - DNA, 436 bp, Homo sapiens
  misc_feature (423)..(423): n is a, c, g, or t
aggtgagaaacggtattttgatatatggcagagctccctttttttttgagacagtcttgctctgtcgcccaggggagagagatcagactgttactgtgtctgtgtagaaagaagtagacataagagactccattttgttctgtactaagaaaaattattctgccttgagatgctgttaatctgtaaccctacccccaaccctgtgctcactgaaacatgtgctgtgtcaactcagggttaaatggattaagggctgtgctggatgtgctttgttaaacaaatgcttgaaggcagcatgctccttaagagtcatcaccactccctaatctcaagtacctagagacacaacacactacagaaggccgcagggacctctgcctaggaaagccaggtattgtccaaggtttctccccatgtgatagnctgaaatatggcc

SEQ ID NO: 591353 - DNA, 921 bp, Homo sapiens
gcaaggatgatcatatgatgggtgccaatgactctcaagattagggatcagggagtaatgggaccgattgatatgtataataagatcatgaaaataatgccggtatgataaaagggggattgatcactgtagccagttgaatagtaatgcagtaacacggtgagcaatctcatggagtgaacgtgggattgtcacagaagtctattactcaccgcatacctgaggtctcggatcctagtatgtgatagtagtctagtcttcagttgttcattctggatgaaatatagtgcctgaccaatatggcccgaatggagatatatttcactccactgctgcataactgggggggatctttccgggctggggtcactacctgtccccttctattttggctctctcatttctaatcaagtttatgggtggaagaaatacagaggagtgtcactccttgagtgggggccttgtgcgactgcctcggtcccacgccttcactaatacaggtataccggagaaggcacaagtggtaagcgtacgtatccagttatcgctgtcctgtcagttgaaggaaaccagagaacttggagaaaaggtaaggtagactcgaggttctactaaccatgtgaggggtctgtataagcacaggagaatgaggtgagtttagtaacaggctatttggaacaattaggtgcgagggtgtaagttgggactgacacttttgtccgaattcggaggatttacatgaaagatggccaaaggatggtgctagctaggtctatccaggacgtgataattgtggaggcagatgagggagctgctttgaagttcagttgagtaaataggtcgagaagaaagtgtgatttacgggaaaatgcattggggaaggataaaaggaaggttaagggggaagacaaagcttaagaa

SEQ ID NO: 591354 - DNA, 208 bp, Homo sapiens
gaagtaattgtgtgtgttccaccaccgaccggtgaatacctgtccacagcacgttgatacaccaccgacctgttctcctgtgcaacagcaggaattgtgttgtacagcaccgacctgtgcacgccttgcaacagcgttgaattttaacaccacccaccttgggcggctgcagctcttcagcattgcgggggattcttcttaaagctca

SEQ ID NO: 591355 - DNA, 1012 bp, Homo sapiens
ctgcggtgacctcctagtgtgcgcgcgtgtgccgctttggggtcgcataagggcgggcgctagtcgtgtggtgcggcttcgttgggacacgttgaattctcggtggttccgtcagcggggttcgcgcctccgcggggtgcacacccggctagtggtgcatacgttcgtcgtctaggtgagggtgtcccgctcgttgtggccccgctctatctgtgggctagtttgctgcccgcaccggtgggccttgctctgtacgctgcccactggtcgggtggatgttttactggttttcgtcgtctccgggcctgagatctcctgcttgttggttatgcggcagccgcccgatcaggtggttggggtgcacgccgcccttcggtgtccggattcctttgttccgtactccggccgggcgctttcggccgctctccctgctcgtctaccatctctcgtggcccccccctggggcgcgggaactcgtctgttgtctcccccatattaggtggcgtacgatgttttctcgacttacgcaacgaacgtcgccgccgccgtatctgcttgggacccagcggggacatttggatatctcctccgtgtgcatgtagcacaccgctcgaggggtatgtcattcccgcggtgtgtgacgccccgcctcttgtgataaagcaaaatggtacacgttcccccaaagcgttcgtgtcaacgccacatgaggactggctcgccccaccacataggggtgtttccagcacaagactcatatgtctccgtgaagctgtctgcacgccacactacgttttcgcgctcggatctcaccggcgcgggggattgacctcaccgcggcgccatcgttggtaaaaatcttgcgaggcaggcaacgcgacccaagttgtaatgccccgcagtcgtcgtgagaagtaaagtcccgccgctaaaacttctggtgaagtaggtgaggcccggatcgtcgccctactatcagcccccccttctaccccccttaagaccaacaaac

SEQ ID NO: 591356 - DNA, 642 bp, Homo sapiens
  misc_feature (1)..(1): n is a, c, g, or t
  misc_feature (14)..(14): n is a, c, g, or t
  misc_feature (16)..(17): n is a, c, g, or t
  misc_feature (68)..(68): n is a, c, g, or t
  misc_feature (74)..(74): n is a, c, g, or t
  misc_feature (203)..(203): n is a, c, g, or t
  misc_feature (345)..(345): n is a, c, g, or t
  misc_feature (512)..(512): n is a, c, g, or t
  misc_feature (541)..(542): n is a, c, g, or t
  misc_feature (544)..(545): n is a, c, g, or t
  misc_feature (557)..(557): n is a, c, g, or t
  misc_feature (580)..(580): n is a, c, g, or t
  misc_feature (592)..(592): n is a, c, g, or t
  misc_feature (607)..(608): n is a, c, g, or t
nctgccgaaagtancnngtccgccatcacaggccgggactatgaacggtatctctgccgtgaccaccntaatgncaaagacaccaggggtagattttgtcagagaccaggtgggctacccaagcctgctcagaagtgacttgagcccgtctaagagaaactggtaaggaactggttaacaagccatgttttactagaaatggnagcaccaagattcttcacttcatgctcccccacacctgaacaaaaccatattgctgctacctgtggatgcttattgattctgtcactgccctcttgggccatgttcctgaaaggctctctgaagtcaagtatatgacaccgntggatgtaacctaaggaagggtattttccatgtcagatgagaactgggcgggcatagattctgcaacatcccattcctctggcacctgaaggcatgatgagcaaatgctgggtaaaggaagaaggccaggcagggcatgatcaggggaaaaggacaagtgaaagggnggatcaagtcacaatgttggcctgggccnngnnttggggttgagntcaaggttgggtcaaaggtgggngtttgttccttncccagggcccacttnnccctggggggcaaggcctccttgggactcaaccc

SEQ ID NO: 591357 - DNA, 850 bp, Homo sapiens
  misc_feature (34)..(34): n is a, c, g, or t
  misc_feature (62)..(62): n is a, c, g, or t
  misc_feature (65)..(65): n is a, c, g, or t
  misc_feature (69)..(69): n is a, c, g, or t
  misc_feature (91)..(91): n is a, c, g, or t
  misc_feature (115)..(115): n is a, c, g, or t
  misc_feature (132)..(132): n is a, c, g, or t
  misc_feature (153)..(153): n is a, c, g, or t
  misc_feature (156)..(156): n is a, c, g, or t
  misc_feature (192)..(192): n is a, c, g, or t
  misc_feature (234)..(234): n is a, c, g, or t
  misc_feature (301)..(301): n is a, c, g, or t
  misc_feature (445)..(445): n is a, c, g, or t
  misc_feature (508)..(508): n is a, c, g, or t
  misc_feature (520)..(520): n is a, c, g, or t
  misc_feature (538)..(538): n is a, c, g, or t
  misc_feature (540)..(540): n is a, c, g, or t
  misc_feature (542)..(542): n is a, c, g, or t
  misc_feature (547)..(547): n is a, c, g, or t
  misc_feature (550)..(551): n is a, c, g, or t
  misc_feature (554)..(554): n is a, c, g, or t
  misc_feature (557)..(557): n is a, c, g, or t
  misc_feature (559)..(561): n is a, c, g, or t
  misc_feature (563)..(563): n is a, c, g, or t
  misc_feature (566)..(566): n is a, c, g, or t
  misc_feature (568)..(568): n is a, c, g, or t
  misc_feature (577)..(577): n is a, c, g, or t
  misc_feature (606)..(606): n is a, c, g, or t
  misc_feature (614)..(614): n is a, c, g, or t
  misc_feature (635)..(635): n is a, c, g, or t
  misc_feature (653)..(653): n is a, c, g, or t
  misc_feature (663)..(663): n is a, c, g, or t
  misc_feature (667)..(667): n is a, c, g, or t
  misc_feature (674)..(674): n is a, c, g, or t
  misc_feature (683)..(683): n is a, c, g, or t
  misc_feature (687)..(687): n is a, c, g, or t
  misc_feature (689)..(690): n is a, c, g, or t
  misc_feature (696)..(696): n is a, c, g, or t
  misc_feature (700)..(700): n is a, c, g, or t
  misc_feature (704)..(704): n is a, c, g, or t
  misc_feature (706)..(706): n is a, c, g, or t
  misc_feature (709)..(711): n is a, c, g, or t
  misc_feature (714)..(714): n is a, c, g, or t
  misc_feature (729)..(729): n is a, c, g, or t
  misc_feature (732)..(732): n is a, c, g, or t
  misc_feature (737)..(737): n is a, c, g, or t
  misc_feature (746)..(746): n is a, c, g, or t
  misc_feature (751)..(751): n is a, c, g, or t
  misc_feature (764)..(764): n is a, c, g, or t
  misc_feature (767)..(767): n is a, c, g, or t
  misc_feature (829)..(829): n is a, c, g, or t
tggccaatcatgtgtgaaaccctgtctcttctgntatatacaaaatactattcttggttttnttnttcnttcctttttttccagctacttnttatgcttatgcattataatctgncttatcccgggaggtgnaggttgcagttagctgagatngtnttactgcacttcagtctctgtgtgacatagcaaganccctgttttcaataccaacaattcagggtgcagtataacgtnactatgaagaagagttgttctggagccataccgcatgatgcttcaatcctgtgctttgtcacctaanagttaatctaaattttttgtgtttctttttctatcatctgttaaatatataaccatttactgaacaactattcattgtgttccctaatcattccacctcagatgttgttctctgatagtgctgtctttgcttttggtttaattntgtcacatttgtatgctgtatgatcaccaagaggcttagagtgtttaaaaaatgaaaggcttnaaatcactctanttagggaaaagccccccnantnagttnggnnttnttngnnnanaancnggggaaacntgggatggggtagtcaaacaaaccaagcnaagggccncaaaaaaccggagggaggaangagggccccacacaaaanggcggggaanggcngaacacngaaaaaaanaccnanncctctncccngccngnggnnnccnaaaagacaagggctngcnctgangcccaggcnggagngcaatggcatgangantgctcactgcagcctcaaactcctgagctcaatcaatcctcccaccctcagtctcctgagtngctacgactacaggtgcatgc

SEQ ID NO: 591358 - DNA, 108 bp, Homo sapiens
cactacttacataaactgtgtgctctgcagcctgccaacgagttgttgaaaagaaccgtcactctgcatatcttcaatgcctacatgtcaagttttctcttggggaca

SEQ ID NO: 591359 - DNA, 1284 bp, Homo sapiens
gaggcgctgtacctgcattgctgcatcggtagcctagactctaggagactatcgcgaggctccactacgcctcataagatattcgaaggaacggagagaaccgggatcgccctgcggggacccggaactgagtctgacagtgaatggcatctgatgacctatgtacactaggtgaattgaggtcaatgctatggaatcgtcgctatagaagaagagaaggaggactgatgctaactgataggaataggaaacgtcagaagagaggagttaatcctgtagcgaaataccaccagacaggactcagacagcagctggcaatggagcaccacggggaagccgagcaaccaatcagggggagtacgagagtcaagtgcgctaaggtctggaggatccggagatccgtggtgattagacggtagcaaaatagtcggagcctgcaagttccaaggtcggcaagattgtcagtgcaacctgttagacctgtagctttgggaatcagtctgagaagtagggtaagtagaggtctgtcagaaggtacggggaagcccattgcggttcgtgcacggactacgctgtgaccaatgtacgatggaaggtccctccacagcatgtgctcagcttgagtttactcatgcgttatgggagcaaaggttaaaggaggtgcactgcgatgtgtcgagaaggatggaaaggaggccctcgatttctaaggggagacagcagggtcgaacgtaaaagtctttgacgatacccctgtacggaacgccggtgaattgacccgcccactaaggtttggtttcgtgggtaaatgccggggtacctaaggctttgatccctgaagatttaacggagggctctccggacggacttcttcgcgacgggaaccttgttctatccttcttggcctgatacgggcaaaggggttgttctgccgaactcgttaacgatagttcaatcctatcaacaatttcgggaaacccgtccaccgttgggtttcttaaaggggggggagttctcgagcccttaagcgatgggaacatttccttagggtgaaacagttcccccatgatactgggtgcgccccatgagtgggatccaaatatgtggccttggcacgtgggcgcaagacggagtttgggtggcgcgcacgttgagcctattcaaattggcgtacaggggctttcaaccacgcaaggaggaaatcccaaccggactgggcacccaatggggccacaatgctgcaataatgcgtgatgggttccccaacgcgccctctctattgtg

SEQ ID NO: 591360 - DNA, 266 bp, Homo sapiens
tgggccagtttggggactttcccaaaaaacccccatgactagggggttttaggtttttaactgatggaatgaaggattcaaaattaacccctccaaggggggattgaaggaaaaaccccttttaatggacaaaaaaaaaaaaaggggagggagtaacagggatatgagctttagccgcccaagctagcaatggcaacccttttgggtccccttccagcatgtggaagctttcctttcgcttcattcaataaacagctgctgctcca

SEQ ID NO: 591361 - DNA, 141 bp, Homo sapiens
taagtaaacaggcggtggggttctccatatgggtctggcgggtctcgaatcccgatctcaggtgatccacctgcctgtgcctcccaaagtgtgggaattacaggcttgagccaccacattgtgccccttcccatctttccg

SEQ ID NO: 591362 - DNA, 381 bp, Homo sapiens
gtgacttaaggatccctcaccgacggggtgctccacccgacggtgtgctcacccgaggggtgctcacccgacggggtgctcacccgacgggtgctcacccgacggggtgctccacccgacgaggtgctccacccgacggggtgctccacccagacggggtgtgtgggaactctctgtactatctttccaatttttctgtacattaaaactgtcctaaagaataatgtctacttacgaaaatcaatgacaaactaccaacccaggacaaagccttcatctttcccaccaagccccaggcagccccaaggggaccttccccaggacagttgctggaaccagtctcattcccaggggcctgtatccatggtgacacctgtatgt

SEQ ID NO: 591363 - DNA, 384 bp, Homo sapiens
  misc_feature (19)..(19): n is a, c, g, or t
gttactttcctctggtgangtcaaaacccctcaaagtcatccatgatgattgagtcaacttttttcaaactcctctaaatgttgacatattgacctcttctcaatgaatcactaatgttcctaatggcatctaggatggttaatcctttccaaaaggttttcagtttactttattcagatctatctgaagaattactttttgtagaagctacagccttgcaaaaagtatttctgaaataataaaacttgaaagtcagttgggcatggtggccacacctgtaatcaaagcagtttgggaagccgagatgagcagatcacttgagtccaggaggtggagactagcccgggcaacatagcaagttccattctctacaaaaaaaaaga

SEQ ID NO: 591364 - DNA, 148 bp, Homo sapiens
  misc_feature (131)..(131): n is a, c, g, or t
tagacagcatggtctgtctgggtattgcaaggtctctttaaaagataaaaaacaattagtccacagaattccttaacagaaaattggagggcaggcaggaggactatgggccttatggacaggcagtcagncatcacgcccagcgttt

SEQ ID NO: 591365 - DNA, 137 bp, Homo sapiens
cgattgccatgccgcgagagtagtgagggcgctgcgaagatgagccttgaagcctagtggcgcgtgcacgggatggagcctgccgcagatgcagatcttggtggtagatagcaaatattcaaaccgagaactttgaa

SEQ ID NO: 591366 - DNA, 191 bp, Homo sapiens
  misc_feature (18)..(18): n is a, c, g, or t
  misc_feature (20)..(20): n is a, c, g, or t
gggtttttttgggccctngntgttcccctcccctttttgggggttggggggggtcaaggggtccccgtgttccctgtttcccttgtacccaaagtttccccgccccctttcccccctgggtgatttcccttttttttaccggttcctgtaaaaactcccttttcccaaaaaaacttggggggtgttttcca

SEQ ID NO: 591367 - DNA, 214 bp, Homo sapiens
agagtgaaagtatggtaagagccaggtcatatcaggaagcactcttatctcattccaacattccgaagcggttgcagcgcacaatttcctccctgcttgaggtctgccgccggttaacattgtagctactgaactgaagagtgtcttcgtgaacggaagtggggttgtacaattgttttgtccattccgtgaacctcacaccctcctctttcga

SEQ ID NO: 591368 - DNA, 679 bp, Homo sapiens
gagcggacttttctgatgttgaggccagctccccacccgcaagaggccccacattccggtgtcatcagcccagaaagtacctccccgcaggcggagacagccccaagaagtcgacgccctcggtccctgccgccctggccacttaccctagatgggctgccgcctgctctccaagttcttgtgtgcccctcgcgggtgcggagtatgggtgcgctgagtgtgccatggacgggctactggctgcttcctggcagtctgctggggtcggctctgctcgatcggcttcctgtcggtgatctttcgccctcggtctggagtcctcacaataccgagaggggcttggctgggatgggagcgcacatagagtttaactggcacccagtgctcatggtcacccgggttcgtccttcatccgagggcatcggccattcatcgtcttacagactgactgtggaccttggaaatgcagcaagtctcctgatgaaatccatccatgcagggttaaatgcaggttgctgccattcttgcaataatctctgtggtggccgtgtaatgagaaccacaatgttaacaatatagccacatatgtacagtctgcacaggtgggttggagtgatagctgtcatatgctatttgtacagcttcttcaggttacagtctttctgcttccatggggcac

SEQ ID NO: 591369 - DNA, 821 bp, Homo sapiens
  misc_feature (553)..(553): n is a, c, g, or t
  misc_feature (695)..(695): n is a, c, g, or t
tagaggcatggcgttgtgacgccgctcttgcatgtaaggtgagttggatagcgagtgcgtcactagactagatgatccttatgagcattcctggctcgtgactatatgcttgccagttctacacgcatagtaagagaacgtgcgagcgggaaatcgcagcgtccatagcatctactcgcaagaatgggcatgcttcatgagggatctttcaagttgcgcactttaatacacaccatgggaggtcgccgacacggtatagtaccctactatcagattgatacgtcgccccgacccattgacagatcgattcggaacgaagctcccagagcctcctcggcatttccagcctgcaattgctcctttagttgcaaatttgaaacaacacatttttttatattttacagcccttttttaagcaaaagcttcagtcgtcccgcattaaagaggcagaatacaacgtgctggttgaacgagcataggaagcacacagacaatggcggaacaaaagaatgaaagtaacatgaacagaatttttccaattgggcggacctancaaagaaggaaagaaaaaggcacaaaggaaagtgactttacagagattgtgaaaaaagacacatgatccatttttgatccagaaagtagttcagattaaaggctggcaaaagcagaacattgacagacgaactatctgcatnttattgaacagaaagcaagctgaaatcaatgaaaacaacgtcggggaattttgcaatgttatttgcttggtacatcacgaaaatagtttgtggcaagaactgatgcgaattttttaccccttaccc

SEQ ID NO: 591370 - DNA, 133 bp, Homo sapiens
gggggggacccccctttttgcccacccctttttttttccccgggtttttttcccccccgggggtttttttttcccgggttttttaggggggggttttttccccccccctttgccgggttcccccccccgaaga

SEQ ID NO: 591371 - DNA, 139 bp, Homo sapiens
  misc_feature (115)..(115): n is a, c, g, or t
tatagtcatactgctggtggtgctggctcagaccaggcctgccgctgtcccccggcgctacctgggtactcacacatgtgcagatgtgcgctggccgctgctgtcaccagcactnagcacaacgtcagtctttctgata

SEQ ID NO: 591372 - DNA, 238 bp, Homo sapiens
ggagtgtggatcagtacacgggcgcgtgacgtcataacaggttggttaatcatagcagacgcgtgcttcctcacaggtccagtgtttatacaccgcagtgagagtctacgggccaggaaggtggcaggctgagcagagatcactaccttctcgcaggatcgagccttcacgttgccggtgtcgccagccgggcatgcagtgctggcgatcctcgcagcacacagcttgagacacgcga

SEQ ID NO: 591373 - DNA, 777 bp, Homo sapiens
  misc_feature (115)..(115): n is a, c, g, or t
gtgcgatgtgctgacgtgtctgcagcaaatccagctgctgctgcggcggctgtggctggctgtgcagctggcggtgactgaggatacgagaagcccacaagtcaatcggaagggnaagccttggcccccaggggggggcccctttggggaacccaaggtcccaagtgattggtgctgcccatgaactagcgaagaacctgtggcgagatgtggtggcgatggaaactgctcccactagcaggagcctgtgcagaaaagctagggttcccttgtaggaagaagcactaggaggtataaagaccactgttggggcgaactgctcggcccaagattttaaaccactggtttttgagcccaaatcggcggcggcaaagggcggtcggtgaaactcccaatgtgcacactttccaagttcacaccctttcacacgttgtggcttgcgattcaagcaaaatagcccaccaactccatttcaaacattgaacgactacacaccttgcgctgccgtcaagggcacgggtgaacttgcgcttggaacgagcgacggcacttcattcgttgcttcgcgtccacatgcaggctagcgtctagagaatatagcctagaggtcgaacagcgcttagcgctttcactttgggggtccattaagacaacaggcgaattagggcacaatagcagcaaaccaattgtagagagccgcaaacggggttcaattacggagagcgatgcacccaagcgaataccaagcacagggggtccgaaacggcttggttaccc

SEQ ID NO: 591374 - DNA, 543 bp, Homo sapiens
tagaggatccctgcatgtgaatgatgagaacttttaggttttttaatcttgggaatgttgtttatttgtagcaagtaatttatactaatttcacagactggcaaacaggtcttctaaattcaagaaattagttctctgacatcctttaatcctacataatgtggagaagggagtggaaatgaaatatatttccatacatgtatcttgcataaaataacatttttctgttcctgaaatagtatggttacacttgcaagcatgccttgaaagggcaaatataacttggctcccacagaggaaaagaaggtatagaaatggaagctcagggccaggcatagcggctcacacctgtaatcccagcactttgggaggccgaagtgggaggattgcttgagctcaggagttcaagaccagcctggacaacatggtgaaaccccgtcactatgaaaatacaaaaattagccagtcatggtgatgtgtgcctgtaatctcagctacttgggaggctgagttgggaggatatcttgagcccaggaggcggag

SEQ ID NO: 591375 - DNA, 157 bp, Homo sapiens
  misc_feature (149)..(149): n is a, c, g, or t
gctcgtctctagcagggatcccccttgggcgactgctccccgcttcttccttgagtgtttggcttgtctaccgttcctcctgactgagagtcaccgttatactttttgttttttcaatgaatgactgcagagaaccctgcttgcctcanggggttcc

SEQ ID NO: 591376 - DNA, 719 bp, Homo sapiens
cacgcgtcgctcctactcctcattgtacccattctaatcgcaatggcattcctaagtgcttaccgaacgaaaaattctaggctatatacaactacgcaagaggccccaacgttgtaggcccctacgggctactacaacccttcgctgacgccataaaactcttcaccaatagagccccttaaaacccgccatcgatctaccgatcaccctctacatcgaccgccccgaccttagctctcgaccactcgcgtcttctactatgaagcccccctccccagtacccaaccccctggttaatcctcaacctaggctctcctatgttattctagccagctctagccgtagccgtttacttcaatcctctgagtcaggagtgagcagtcaagctcgaacacgtacgccctatatgcggcgccatctggctgagcaggtagtcgccagaaatcaatctccctgtgagaggtcatcctctagtccatctattctactatcaaacagttactaataagtgggtcctttaacctctcgcacccttatcacagataccaagtaacagcctctgtattgactcctgccatcgatgacccttagcccatacatatgatttatgctccacggctagcggagaccatacgcgaacccccttcgaccttgtccgaacggggatgtccgagactagctctcaggcgttcaacatcgaatacgccgcgaggcccctc

SEQ ID NO: 591377 - DNA, 371 bp, Homo sapiens
aaagagtgagcagcagcaagatttatggtgaagaccgatagaacaaagcttccacagtgtggaagggggacccggaaatggttattgaggaacatggcgttgctggtgcgagtccttaggaaccagactagcatttccggagtttcttctttccagtgggttcgtggtctcgctgacttcaagaatgaagccgcagaccttcacagcaagtgttaccagctcttaaaggtggtgcggacccaaagagtgagcagcagcaagatttatggtgaagaccgaaagaacaaagcttccacagtgtggaagggggacctgagcgggttgccactgctggctagggtggccagcatttattcccttatttgtccctg

SEQ ID NO: 591378 - DNA, 551 bp, Homo sapiens
cgtgaggcgagagtcgtgggcggggactgcatctaggtaaaaagttgtggcgatgcttgggatgcttcggtcgtccagtaacatctgtgccacacagatcataacggccagtgcttcgagtacgcggaatctccttgggttactagtagctggtgccatatctcctcatcaacccaaatcccgcttcccagatggacctggccattgtctaggatatacttgtccatgacaggcgcaggagcggggtaataggacgacgtatttgcatcctcactgaaagtgctccgtaactccggctcgggctcgagacattctgactttactttttccagatcaatggcgggaccgctgccaagcctcaggagcagcacgtccgggagcctccggttaaggtcacggagctccttcatttcagacacaagtgccccgtactccttgagcttctgggcctgttgtaccagctgcctccgagtccactccagctcctgctggaggtggcgcatctcttcctgttgctgctggtagttgcgcagcagctcctcatacagagc

SEQ ID NO: 591379 - DNA, 207 bp, Homo sapiens
aattttcccattaaaaatggggtttttttaatttttggcccaaaattttttggggccttattttttcgggggggttggtggtttaaaaaaagggattccccaaaaaaggggttttggttcccccctttttaatgggggtccggaaaacaggggtttttttttttggtttaaagggaacttgggaaaaaaaaaaggggccccccccca

SEQ ID NO: 591380 - DNA, 166 bp, Homo sapiens
ctatactgtggtgtacctgtgattccaggactcccctctcttccggcttacttccatcaaacttttctttaaagcctgggacaagggaacagatgacttctttaacagtgacaataacagagtcagctatgttcccagatgctgcactcaccatatacctgtctct

SEQ ID NO: 591381 - DNA, 123 bp, Homo sapiens
tgctgaggtgatctagaggatccttatgatttgtagatcacatataagcaggtatagctataagaagaattttatggcgaagggacgcggcggggggatatagggtcgaagccgcactcgtaa

SEQ ID NO: 591382 - DNA, 959 bp, Homo sapiens
  misc_feature (796)..(796): n is a, c, g, or t
ctagttctagatcgcgagcgggcgccctttttttttttggttggaaatagagtctggctcgggggcacaggctgggatgtggcagtggacgtgtggatctcgggctcactggcaacctccgcctggctgggtgttcaacgcgactctactggtgctcagcctcctggagtagctggggactacaggcactgtgccaccacgcctgggctaattttgggtattttggagtgtaagacgatgggggttccaccattgttgggccagggctgggtcttagaactcctggacctcggtgatccacccggcctcggcctcccaaagtggctgggagattacagggtgtgtggacgccattgggacccaggccaagaaagaaaacaatcttttaaaccactatggatcttgtggccttatcaggggttctcaccaagacaaatccttttgtggaagagatactatttcccaacaattctacattattttccaaagggtggtctggtgtttgtggtgaacgttgagaggtttataaattttggagattggcgagagatattattttcttggcgttagacaatggtgctatgtgtagacaaactctaattttatttcaaacaatggtggtattcatggcgtggccaaagggaatttggaggccaattaaaatggctctggggactaatgtaaaaaggaaaaaagaaaaatttaaaattaccaggtgagaacttcctacttggcttgagaagaatttcaaaatccctaagatagggacttccccggatacgcatggtcctatcangaccggatcaccgggcattctacggggaaattttccaagcttacattcggctggtaccccaatgggcacggtaaagtcattcccatttgaaacacagcggtcaccgcgcacgtgttccaacgggtggtccgcgatcgtggacaactttctttcaaccgcattt

SEQ ID NO: 591383 - DNA, 773 bp, Homo sapiens
caacacttatgacttatttctagttagcaatgcacttaaatagtatttctttaaataaaacttcttggttctaatttttaaattgtttaaactgatctaccccgaagaaaagaaggaattaaaaagcaaatatgactataccaacaaatatacatatagttacatattcactttcaatgaacgctgacatttaaaaaacaccatacggcacaaacataaatatgtgtgtgtgtataggtgtgcttaacagtggtacaaatttccagtcaccccagtcaaaacatctgatttaaatttgttccttctgctgaatgccagatatgcaggttaggatcacagtgaaatgagcccatttcaataaagtctagaactaaccagtgccctcatatttgtggtacacattaatttttttaacgtgaagcatagtagagaatcaagaatgacgtttttctttgttccttcactttatgtagtagatttgatggtactctcatacatgtacagggtaacaaacagacgaataacaaaacaacaaaagtgttgcgcaacacatgagaccaccagaaacgatctatccaagcagccatcaattagtgacgaccgacacaccacatgagaagagtgacacatggacacaacagaagccaaaggaacaaccgacaaagcgagagccagagacctacccaaaaaaaacagccggggaccagacgttcgaaacactacaggatactgagcgcacagggcattaaagcaccaccaaagcaatcaaagcc

SEQ ID NO: 591384 - DNA, 475 bp, Homo sapiens
tttttttggtttcagaaacttggtggttggttgaggcaaatagagaaagattccttctgtgggctcaaatggaaggtttacatgagccattcctctgaagttcaccttctcaacattttgatgtatgtctccctgtgtctttgagttaagttttcagctaggatctactgtttcaaggaggaacaagttaggacctatatcactaggctgcttttctggtttctgagtcctactgtaaatcaagcatatctggaaaccacaccatactgctgtcatgggttttattgttatatccaactgggacctgcctcttcctcatgtgggtgatatttactaaacactatatgcagttggcatttgtcaagtactctgtgtgtttagttgatgaagttttttcccatcactggtgttacaaaaggcccttgcttagtgagcttcctttcatggaaggatgacaactaacaaactgacagga

SEQ ID NO: 591385 - DNA, 839 bp, Homo sapiens
gatgttcctcctctgactccccttcccctcctctcccctccttttcctgtccttccttccttatcctggagcactgagcaccattaggaagcttgagagaaagccaaaagttaaagatgagaaagagagagcgtgcaagaaaaaaaaaggaagataaaagataatgaaaaaaaaaaaaaagaaaaaaggacacgatcgggaccagctacatctcgccccgaaacctccgtaccacacgactccaacgaagtgcgggcgaccagcggccacgccaagcacatcgtcctccacacacgagccggccgaagacctacgcccgcatcgcacacgccacgggccacaaccaccacaaaaagcaccgcgcgtactacacaaccccacacaacaccacagaccccacaccccctcccgtatcaggaaaccaacaccaaccccacgcccaatcgacaccacacgtagacgtgggaccacaagaagcggcacgcaacaaccgaaggggggcccccatacgcgcacgcacgcaggacaaaacggagagaaacgcgccagaacaaacgaatacaatcgcggcccccaaccagcacacgacgagccgggcccgccaaccacaaccgcgacacacccccccgcacgacccccccaccccaccgagcacgcaaacacaccatccacccgcgacactacgtgacccaacacaacacaactgtagagagccaaacctgaaacaggcgtcaaccacacccacaacaggatccgggcacccccaacgcaagctaacacaaaaagaccaaaggcgccccgggccaccaggccactcaccccgcggaaacaccaaccgg

SEQ ID NO: 591386 - DNA, 375 bp, Homo sapiens
cggttcgacgagactctcatatcgatctcaatgacgcgaagtatttgtgggcagatcaagtctcgcgtgagcgggacgctggagcttggagccaaagccaatggaattcaccaatgtttactatcacaaactttggctaataggtggatgatgagattctgaaagagctattcagtcagtttggtaagaccctaggtgttcacgctagtaaacatccctctgggaaatccaaaggctttggctttgtgagttacgataacacacgaggatgcccataaggctgtggaatcacgcatgaattggaagagatatacgtggtataatcatatttgtaggccgtgcacacgacgaaagtacaacggttggcagagttaa

SEQ ID NO: 591387 - DNA, 180 bp, Homo sapiens
gccgccgtagttgctggtgcccaggctgttgggcgagtcgagcgaggcgacccacagctggaacagcgccgaggcttcgcccgtttccgccggccagccgcccatcgagaagctgaactcgcgcttggcgcgcttggggaagtagatcgaggcggtcatggcgtcgacgttggtcttgct

SEQ ID NO: 591388 - DNA, 585 bp, Homo sapiens
tactttccacaggggatctaaggtgattaatcaaggtggccacacaaaacaacagatgttcagtgtacacaaaacagccttctattggaagaagatgccatgtaggacttctgtggctacagaggagaagtcgatacctggcttcaaagcttcaaggtacaggacagactgactctcttgttacggttaaatgcagctggtgactgtaagttgaagccggtactcatttgccattccaaaaatcctaggctcttaagaattatgctaaatctactctgcctttgccctagaaatggaaaaacaaagcctaagtgacagccacatctgtttacagcatggcttgctgaatattttaagcccactattgagaactactgctcaggaaaaaaagttcctttcgtaatattactgctcattgacaatgcatcaagtcactcaagagctctgatgaagatatacaaggaggttaatgttgttttcatgcctgctacaccccttatgcatgccatggatcaaggagtagtaatttcaacttttaagtcttaccatttaagaaatacattcatgggctatagctgctgtaga

SEQ ID NO: 591389 - DNA, 135 bp, Homo sapiens
caagcctgccgggcggatctaaaagatcccctaacccacagtcccacttgatttttacgacgcactactgactggctactatgcggacggtccaatatcacagggaatgattgcactgaaggactcggggatatc

SEQ ID NO: 591390 - DNA, 500 bp, Homo sapiens
cgaggtccgtatggtgagggtcagggctccatatgtgatcagggtcagaggtcagtgtgtggccaggctccatagtcaggcttggggcatcctcagtcatgacaggcattagggcaaagcccgcctgccgcactcgatggagccattccgggtcccagctctggtctctgtattggagcctccgctttccccaccagccaccccgcccaggcctgtgccagtgtttccagaagcctctccaggccccattgcttggtgaggaggcctcttgctgtagatgaaggatctgggccgggctcagcataatggggacagagaccctgcacaccaggatgaggaggatgctttggtggtggtgcatcccccaggactgcaccgattgctctcagaggatgaaatgtgcccgagcagtctcttcagaaagccctgcctgggctcccttggcagccaggctacaagacagtgctggtgccctgggtgggcaggacgtggcattgtac

SEQ ID NO: 591391 - DNA, 165 bp, Homo sapiens
atgagactctatctctagtaaacattaaataaaataaaaaattagtcaggcatggaggcatgttccaggagtcccaagcacttggcacttgggaggctgtggtaggaggattgcttgagcccaagaggtcgaggccgcagtgagcgattacgccactgcactcag

SEQ ID NO: 591392 - DNA, 124 bp, Homo sapiens
tttattgtgcagctgtcaattcagtgcgcatgcagtcaggggcaagggcagcctcctcaggatgtcaggcatcaggcaagtcatgtgacctgcgttccaggcgattctaggctcggttgccctc

SEQ ID NO: 591393 - DNA, 103 bp, Homo sapiens
aggcagttatctgcaagcaaagagagaggcttcagaagaaacaaaatcaccagcaccttgatctttgacttctaatctccagaatagtgagaaataaatttct

SEQ ID NO: 591394 - DNA, 656 bp, Homo sapiens
  misc_feature (13)..(13): n is a, c, g, or t
  misc_feature (65)..(65): n is a, c, g, or t
  misc_feature (79)..(79): n is a, c, g, or t
  misc_feature (89)..(89): n is a, c, g, or t
  misc_feature (112)..(112): n is a, c, g, or t
  misc_feature (115)..(115): n is a, c, g, or t
  misc_feature (123)..(123): n is a, c, g, or t
  misc_feature (135)..(135): n is a, c, g, or t
  misc_feature (157)..(157): n is a, c, g, or t
  misc_feature (160)..(160): n is a, c, g, or t
  misc_feature (162)..(162): n is a, c, g, or t
  misc_feature (164)..(164): n is a, c, g, or t
  misc_feature (169)..(169): n is a, c, g, or t
  misc_feature (191)..(191): n is a, c, g, or t
  misc_feature (194)..(194): n is a, c, g, or t
  misc_feature (200)..(200): n is a, c, g, or t
  misc_feature (214)..(215): n is a, c, g, or t
  misc_feature (218)..(218): n is a, c, g, or t
  misc_feature (221)..(221): n is a, c, g, or t
  misc_feature (226)..(226): n is a, c, g, or t
  misc_feature (231)..(231): n is a, c, g, or t
  misc_feature (236)..(236): n is a, c, g, or t
  misc_feature (241)..(241): n is a, c, g, or t
  misc_feature (248)..(248): n is a, c, g, or t
  misc_feature (250)..(250): n is a, c, g, or t
  misc_feature (258)..(258): n is a, c, g, or t
  misc_feature (282)..(282): n is a, c, g, or t
  misc_feature (298)..(298): n is a, c, g, or t
  misc_feature (401)..(401): n is a, c, g, or t
  misc_feature (416)..(419): n is a, c, g, or t
  misc_feature (648)..(648): n is a, c, g, or t
tttttgaaaaaangaaggccacgtcatatgaggtctcagcttcaagtacaggagttgcagcccantgtagggagcaggngctcccaggngttcacgcactcacatggggtanttntgcacaanatcctgtttggnaagttccagcaacataggtttnttntngnttttnttgttgttcacatttttattgnggncctttntatggggggttttnnttntgnttttncgggncaggngtggngttgggngngggtccanggggggggtgaaaatgctcttgtncaggggattaccaggnacaatttgccagtggtggaagacagacagagaaaaggcttgtccctgggtgtgagtccggagatcagtctcaaagccaaaagagtcgatggccgggataaaanctttgatggtgtacnnnngggagcctgggatgggtgcatcctgagtcacgtgccccctgcgcctggccaggacggtataaactgcagagacgcaatctgcaggggcctggacctctacaaagtagtaaggctccatcagacgaggagtagccatgaggaaggcagagtagacgactctcctggctgtggggatgatctggcccccgccccggtgcaggggctcctgggcaacaccgcatccaggatnttaaactt

SEQ ID NO: 591395 - DNA, 455 bp, Homo sapiens
cacgaggtgaagcagtgtaacttggtgaggaacgtcttattttatctctttaccacatcaacagaaacacttccccttccaaatgaaaacattggcatattctgaactaaaaactgaatcccaaatgcttcgacatattttgcagcaaacgctgtttaagcagaaacaccaggaaatatctctcagggacacccttgcaaagctctcggggtgtcagggcctgaccctgggaagtggggaggcctggagaagtggtggaagccatgcacagccttccctcctccccaccctcaaatccaagccaaggaggccttgcccccaagtgccgaggaagctcagaaccccagggtatgagaggggtagctatcagcagggaagccgccaggaaagacctcaagatgatctgaccgagcctcatctccaggccccttttcataaacaggggaacgccggta

SEQ ID NO: 591396 - DNA, 339 bp, Homo sapiens
  misc_feature (37)..(37): n is a, c, g, or t
taaatggcagtgtaagtgccacaccttttgtcagtgntctgggagaaattgaccctcagagccgggtgcggtggctcacgcctgtaatcccagcactttgggaggctgaggcgggtggatcacaaggtcaggagttcaagaccagcctgaccaacatggtgaaaccccgtctctacgaaacatacaaaaattagctgggcatggtagcgcatgcctgtaatcccagctactcagggggctgaggcaagagaatcccttgaacctgggaggtgaatgttgcaatgagccgagatcgcgccattgcactccagcctggcgacagagcgagactccatctca

SEQ ID NO: 591397 - DNA, 1338 bp, Homo sapiens
gtacccctaaaagccaaaatgggaaaggacaagactcatatcaacatagtctgtccttggacacgtagattcgtggcaagtccaccactactggccatctgatctatacaatgcggctggcatcgacccaaagacaccacttgaaacacattcgacgacggaggcatgctgagcactgggaaacgggactccttcaatgtatgcctggagtctaggactaaacctgacacagctgacgcgctgaaccgtggtactcacgcatggcatatctccttgatggaccatcggagaccagcacagtactatgctgactatcacttgagtgccccagtgacaccagcgaccttaatcacaaaagcatgcagttacagggaccatctcaggcatgacctgtgactgtaccatgattgtcagcttgcatggctgtctggatcgcaaatctgaacgactgtgtatactccacatgacaatggcgcacgaaccccgaagaggccatgacactatacctggcttacccaccaaccgaccgaaggcgcaacacaaaaactacactggcacagagcagacacacaccacaacactgcgcactcccacctggaagcccaccccatacagcacagaacacggcgaacaatcgaaggaacaacgcgcaaacggcaaacgccagcgcgcagaacaacaccaggaacaaacccgcggaactacaaaacccgcgcagaacaagccagaccacacgatgccacaaacacacagggaacgagcaacaggggaacaaccaaggcctgggcaacccaagcgggccaaacagagccacagggccgcacactgacacatgcgacacgacaacgccgacaagcgcatgcgacaaagcgcacaaggggagaaaccacgacgcgactggcaagaaccccccgacaccaagccctccaatgcagccaaaacatggcacccagcgagaccaaccaccatgaccgcactagcacgccccaaggaccgacaccaacccaaggaggcacaaaggaacgcaaccaaaaggacagacaccacaaccggggacacacacgaacagagcccagccggcgacccccgggcaccccgcaaccgagcacacagcggctaacaccgggccgacgggacacggggcaaacgcgaacaacaccgggggagcaaggcggcccaagcccaccacagctcccagcccaaagcagacagcagaggacaacaaagcagacaagacacaggcaaaaacagagtaagagcacccaagccagcacgacaacgccacaccacctgagacagcaagagcatacagccacgccacgacccagaagagcgacc

SEQ ID NO: 591398 - DNA, 313 bp, Homo sapiens
  misc_feature (3)..(3): n is a, c, g, or t
  misc_feature (5)..(5): n is a, c, g, or t
  misc_feature (24)..(24): n is a, c, g, or t
  misc_feature (57)..(57): n is a, c, g, or t
  misc_feature (65)..(65): n is a, c, g, or t
  misc_feature (78)..(78): n is a, c, g, or t
  misc_feature (82)..(82): n is a, c, g, or t
  misc_feature (109)..(109): n is a, c, g, or t
  misc_feature (125)..(125): n is a, c, g, or t
  misc_feature (136)..(136): n is a, c, g, or t
  misc_feature (148)..(148): n is a, c, g, or t
  misc_feature (175)..(175): n is a, c, g, or t
  misc_feature (204)..(204): n is a, c, g, or t
  misc_feature (248)..(248): n is a, c, g, or t
  misc_feature (259)..(259): n is a, c, g, or t
  misc_feature (305)..(305): n is a, c, g, or t
ccngnctgtaagatgttgttttangggcgaaaggggagaaacggaaagtgttttacncgttttcnaaagtgttggtcnttcnaatgtagctatttttcgtgttgcatcntttctacgtcagtacncgtggtgtacngggttaatggcnagtactgtattggctctgtgaaaacgnatttgtgaaaagagtatgtagtggcgtcntttgaactgttagatgctgaatatctgttcacttttcaatcccnattctgtcccnatcttaccggatgctactggacgtgaatggttaataaaactgcacngtgctgtt

SEQ ID NO: 591399 - DNA, 1277 bp, Homo sapiens
ggtcccagagccaagagtgccaaggtgtcatggggccacacgggagccacgagtcccaagggtccacggcagtacgaggagacacccaggtgcccatgcccagcccatccgtggctgcgtcccaggaggcaggcagtggcatatgacagtgaggactgcgagggtctcctggggacagaggcaccacccaggtaagcagggctgctgctgcacgcctgtttgccagtgtggccgtgtaggggccctcacacctcctctgtggtcaaggatggaggccaaccagaaggccaagaacgacagacggcgaggcaggggatgctaggggcctgacagactgatccagccctgagagtgaggtcacgatcacgaggcggacggtgcaggcccaaggtgggcaccaccctggagcgggccccagggcaaaggcacaccaggtgcgctgggcacagaggcacgccaagggcaaggccacgggcagacatgcgggcacagccaagagaaacaaccccaagaagcagggaacgagccctcgtacaaccccctactcgggagacacacgggcacgtggccacgacgcagcgacgaggcaagaccacagcataggacaagagagcggcctacagaagggcccacacgcaaagcgcaacaggaggcctgcccgccaccggcggcatggagcgggagcacagaaacgggaggccccctgactgccaacccacggccctgggccacgacggccagcgcccacggagccatccatgggggaaaggggcccggacacgccgcagcacagggccaccgcgaccgagaccggtgcacccgcccagccggaacaagcccatccgaccggtgggaagggccacgacctaaggaggcaccgaacgaaacagcagacgcgcacatcggacaacagccaggcaacgccgaagagcagacaacgccgcacgaaggcacgaggccccccagcacgcggcggcaagagccagccacaagcccccgagggcgccccaccaaccgaaggcgccgagaagccgacaccgggggcgccgccacggtacacgcagcagacgcaagaaacaaaccaagacaacgcaaaactaagacaacagaagacaagtaggaccgccgaaaagaacagaacccgtaggcggaaataacgaaaaaggcagccagaacaggagcacggataggaagaacagagcaaagaacaggcgaacaacgcggaaagcaggcagggggaagacaccgaaagcgaaaaacgaacaagagacgcagaa

SEQ ID NO: 591400 - DNA, 121 bp, Homo sapiens
aattcaagcttctaacgatgtacggggacatggagaccaaagaccttccagtctatggtctccatgccccttatttatgggaaccatttcattctaacagaataaaccgagaaggaaacca

SEQ ID NO: 591401 - DNA, 168 bp, Homo sapiens
tctagagtatccccccgaatggaatcctgttgcagaaatttgtcagttctctttcagagattttcccaatgctctatttttagaggaaaagtgtattacaaatacactaatacaagttaacttttttcttgcattgtgttttcctattcatttctccatttgattgat

SEQ ID NO: 591402 - DNA, 389 bp, Homo sapiens
acgtgacatgagcaaaacatggctcacaagcagataccccagatagccaagacacatgtgacaactgtgcaacatcactaatcatcagagaaatacaaattaaaaccacaatgagatacaaacttaccccagacagaatggccattattacaaagtcaaaaaacaatagatgttggtgtggctatggcgaaaaaggaacacttatatgctgctggtgggaatgtaaattagtacaacctctataaaaacagtacggagatttaccaaagtgatctatttctttttttaacaatgtatttatcttaagaaaaacagcctgggcaacatggcgaaaccccatctctacaaaaaaatacaaaatttagccacatgtggtagtgcgcgcacca

SEQ ID NO: 591403 - DNA, 502 bp, Homo sapiens
  misc_feature (453)..(453): n is a, c, g, or t
aaagatgtttttattgttgaatagacactacggcattaagatttccactatgatgggtgctcacaaatgataggcctcttaggtaagaagctttaattgacaacattaaatatgcggggcggggggagtgggtgcagagtctctctttcctttgttagggcatcccagtgacagaaacaatgcctgacacatggtacgctctcgataaatattcgttgattacataaccccctctaccacccaataacttctcatcattcattcaaagttactgaacgtaccatattagcgaatctgcaatggaaacagtggaggctgttttctcaaaggattttctaataaagcaacaaatctttttttaaaaaaatgaatggtgtgccccaagtcaatgctgggcttcggatttctgcggtagtttggcctggggtcctcactgggatgctggctggggangtgctccctgcccttgaatctccttcctttgtagtttttggcggccgca

SEQ ID NO: 591404 - DNA, 101 bp, Homo sapiens
tgctcaggtaggcgctgctgcagatgctccaggaagctcagcaggcctgctggccccacaacctgcctgtggttcaggcggctcagcagcgagaactagag

SEQ ID NO: 591405 - DNA, 139 bp, Homo sapiens
gttatagcatggcgtgtggaagtgcagcagggcaaagaagtaaaaataactccaaacatgtgggcctgagcaaattgcaacaggatagcaactgctcattccttgcagagggggcaagcactgcataccagtagatgca

SEQ ID NO: 591406 - DNA, 420 bp, Homo sapiens
atagcattctagtacatataagtcagttaatagttgactccttgaacatgtataggttggacttacaccgatggtatgctgatccgctgaaagctcaggatatttctcaggcttgtctatctcggtgagactcattgtccgaatttggtcaaccatgtaagaattaattggggccttccagagctagtcttagcctgggtctagagtaggcgtgatattagagcatggtcctggttccacagacctatctcttgtgttatgtcagctacataactgaagtcagcaaggatatatccaagtggactgggttgaaactccagattccgcacggctctatctgtaatattacaattccactctcgttccgtagcatctaatctctggtaagcgttgcgcagtctcatacagtgtacacgtagc

SEQ ID NO: 591407 - DNA, 268 bp, Homo sapiens
aggattcgatgcaggatgccatatgacatttagaagttatgtctccttagctaccttggatctgtgataatttgttcagactttatttttgaagacctgaatagttttgagaagccctgttcaggcactttgtagaatgtaccttttgggattgtctgatgttcttctcataggtaggctggagtcataggatgtcaacttaaaaatcacacagtttataagtttagaaaagatattttatttattataaagtgctacaacttgcagg

SEQ ID NO: 591408 - DNA, 303 bp, Homo sapiens
tggtggtcctaggacagacagtgaccagaaaagctaacacaatccaggtggctctgactaagagaaaattgactaaatgaatcttgtgtccaagaacttaccccttttcagctgagccctggggactgtccaaaagccagtgaaatgtgaaggaaagtggggtccttcggggcgatgctccctcaggctcagaagagctctaacctgctccctggtttggcttgagggggctgggaaaaaaacttggcactttttcgtgtggatctcgccacatttctgatcagaggtgtacactaacatttc

SEQ ID NO: 591409 - DNA, 116 bp, Homo sapiens
caaagcgctggagggcacgcaggaagccgacctggatacgttgcgcttgaactacaaccccaccgacatgaagcggatgaacagcgacacccgggccttcctcgacacgttcgcag

SEQ ID NO: 591410 - DNA, 190 bp, Homo sapiens
  misc_feature (1)..(1): n is a, c, g, or t
ntcgacgggattggtgcaacggcaggtaccgcaccttgccgctttgccgtgaatcttcaggtgttggatcccacggcgttcctgaatgtcgcttacctgcagcagcgccgcttcttcacggtgcaggccgtgatagagaaggacagccaatatcgcccgatcgcgcattcctttcaaagtggtttcatcg

SEQ ID NO: 591411 - DNA, 139 bp, Homo sapiens
agctgtctgcaggacgatgagcagatctgtttcgtcagctctaaaaggctctccttcgcctggtgcagggtccgggtgatggccacgtagagccactctctcactgtctgggagttgccctggtagaagaggtccgtgg

SEQ ID NO: 591412 - DNA, 106 bp, Homo sapiens
tgcctcgtggtactcctccactctggtactgcagagactggcactgcttggaaacttacctggacacctccactcagtgaatttgggtacctgcagctcgaattcg

SEQ ID NO: 591413 - DNA, 482 bp, Homo sapiens
aaattcggccatattggccggccattcgaattaggcttaatggggattttacctttaataaatggtggcagttccctaaggtaaatcctttaccattaaggtaccaggccttattcttcccttaaaggggaccccaggttcccatatgggttggaaaaatgggcctgggggggtttggtttaatccttaaaatttggttccaataagttttgtgggaatgggaatcctggtttaataagcttggggggggtccttttccccaaaaccccttttgggtgaaaccatccctttgccagttgcagccttttgacctcggttaccattagaagagttaatctaattttaacttttgaccgttggccttacaatcaaaggtaagtattatatattggacctgatgaaaattaataaccggttttaccaaaattaaaggtccatggtagaaaaaaaaaaaccataattaaatattaccataaaaaaaa

SEQ ID NO: 591414 - DNA, 119 bp, Homo sapiens
ccttagaacgggctgaactggtgcagtggtcaaaactgtcttggtgcacttccccatacacttatgctgctatgaggcctcttctgctctcgggctcatcatttacccaccactatgtc

SEQ ID NO: 591415 - DNA, 550 bp, Homo sapiens
gcggcgccctttttttggtgttcaatattagtccaggtatgagttaaataatgacaagtctgggcaacataatgggaccctgtctctacaaaaattaaaaaaattactcaggtgtggccgggcggtgtctcacgcctgtaatcccagcactttcggaggccgaggcaggcggatcatgaggtcaggagatcgagaccatcctggctaacaaggtgaaaccccatctctactaaaaatacaaaaattagccaggtgtggtggcgggcgcctgtagtcccagctactcgggaggctgaggcaggagaatcgcttgaacccaggaggcagaggttgcggtgagcagagatcgcaccactgcgctccagcctaggcaacagagcaagattctgtctcaaaaatgaatcactcacaaataaatcactcaatcaaaatacaattggaaagcaatcacatagcttacagaatccgtggaaaggctggagcgtcttgacacatggagaacaacaacagaagccaagtgacctaagacacaggctaatcactctaccgt

SEQ ID NO: 591416 - DNA, 747 bp, Homo sapiens
  misc_feature (312)..(312): n is a, c, g, or t
tactatggtatctgtgtaccatattcctaagtatccattattaaatggggacttcttaaaaccataacctggcttgccttttagtgttaagaaaactacaacagtgtgtatagttagagatttcttctttaatgaagaagagctgactgtagttaatgagcagtgatctgagaaagacattaaataagtggtctgagagtgatacatttgtcaaacatgaagagtgacaaccatcaatttatgaaatggaaacaatcagactgggaattgtatacgaatttcattggtatatgtgcctggtatggcctctgngaataacttagaggaaatgtgttctacctatatgtcctcagttacttcatctacaagtgtgggaaaaacattttgcctcttaaaatgtgtgaagaggattatatatgatatgatatatgcgtatatatcaatatatttaattggcttagagtttctagcaatataagcaataataataaagtatacgtgtattagtataaacataagggttgaaaggttcttgggattggatgcatatagactaaagtgttgtattgtgggggcaaaggtaaggcggtaattgtcgagtgccagggataacaagcaaattgatgagaaagtctaatagtaatggttggtcccttttgaaatctatgctaacaaggtacttagatagcctaagataaattaacttgggggggaagacaaatggtaaatgggaaccttaaaatggcc

SEQ ID NO: 591417 - DNA, 238 bp, Homo sapiens
  misc_feature (224)..(225): n is a, c, g, or t
agtctttaattttgtgtaatgtgttaagtgctgttcatttaagttattgaaaatgagaataaaatgttgagcttctttaaaagtaacacactatgcaagcatgtgtactttttatatctctcatgtttagtttttataacaccatatccaggttgctatctcacatagtagtcctttaacatatgtgtattagcagtgccaatggtggactgaagctgcttcannctgttccctttgc

SEQ ID NO: 591418 - DNA, 373 bp, Homo sapiens
  misc_feature (373)..(373): n is a, c, g, or t
cggccgcggaggtcatgcctggtattccagcactttggaaggcccaggcaggcggatcacctggggtcaggagttcgagatcaggctgggcaacatgacgaaaccctgtctctactgaaaatacaaaaattagccaggcatggtggtgggcgcctgttatcccagctactcgggagaactgagcaggagaattgcttgaacacgggaggtgaaagttgcagtgaaccgagattgcaccactgcactccagccaggcgacagagcaagacttagactcaaaaagtacataattaaagtaagaaaacttgcaatagtcattaagacttactaagacacactgttcctaacagagcaatgtacagtctgctacatn

SEQ ID NO: 591419 - DNA, 120 bp, Homo sapiens
aatttaactgttagtcaaagaggacagcttttggacactaggagaaaaccttgtagagagagtaaaaaattttacaccctagtaggctaaaagcagcaccattagaagcgttcagctcaa

SEQ ID NO: 591420 - DNA, 868 bp, Homo sapiens
  misc_feature (68)..(68): n is a, c, g, or t
ggggtcgaagggtcaggggccgaagcaccggccacaacttgaagccggaccggcctcttcgccccagnggctcgcggacgtagatgcatccagcgtgcgactatcccagcgcctaacggcagctggacttcgctcccgggacctccaatgggctaccaccttcgcccgcagaccccagcccccgccacgcccacacgtcgcactaggttggcccgcgcctcactggttacggggtcgacccccctagggggcggagctagagaggccacggccaatgaacgccgggggtaagcgggttagtacgacgagaagagtgacagacaggctccataaccagtagacgtagaaggcagaactgagtggcgggtacggcacccgatggctattcgagctctcgatctcggagactggagcgggccattcagaggcgcggggccgggcccggcggacgcttgttgttgtccggccgggggaggcggaggtcgctcgctcgctcgctcggctcgctgactcgccggagcgctctgtggcggtcggcggcaggtcggtcgcgagagcgggctctgtggaagggggcgaggctatgtcgcggtggcagcccggatgggccggcagggccgggagtaacgggacgtcgccgcggagcttcttcccccggatacagtgcggcccgagcggaggccgcggcgccgccctccgatcttgaagagcccgcgctgcgcggagcccgcccccgcctgcgcaccggcaccgacgcggagcgaccagcccagccagacccggcccggcgcggcctgatctaacccagccaggcaggtgggtgtccgccctgcgtcccgcgccgtctgcgtacccggaaccacccgct

SEQ ID NO: 591421 - DNA, 246 bp, Homo sapiens
gtggttatacatgagtattgctgtctgccttctgacacatagcttgtaggacatacttctggtgggcactgtgaggaaacttgaggatgaaatcagtgagactgcatgcacatatgacaggcatggcctgtctcctcacttgaagtgcacaggtcccatcgaccaaagccctgtttctgatcactactcactgtacagaccaggggagatacctctacgagtacgaacttgcacaggccatttcaa

SEQ ID NO: 591422 - DNA, 198 bp, Homo sapiens
ataatgcgtacaccacctgagtccaccacctgtatcaccacctgagtcacaccacctgagtcacaccacctgagtcacaccacctgagtctaaattgcttgattatgtcagaaaggtcctttgacttcaactctactcatttgaggatctacctagagtggaagtgtcaagtcaaaggacctttctgacataatcaag

SEQ ID NO: 591423 - DNA, 2350 bp, Homo sapiens
  misc_feature (68)..(68): n is a, c, g, or t
  misc_feature (2159)..(2159): n is a, c, g, or t
  misc_feature (2165)..(2165): n is a, c, g, or t
  misc_feature (2178)..(2181): n is a, c, g, or t
  misc_feature (2350)..(2350): n is a, c, g, or t
ggggtcgaagggtcaggggccgaagcaccggccacaacttgaagccggaccggcctcttcgccccagnggctcgcggacgtagatgcatccagcgtgcgactatcccagcgcctaacggcagctggacttcgctcccgggacctccaatgggctaccaccttcgcccgcagaccccagcccccgccacgcccacacgtcgcactaggttggcccgcgcctcactggttacggggtcgacccccctagggggcggagctagagaggccacggccaatgaacgccgggggtaagcgggttagtacgacgagaagagtgacagacaggctccataaccagtagacgtagaaggcagaactgagtggcgggtacggcacccgatggctattcgagctctcgatctcggagactggagcgggccattcagaggcgcggggccgggcccggcggacgcttgttgttgtccggccgggggaggcggaggtcgctcgctcgctcgctcggctcgctgactcgccggagcgctctgtggcggtcggcggcaggtcggtcgcgagagcgggctctgtggaagggggcgaggctatgtcgcggtggcagcccggatgggccggcagggccgggagtaacgggacgtcgccgcggagcttcttcccccggatacagtgcggcccgagcggaggccgcggcgccgccctccgatcttgaagagcccgcgctgcgcggagcccgcccccgcctgcgcaccggcaccgacgcggagcgaccagcccagccagacccggcccggcgcggcctgatctaacccagccaggcaggcaatactagcccctctggagcacggagctccttccccaaagacatgaagctattggagaactcgagctttgaagccatcaactcacagctgactgtggagaccggagatgcccacatcattggcaggattgagagctactcatgtaagatggcaggagacgacaaacacatgttcaagcagttctgccaggagggccagccccacgtgctggaggcactttctccaccccagacttcaggactgagccccagcagactcagcaaaagccaaggcggtgaggaggagggccccctcagtgacaagtgcagccgcaagaccctcttctacctgattgccacgctcaatgagtccttcaggcctgactatgacttcagcacagcccgcagccatgagttcagccgggagcccagccttagctgggtggtgaatgcagtcaactgcagtctgttctcagctgtgcgggaggacttcaaggatctgaaaccacagctgtggaacgcggtggacgaggagatctgcctggctgaatgtgacatctacagctataacccagacttggactcagatcccttcggggaggatggtagcctctggtccttcaactacttcttctacaacaagcggctcaagcgaatcgtcttctttagctgccgttccatcagtggctccacctacacaccctcagaggcaggcaacgagctggacatggagctgggggaggaggaggtggaggaagaaagcagaagcaggggcagtggggccgaggagaccagcaccatggaggaggacagggtcccagtgatctgtatttgatgaggaggagccgaggccccagcttcatccagcttcaaccaatgcctggacctgtccacctgagaggcccctggggcctccccagctgctggccagaccctggcgctgccacagtcctggcactgcccaaggccatacctgcctagccctttggctccatcctgtggatgcccactcacccctcagactcctgctgcccatgctgtggccggacttgtcagcagggggcctggtgggaggagcgactgccctgcccaaatgaactgccacagcagggacagctggaccgcagagtttatttttgtatttctactgggcctgcacactccagcccaaagggtctgtggccggaggccccacgagcaggccccagcagtcaccggctctggtcttgggccggccccggtgcccacctgtacccccacctcgcccatttggccgcgtgcactgagtgtcactttgctgcagctcgtttctttccaataaaagtttctgtgacttaaaaaaaaaaaaaacaaaaaaaaaaanaaaaancccgggggccctnnnntgcgggggggggaaaaaagggtgattgcacatgggccatcgggtcaaaagggggttcctcgagcccacagttttctgtccacaacgggggaagacttgcgcggggtccccctatataggaggggcggcgataatttgccagaaagcccgggtaacccggattatgaggn

SEQ ID NO: 591424 - DNA, 2564 bp, Homo sapiens
  misc_feature (68)..(68): n is a, c, g, or t
  misc_feature (1786)..(1786): n is a, c, g, or t
  misc_feature (2373)..(2373): n is a, c, g, or t
  misc_feature (2379)..(2379): n is a, c, g, or t
  misc_feature (2392)..(2395): n is a, c, g, or t
  misc_feature (2564)..(2564): n is a, c, g, or t
ggggtcgaagggtcaggggccgaagcaccggccacaacttgaagccggaccggcctcttcgccccagnggctcgcggacgtagatgcatccagcgtgcgactatcccagcgcctaacggcagctggacttcgctcccgggacctccaatgggctaccaccttcgcccgcagaccccagcccccgccacgcccacacgtcgcactaggttggcccgcgcctcactggttacggggtcgacccccctagggggcggagctagagaggccacggccaatgaacgccgggggtaagcgggttagtacgacgagaagagtgacagacaggctccataaccagtagacgtagaaggcagaactgagtggcgggtacggcacccgatggctattcgagctctcgatctcggagactggagcgggccattcagaggcgcggggccgggcccggcggacgcttgttgttgtccggccgggggaggcggaggtcgctcgctcgctcgctcggctcgctgactcgccggagcgctctgtggcggtcggcggcaggtcggtcgcgagagcgggctctgtggaagggggcgaggctatgtcgcggtggcagcccggatgggccggcagggccgggagtaacgggacgtcgccgcggagcttcttcccccggatacagtgcggcccgagcggaggccgcggcgccgccctccgatcttgaagagcccgcgctgcgcggagcccgcccccgcctgcgcaccggcaccgacgcggagcgaccagcccagccagacccggcccggcgcggcctgatctaacccagccaggcaggcaatactagcccctctggagcacggagctccttccccaaagacatgaagctattggagaactcgagctttgaagccatcaactcacagctgactgtggagaccggagatgcccacatcattggcaggattgagagctactcatgtaagatggcaggagacgacaaacacatgttcaagcagttctgccaggagggccagccccacgtgctggaggcactttctccaccccagacttcaggactgagccccagcagactcagcaaaagccaaggcggtgaggaggagggccccctcagtgacaagtgcagccgcaagaccctcttctacctgattgccacgctcaatgagtccttcaggcctgactatgacttcagcacagcccgcagccatgagttcagccgggagcccagccttagctgggtggtgaatgcagtcaactgcagtctgttctcagctgtgcgggaggacttcaaggatctgaaaccacagctgtggaacgcggtggacgaggagatctgcctggctgaatgtgacatctacaggtgggccggcatccctgcagatggcctccaggcctccaggtttgtggggcacttggcgcctcacaccacctgtcaccctatactccccagctataacccagacttggactcagatcccttcggggaggatggtagcctctggtccttcaactacttcttctacaacaagcggctcaagcgaatcgtcttctttagctgccgttccatcagtggctccacctacacaccctcagaggcaggcaacgagctggacatggagctgggggaggaggaggtggaggaagaaagcagaagcaggggcagtggggccgaggagaccagcaccatggaggaggacaggtgtgtgatgggggccatgacccgggtccctgaagcctggagtgggtacaacagggtgggggcctcctctacttggtctaagtggtngctcctgaaggcccactgtgtgccaacctccgcccagggtcccagtgatctgtatttgatgaggaggagccgaggccccagcttcatccagcttcaaccaatgcctggacctgtccacctgagaggcccctggggcctccccagctgctggccagaccctggcgctgccacagtcctggcactgcccaaggccatacctgcctagccctttggctccatcctgtggatgcccactcacccctcagactcctgctgcccatgctgtggccggacttgtcagcagggggcctggtgggaggagcgactgccctgcccaaatgaactgccacagcagggacagctggaccgcagagtttatttttgtatttctactgggcctgcacactccagcccaaagggtctgtggccggaggccccacgagcaggccccagcagtcaccggctctggtcttgggccggccccggtgcccacctgtacccccacctcgcccatttggccgcgtgcactgagtgtcactttgctgcagctcgtttctttccaataaaagtttctgtgacttaaaaaaaaaaaaaacaaaaaaaaaaanaaaaancccgggggccctnnnntgcgggggggggaaaaaagggtgattgcacatgggccatcgggtcaaaagggggttcctcgagcccacagttttctgtccacaacgggggaagacttgcgcggggtccccctatataggaggggcggcgataatttgccagaaagcccgggtaacccggattatgaggn

SEQ ID NO: 591425 - DNA, 411 bp, Homo sapiens
tgttgtgtagaaaggaatagacataccgcaatccttttgttctgtactaagaaaatttcttctgcctcgcgatgatgttaatttataaccttacccccaaccccgtgctcactgaaacatatgctgtgtcaactcagggttatatggattaagggcggtgctagatgtgctttgttaaacagatgcttgaaggcagcatgctcgtttaagagtcattaccactccctaatctcacgtacccagggacacaaacactgcggaaggccgcagggtcctctgcctaggaaaaccagagacctttgttcatatgtttatctgctgaccttctctccgctattgtcctatgaccctgccaaatctccctctcggagaaacacccaagaatgatcaataaatactaacaaaattaaa

SEQ ID NO: 591426 - DNA, 2208 bp, Homo sapiens
  misc_feature (68)..(68): n is a, c, g, or t
  misc_feature (2017)..(2017): n is a, c, g, or t
  misc_feature (2023)..(2023): n is a, c, g, or t
  misc_feature (2036)..(2039): n is a, c, g, or t
  misc_feature (2208)..(2208): n is a, c, g, or t
ggggtcgaagggtcaggggccgaagcaccggccacaacttgaagccggaccggcctcttcgccccagnggctcgcggacgtagatgcatccagcgtgcgactatcccagcgcctaacggcagctggacttcgctcccgggacctccaatgggctaccaccttcgcccgcagaccccagcccccgccacgcccacacgtcgcactaggttggcccgcgcctcactggttacggggtcgacccccctagggggcggagctagagaggccacggccaatgaacgccgggggtaagcgggttagtacgacgagaagagtgacagacaggctccataaccagtagacgtagaaggcagaactgagtggcgggtacggcacccgatggctattcgagctctcgatctcggagactggagcgggccattcagaggcgcggggccgggcccggcggacgcttgttgttgtccggccgggggaggcggaggtcgctcgctcgctcgctcggctcgctgactcgccggagcgctctgtggcggtcggcggcaggtcggtcgcgagagcgggctctgtggaagggggcgaggctatgtcgcggtggcagcccggatgggccggcagggccgggagtaacgggacgtcgccgcggagcttcttcccccggatacagtgcggcccgagcggaggccgcggcgccgccctccgatcttgaagagcccgcgctgcgcggagcccgcccccgcctgcgcaccggcaccgacgcggagcgaccagcccagccagacccggcccggcgcggcctgatctaacccagccaggcaggcaatactagcccctctggagcacggagctccttccccaaagacatgaagctattggagaactcgagctttgaagccatcaactcacagctgactgtggagaccggagatgcccacatcattggcaggattgagagctactcatgtaagatggcaggagacgacaaacacatgttcaagcagttctgccaggagggccagccccacgtgctggaggcactttctccaccccagacttcaggactgagccccagcagactcagcaaaagccaaggcggtgaggaggagggccccctcagtgacaagtgcagccgcaagaccctcttctacctgattgccacgctcaatgagtccttcaggcctgactatgacttcagcacagcccgcagccatgagttcagccgggagcccagccttagctgggtggtgaatgcagtcaactgcagtctgttctcagctgtgcgggaggacttcaaggatctgaaaccacagctgtggaacgcggtggacgaggagatctgcctggctgaatgtgacatctacagctataacccagacttggactcagatcccttcggggaggatggtagcctctggtccttcaactacttcttctacaacaagcggctcaagcgaatcgtcttctttagctgccgttccatcagtggctccacctacacaccctcagaggcagagcttcatccagcttcaaccaatgcctggacctgtccacctgagaggcccctggggcctccccagctgctggccagaccctggcgctgccacagtcctggcactgcccaaggccatacctgcctagccctttggctccatcctgtggatgcccactcacccctcagactcctgctgcccatgctgtggccggacttgtcagcagggggcctggtgggaggagcgactgccctgcccaaatgaactgccacagcagggacagctggaccgcagagtttatttttgtatttctactgggcctgcacactccagcccaaagggtctgtggccggaggccccacgagcaggccccagcagtcaccggctctggtcttgggccggccccggtgcccacctgtacccccacctcgcccatttggccgcgtgcactgagtgtcactttgctgcagctcgtttctttccaataaaagtttctgtgacttaaaaaaaaaaaaaacaaaaaaaaaaanaaaaancccgggggccctnnnntgcgggggggggaaaaaagggtgattgcacatgggccatcgggtcaaaagggggttcctcgagcccacagttttctgtccacaacgggggaagacttgcgcggggtccccctatataggaggggcggcgataatttgccagaaagcccgggtaacccggattatgaggn

SEQ ID NO: 591427 - DNA, 2137 bp, Homo sapiens
  misc_feature (68)..(68): n is a, c, g, or t
  misc_feature (1946)..(1946): n is a, c, g, or t
  misc_feature (1952)..(1952): n is a, c, g, or t
  misc_feature (1965)..(1968): n is a, c, g, or t
  misc_feature (2137)..(2137): n is a, c, g, or t
ggggtcgaagggtcaggggccgaagcaccggccacaacttgaagccggaccggcctcttcgccccagnggctcgcggacgtagatgcatccagcgtgcgactatcccagcgcctaacggcagctggacttcgctcccgggacctccaatgggctaccaccttcgcccgcagaccccagcccccgccacgcccacacgtcgcactaggttggcccgcgcctcactggttacggggtcgacccccctagggggcggagctagagaggccacggccaatgaacgccgggggtaagcgggttagtacgacgagaagagtgacagacaggctccataaccagtagacgtagaaggcagaactgagtggcgggtacggcacccgatggctattcgagctctcgatctcggagactggagcgggccattcagaggcgcggggccgggcccggcggacgcttgttgttgtccggccgggggaggcggaggtcgctcgctcgctcgctcggctcgctgactcgccgcccccgcctgcgcaccggcaccgacgcggagcgaccagcccagccagacccggcccggcgcggcctgatctaacccagccaggcaggcaatactagcccctctggagcacggagctccttccccaaagacatgaagctattggagaactcgagctttgaagccatcaactcacagctgactgtggagaccggagatgcccacatcattggcaggattgagagctactcatgtaagatggcaggagacgacaaacacatgttcaagcagttctgccaggagggccagccccacgtgctggaggcactttctccaccccagacttcaggactgagccccagcagactcagcaaaagccaaggcggtgaggaggagggccccctcagtgacaagtgcagccgcaagaccctcttctacctgattgccacgctcaatgagtccttcaggcctgactatgacttcagcacagcccgcagccatgagttcagccgggagcccagccttagctgggtggtgaatgcagtcaactgcagtctgttctcagctgtgcgggaggacttcaaggatctgaaaccacagctgtggaacgcggtggacgaggagatctgcctggctgaatgtgacatctacagctataacccagacttggactcagatcccttcggggaggatggtagcctctggtccttcaactacttcttctacaacaagcggctcaagcgaatcgtcttctttagctgccgttccatcagtggctccacctacacaccctcagaggcaggcaacgagctggacatggagctgggggaggaggaggtggaggaagaaagcagaagcaggggcagtggggccgaggagaccagcaccatggaggaggacagggtcccagtgatctgtatttgatgaggaggagccgaggccccagcttcatccagcttcaaccaatgcctggacctgtccacctgagaggcccctggggcctccccagctgctggccagaccctggcgctgccacagtcctggcactgcccaaggccatacctgcctagccctttggctccatcctgtggatgcccactcacccctcagactcctgctgcccatgctgtggccggacttgtcagcagggggcctggtgggaggagcgactgccctgcccaaatgaactgccacagcagggacagctggaccgcagagtttatttttgtatttctactgggcctgcacactccagcccaaagggtctgtggccggaggccccacgagcaggccccagcagtcaccggctctggtcttgggccggccccggtgcccacctgtacccccacctcgcccatttggccgcgtgcactgagtgtcactttgctgcagctcgtttctttccaataaaagtttctgtgacttaaaaaaaaaaaaaacaaaaaaaaaaanaaaaancccgggggccctnnnntgcgggggggggaaaaaagggtgattgcacatgggccatcgggtcaaaagggggttcctcgagcccacagttttctgtccacaacgggggaagacttgcgcggggtccccctatataggaggggcggcgataatttgccagaaagcccgggtaacccggattatgaggn

SEQ ID NO: 591428 - DNA, 800 bp, Homo sapiens
ggctcagcatgggggacgctctcagtctcggcgcacggcccagttccttcaaaatgtctagtgtcacgaaatcctgtgcaagctcagctgggagggtgatcagtctacacccccaagtgcatatggggctgtcaaagcttatactaactttgatgctgagcgggatgcttggaacatgaaacggccatcaagacaaaggtgtggatgaggtcaccattgtcagcatttggaccaaccgcagtaatgctcagaggaacaggatatggcctgtcggctaccagagaaggcagcaaaagggaagttgcatcaggtcctgaagtcagccttatctggcacgctggagacgtgatcttgggctatgaaggacacctgctcgagtatgacgcttctgagctaaaggcttcccatgatggggctgtgaaccgatgagcactctctcatcggcatcatctgctccagaaccaaccaggagctgcggaaccttagcacgagtctacaggattgtacaagactgatcctgagacaggacgtccattgcggacacatctggtgacttcggcacagctggtggttgccctgcaaccgggtgaaccagcagaggatggtcctgcagtggttactgacgggatggccaggaggccgggactcatgacgcggagtgccgaggaggcctggtttcccaggtggtcagattctgaccggggggtcccactcaaaagtttgacggaccaatgagcgtaaatggggacccggacagttgggccgcactctgacacggggaaaaaccgttggggggagca

SEQ ID NO: 591429 - DNA, 941 bp, Homo sapiens
  misc_feature (917)..(917): n is a, c, g, or t
ttttgtggtttttttaaaacaacaacataggcattaattctttcaataagcttcttagttcttagtatcaccaagggaatgatgaaaaaacaacaaaaagcgtgagtcttggcaaatctctgacaaacgagcagagatctcaagggcaatgggggcgggggaggcttgacagaagtgccaaggagcagttccaacgtcacatctctcctgggcgggaagggtagagaacgggggcacggtcgagagctgtcctgtggcaacttctgcccacatgagccagtgcgcctggctcggcatggagccaccccgcgggattccctgggtgcctccatagataccgggccacacacccctcagacgtgtgatccaagtgcccggggagcaccgtccagggcctcagggtggacccagaagaccagcctcgtgcaggggcaggggcacaatgtggaggagaggcagaggcaggcagcgtcgattgacgggtgggagaagccaaggaggtggtgacccaagggaacagacgcgagaggaaccacatctggcggtcggcaaggaacagaggaatcgagaaacagtggaaacaaacaaaaaaaaacactagaaaaaccaaagaaagacacaacacgcacacaaaactacacacaacatcaccagggaggacagagccaaggcagaacggacaaggatagcagacaacaagacgcacacggctagcacgaacgaaacgtgcaccaacacagggaacgtaagtgagctcacaggactagccgaacattcgacaaagaagcgcgacacaacatacgatgatgaacaacaccaacccacagtgcagcagaacatcagagaaacgcgcatcagagtcgacacacagacagtcagaagagcaaagagatataaagacagtcaaacagaaggantggagtctgctcgtgctcgccctg

SEQ ID NO: 591430 - DNA, 2226 bp, Homo sapiens
  misc_feature (68)..(68): n is a, c, g, or t
  misc_feature (2035)..(2035): n is a, c, g, or t
  misc_feature (2041)..(2041): n is a, c, g, or t
  misc_feature (2054)..(2057): n is a, c, g, or t
  misc_feature (2226)..(2226): n is a, c, g, or t
ggggtcgaagggtcaggggccgaagcaccggccacaacttgaagccggaccggcctcttcgccccagnggctcgcggacgtagatgcatccagcgtgcgactatcccagcgcctaacggcagctggacttcgctcccgggacctccaatgggctaccaccttcgcccgcagaccccagcccccgccacgcccacacgtcgcactaggttggcccgcgcctcactggttacggggtcgacccccctagggggcggagctagagaggccacggccaatgaacgccgggggtaagcgggttagtacgacgagaagagtgacagacaggctccataaccagtagacgtagaaggcagaactgagtggcgggtacggcacccgatggctattcgagctctcgatctcggagactggagcgggccattcagaggcgcggggccgggcccggcggacgcttgttgttgtccggccgggggaggcggaggtcgctcgctcgctcgctcggctcgctgactcgccggagcgctctgtggcggtcggcggcaggtcggtcgcgagagcgggctctgtggaagggggcgaggctatgtcgcggtggcagcccggatgggccggcagggccgggagtaacgggacgtcgccgcggagcttcttcccccggatacagtgcggcctgatctaacccagccaggcaggcaatactagcccctctggagcacggagctccttccccaaagacatgaagctattggagaactcgagctttgaagccatcaactcacagctgactgtggagaccggagatgcccacatcattggcaggattgagagctactcatgtaagatggcaggagacgacaaacacatgttcaagcagttctgccaggagggccagccccacgtgctggaggcactttctccaccccagacttcaggactgagccccagcagactcagcaaaagccaaggcggtgaggaggagggccccctcagtgacaagtgcagccgcaagaccctcttctacctgattgccacgctcaatgagtccttcaggcctgactatgacttcagcacagcccgcagccatgagttcagccgggagcccagccttagctgggtggtgaatgcagtcaactgcagtctgttctcagctgtgcgggaggacttcaaggatctgaaaccacagctgtggaacgcggtggacgaggagatctgcctggctgaatgtgacatctacagctataacccagacttggactcagatcccttcggggaggatggtagcctctggtccttcaactacttcttctacaacaagcggctcaagcgaatcgtcttctttagctgccgttccatcagtggctccacctacacaccctcagaggcaggcaacgagctggacatggagctgggggaggaggaggtggaggaagaaagcagaagcaggggcagtggggccgaggagaccagcaccatggaggaggacagggtcccagtgatctgtatttgatgaggaggagccgaggccccagcttcatccagcttcaaccaatgcctggacctgtccacctgagaggcccctggggcctccccagctgctggccagaccctggcgctgccacagtcctggcactgcccaaggccatacctgcctagccctttggctccatcctgtggatgcccactcacccctcagactcctgctgcccatgctgtggccggacttgtcagcagggggcctggtgggaggagcgactgccctgcccaaatgaactgccacagcagggacagctggaccgcagagtttatttttgtatttctactgggcctgcacactccagcccaaagggtctgtggccggaggccccacgagcaggccccagcagtcaccggctctggtcttgggccggccccggtgcccacctgtacccccacctcgcccatttggccgcgtgcactgagtgtcactttgctgcagctcgtttctttccaataaaagtttctgtgacttaaaaaaaaaaaaaacaaaaaaaaaaanaaaaancccgggggccctnnnntgcgggggggggaaaaaagggtgattgcacatgggccatcgggtcaaaagggggttcctcgagcccacagttttctgtccacaacgggggaagacttgcgcggggtccccctatataggaggggcggcgataatttgccagaaagcccgggtaacccggattatgaggn

SEQ ID NO: 591431 - DNA, 2450 bp, Homo sapiens
  misc_feature (68)..(68): n is a, c, g, or t
  misc_feature (1239)..(1239): n is a, c, g, or t
  misc_feature (2259)..(2259): n is a, c, g, or t
  misc_feature (2265)..(2265): n is a, c, g, or t
  misc_feature (2278)..(2281): n is a, c, g, or t
  misc_feature (2450)..(2450): n is a, c, g, or t
ggggtcgaagggtcaggggccgaagcaccggccacaacttgaagccggaccggcctcttcgccccagnggctcgcggacgtagatgcatccagcgtgcgactatcccagcgcctaacggcagctggacttcgctcccgggacctccaatgggctaccaccttcgcccgcagaccccagcccccgccacgcccacacgtcgcactaggttggcccgcgcctcactggttacggggtcgacccccctagggggcggagctagagaggccacggccaatgaacgccgggggtaagcgggttagtacgacgagaagagtgacagacaggctccataaccagtagacgtagaaggcagaactgagtggcgggtacggcacccgatggctattcgagctctcgatctcggagactggagcgggccattcagaggcgcggggccgggcccggcggacgcttgttgttgtccggccgggggaggcggaggtcgctcgctcgctcgctcggctcgctgactcgccggagcgctctgtggcggtcggcggcaggtcggtcgcgagagcgggctctgtggaagggggcgaggctatgtcgcggtggcagcccggatgggccggcagggccgggagtaacgggacgtcgccgcggagcttcttcccccggatacagtgcggcccgagcggaggccgcggcgccgccctccgatcttgaagagcccgcgctgcgcggagcccgcccccgcctgcgcaccggcaccgacgcggagcgaccagcccagccagacccggcccggcgcggcctgatctaacccagccaggcaggcaatactagcccctctggagcacggagctccttccccaaagacatgaagctattggagaactcgagctttgaagccatcaactcacagctgactgtggagaccggagatgcccacatcattggcaggattgagagctactcatgtaagatggcaggagacgacaaacacatgttcaagcagttctgccaggagggccagccccacgtgctggaggcactttctccaccccagacttcaggactgagccccagcagactcagcaaaagccaaggcggtgaggaggagggccccctcagtgacaagtgcagccgcaagaccctcttctacctgattgccacgctcaatgagtccttcaggcctgactatgacttcagcacagcccgcagccatgagttcagccgggagcccagccttagctggntgagggtcaggtggagggaagggacccacagccaccccactgtccttccccactttgggtagccctggctcctgtcaccctgactgtgacctgccctaggtggtgaatgcagtcaactgcagtctgttctcagctgtgcgggaggacttcaaggatctgaaaccacagctgtggaacgcggtggacgaggagatctgcctggctgaatgtgacatctacagctataacccagacttggactcagatcccttcggggaggatggtagcctctggtccttcaactacttcttctacaacaagcggctcaagcgaatcgtcttctttagctgccgttccatcagtggctccacctacacaccctcagaggcaggcaacgagctggacatggagctgggggaggaggaggtggaggaagaaagcagaagcaggggcagtggggccgaggagaccagcaccatggaggaggacagggtcccagtgatctgtatttgatgaggaggagccgaggccccagcttcatccagcttcaaccaatgcctggacctgtccacctgagaggcccctggggcctccccagctgctggccagaccctggcgctgccacagtcctggcactgcccaaggccatacctgcctagccctttggctccatcctgtggatgcccactcacccctcagactcctgctgcccatgctgtggccggacttgtcagcagggggcctggtgggaggagcgactgccctgcccaaatgaactgccacagcagggacagctggaccgcagagtttatttttgtatttctactgggcctgcacactccagcccaaagggtctgtggccggaggccccacgagcaggccccagcagtcaccggctctggtcttgggccggccccggtgcccacctgtacccccacctcgcccatttggccgcgtgcactgagtgtcactttgctgcagctcgtttctttccaataaaagtttctgtgacttaaaaaaaaaaaaaacaaaaaaaaaaanaaaaancccgggggccctnnnntgcgggggggggaaaaaagggtgattgcacatgggccatcgggtcaaaagggggttcctcgagcccacagttttctgtccacaacgggggaagacttgcgcggggtccccctatataggaggggcggcgataatttgccagaaagcccgggtaacccggattatgaggn

SEQ ID NO: 591432 - DNA, 1660 bp, Homo sapiens
  misc_feature (32)..(32): n is a, c, g, or t
  misc_feature (48)..(48): n is a, c, g, or t
  misc_feature (127)..(127): n is a, c, g, or t
  misc_feature (1469)..(1469): n is a, c, g, or t
  misc_feature (1475)..(1475): n is a, c, g, or t
  misc_feature (1488)..(1491): n is a, c, g, or t
  misc_feature (1660)..(1660): n is a, c, g, or t
ggtcagtagccgccctcctaggcgtctggagnaaactaggcaattttnccgggtagagtggaggaacctgtagttttcctctccccgggccagaaagtagccaaaacgaaagagcgcccgcccaggncaatactagcccctctggagcacggagctccttccccaaagacatgaagctattggagaactcgagctttgaagccatcaactcacagctgactgtggagaccggagatgcccacatcattggcaggattgagagctactcatgtaagatggcaggagacgacaaacacatgttcaagcagttctgccaggagggccagccccacgtgctggaggcactttctccaccccagacttcaggactgagccccagcagactcagcaaaagccaaggcggtgaggaggagggccccctcagtgacaagtgcagccgcaagaccctcttctacctgattgccacgctcaatgagtccttcaggcctgactatgacttcagcacagcccgcagccatgagttcagccgggagcccagccttagctgggtggtgaatgcagtcaactgcagtctgttctcagctgtgcgggaggacttcaaggatctgaaaccacagctgtggaacgcggtggacgaggagatctgcctggctgaatgtgacatctacagctataacccagacttggactcagatcccttcggggaggatggtagcctctggtccttcaactacttcttctacaacaagcggctcaagcgaatcgtcttctttagctgccgttccatcagtggctccacctacacaccctcagaggcaggcaacgagctggacatggagctgggggaggaggaggtggaggaagaaagcagaagcaggggcagtggggccgaggagaccagcaccatggaggaggacagggtcccagtgatctgtatttgatgaggaggagccgaggccccagcttcatccagcttcaaccaatgcctggacctgtccacctgagaggcccctggggcctccccagctgctggccagaccctggcgctgccacagtcctggcactgcccaaggccatacctgcctagccctttggctccatcctgtggatgcccactcacccctcagactcctgctgcccatgctgtggccggacttgtcagcagggggcctggtgggaggagcgactgccctgcccaaatgaactgccacagcagggacagctggaccgcagagtttatttttgtatttctactgggcctgcacactccagcccaaagggtctgtggccggaggccccacgagcaggccccagcagtcaccggctctggtcttgggccggccccggtgcccacctgtacccccacctcgcccatttggccgcgtgcactgagtgtcactttgctgcagctcgtttctttccaataaaagtttctgtgacttaaaaaaaaaaaaaacaaaaaaaaaaanaaaaancccgggggccctnnnntgcgggggggggaaaaaagggtgattgcacatgggccatcgggtcaaaagggggttcctcgagcccacagttttctgtccacaacgggggaagacttgcgcggggtccccctatataggaggggcggcgataatttgccagaaagcccgggtaacccggattatgaggn

SEQ ID NO: 591433 - DNA, 1549 bp, Homo sapiens
  misc_feature (1358)..(1358): n is a, c, g, or t
  misc_feature (1364)..(1364): n is a, c, g, or t
  misc_feature (1377)..(1380): n is a, c, g, or t
  misc_feature (1549)..(1549): n is a, c, g, or t
aggaggaggtggaggaagaaagcagaagcaggggcagtggggccgaggagaccagcaccatgaagctattggagaactcgagctttgaagccatcaactcacagctgactgtggagaccggagatgcccacatcattggcaggattgagagctactcatgtaagatggcaggagacgacaaacacatgttcaagcagttctgccaggagggccagccccacgtgctggaggcactttctccaccccagacttcaggactgagccccagcagactcagcaaaagccaaggcggtgaggaggagggccccctcagtgacaagtgcagccgcaagaccctcttctacctgattgccacgctcaatgagtccttcaggcctgactatgacttcagcacagcccgcagccatgagttcagccgggagcccagccttagctgggtggtgaatgcagtcaactgcagtctgttctcagctgtgcgggaggacttcaaggatctgaaaccacagctgtggaacgcggtggacgaggagatctgcctggctgaatgtgacatctacagctataacccagacttggactcagatcccttcggggaggatggtagcctctggtccttcaactacttcttctacaacaagcggctcaagcgaatcgtcttctttagctgccgttccatcagtggctccacctacacaccctcagaggcaggcaacgagctggacatggagctgggggaggaggaggtggaggaagaaagcagaagcaggggcagtggggccgaggagaccagcaccatggaggaggacagggtcccagtgatctgtatttgatgaggaggagccgaggccccagcttcatccagcttcaaccaatgcctggacctgtccacctgagaggcccctggggcctccccagctgctggccagaccctggcgctgccacagtcctggcactgcccaaggccatacctgcctagccctttggctccatcctgtggatgcccactcacccctcagactcctgctgcccatgctgtggccggacttgtcagcagggggcctggtgggaggagcgactgccctgcccaaatgaactgccacagcagggacagctggaccgcagagtttatttttgtatttctactgggcctgcacactccagcccaaagggtctgtggccggaggccccacgagcaggccccagcagtcaccggctctggtcttgggccggccccggtgcccacctgtacccccacctcgcccatttggccgcgtgcactgagtgtcactttgctgcagctcgtttctttccaataaaagtttctgtgacttaaaaaaaaaaaaaacaaaaaaaaaaanaaaaancccgggggccctnnnntgcgggggggggaaaaaagggtgattgcacatgggccatcgggtcaaaagggggttcctcgagcccacagttttctgtccacaacgggggaagacttgcgcggggtccccctatataggaggggcggcgataatttgccagaaagcccgggtaacccggattatgaggn

SEQ ID NO: 591434 - DNA, 663 bp, Homo sapiens
caacctcaacaccaccttcttcgaccgccgtgcggaggaggagacccgcagttctataccaacgacctattctgattttgcggtcaccctgaagtttatattcttatcctaccaggcttcggagataatcgtcccatatgtaacttactgactccggtaataaaggagaaccattgggatacgtaggtgatggtctagagcgtatgatatcaataggcttcctagggtttagtcgggtgagcacaccagtatatttacgagtaggaatagacgtagacgcacgagcatatgtcgcactccgttaccgataatcatcgttatccctcatccggcgtctaagtattatatgcttgactcgcactaaactccgacggaagcaatatgaaatgatctgcgtgcagtgctctgagcacctaggattcatcttacttggcaccgtaggtggcctgactggcattggattagcaaactcatcactagacatcgaagtacacgaacacgtactacggtgtagcgtcactttccactatgtcctatcgaatgatggagctgtgatgtagccatcataggaggcgttcattcactgattttcccctattctctaggctacatcctagagcaaagctagccaaaatgccatttcactatcatatgcatcggcag

SEQ ID NO: 591435 - DNA, 2293 bp, Homo sapiens
  misc_feature (68)..(68): n is a, c, g, or t
  misc_feature (2102)..(2102): n is a, c, g, or t
  misc_feature (2108)..(2108): n is a, c, g, or t
  misc_feature (2121)..(2124): n is a, c, g, or t
  misc_feature (2293)..(2293): n is a, c, g, or t
ggggtcgaagggtcaggggccgaagcaccggccacaacttgaagccggaccggcctcttcgccccagnggctcgcggacgtagatgcatccagcgtgcgactatcccagcgcctaacggcagctggacttcgctcccgggacctccaatgggctaccaccttcgcccgcagaccccagcccccgccacgcccacacgtcgcactaggttggcccgcgcctcactggttacggggtcgacccccctagggggcggagctagagaggccacggccaatgaacgccgggggtaagcgggttagtacgacgagaagagtgacagacaggctccataaccagtagacgtagaaggcagaactgagtggcgggtacggcacccgatggctattcgagctctcgatctcggagactggagcgggccattcagaggcgcggggccgggcccggcggacgcttgttgttgtccggccgggggaggcggaggtcgctcgctcgctcgctcggctcgctgactcgccggagcgctctgtggcggtcggcggcaggtcggtcgcgagagcgggctctgtggaagggggcgaggctatgtcgcggtggcagcccggatgggccggcagggccgggagtaacgggacgtcgccgcggagcttcttcccccggatacagtgcggcccgagcggaggccgcggcgccgccctccgatcttgaagagcccgcgctgcgcggagcccgcccccgcctgcgcaccggcaccgacgcggagcgaccagcccagccagacccggcccggcgcggcctgatctaacccagccaggcaggcaatactagcccctctggagcacggagctccttccccaaagacatgaagctattggagaactcgagctttgaagccatcaactcacagctgactgtggagaccggagatgcccacatcattggcaggattgagagctactcatgtaagatggcaggagacgacaaacacatgttcaagcagttctgccaggagggccagccccacgtgctggaggcactttctccaccccagacttcaggactgagccccagcagactcagcaaaagccaaggcggtgaggaggagggccccctcagtgacaagtgcagccgcaagaccctcttctacctgattgccacgctcaatgagtccttcaggcctgactatgacttcagcacagcccgcagccatgagttcagccgggagcccagccttagctgggtggtgaatgcagtcaactgcagtctgttctcagctgtgcgggaggacttcaaggatctgaaaccacagctgtggaacgcggtggacgaggagatctgcctggctgaatgtgacatctacagctataacccagacttggactcagatcccttcggggaggatggtagcctctggtccttcaactacttcttctacaacaagcggctcaagcgaatcgtcttctttagctgccgttccatcagtggctccacctacacaccctcagaggcaggcaacgagctggacatggagctgggggaggaggaggtggaggaagaaagcagaagcaggggcagtggggccgaggagaccagcaccatggaggaggacagggtcccagtgatctgtatttgatgaggaggagccgaggccccagcttcatccagcttcaaccaatgcctggacctgtccacctgagaggcccctggggcctccccagctgctggccagaccctggcgctgccacagtcctggcactgcccaaggccatacctgcctagccctttggctccatcctgtggatgcccactcacccctcagactcctgctgcccaaatgaactgccacagcagggacagctggaccgcagagtttatttttgtatttctactgggcctgcacactccagcccaaagggtctgtggccggaggccccacgagcaggccccagcagtcaccggctctggtcttgggccggccccggtgcccacctgtacccccacctcgcccatttggccgcgtgcactgagtgtcactttgctgcagctcgtttctttccaataaaagtttctgtgacttaaaaaaaaaaaaaacaaaaaaaaaaanaaaaancccgggggccctnnnntgcgggggggggaaaaaagggtgattgcacatgggccatcgggtcaaaagggggttcctcgagcccacagttttctgtccacaacgggggaagacttgcgcggggtccccctatataggaggggcggcgataatttgccagaaagcccgggtaacccggattatgaggn

SEQ ID NO: 591436 - DNA, 518 bp, Homo sapiens
tccttccgaatggtatacgggctgggctgtgttgagttaggctggtggcctgtggcatacggtggtcccctgggtgtgcatactgacctggatatgtgagaggctgatcatcatcatttggattaacatttgcatgctttatgaacatcccggaggtggaggattttctccatggggatactattgttgagtatgaactcttgtgctctgttgttggccaacccctgatccaggcctgtccttgaagatctgatgtttctcgtactgtactttgtatagtgattcatgtcttgctataggtgtctccttgtgctctacgttgtctgtcacgaagctgcatgatatttggctggttggtgttgtcaggaagaaaagccaagagaactcctacagtactagtgtccatggcttgagtgagttgcacagcttttcgcaggatgacaactttctcaatcagatcctgaagtgacaaagggtggcttccatcttgagctttagtccaacatgcaactaatttc

SEQ ID NO: 591437 - DNA, 191 bp, Homo sapiens
ggggggggccccccccctttttgggggttttccccccccaaaggggggggggaaaaggggggggttcccttttttgtaaaaaggtccctttgggggggggaaagcaaatttttgggtttccccccaaaattttttccccccccgggggggtttttttggaaaaaaaaaaaaaaaagtttttttttggggga

SEQ ID NO: 591438 - DNA, 117 bp, Homo sapiens
  misc_feature (79)..(79): n is a, c, g, or t
tatctaagatcaatttattggaggttgtgagagctatttctgtcttgacaggagattgagtaatagaacgactgatatncgtctgactcagatagtagacttaatgtcgatgagaga

SEQ ID NO: 591439 - DNA, 196 bp, Homo sapiens
cagatccaaaacatgcagaacagagtgagccaagggccacacccgaaatcccagggtgatgacatcccagagggaggcgcatcgctgggcatgcaaagccaggttcaacaccccagtcgcagaccctcagctcctcctgcccacctctaataaacaaagcagacactcagaagcaaactctatatggctacacgag

SEQ ID NO: 591440 - DNA, 460 bp, Homo sapiens
caggcacagacgatttggacagatcatagcactataatcacaggcgtcctggcaaaagcttagaatgcttccctgtgctactttaggtctttgatgatggtgatgtacagatgggtgttcatgtgtagatgtcctttctggttgttagtatgccttctaacagacaggatcctcagctgtaggtctgtgggaataccctgccgtgtgaggtgtcagtgtggccctgtctgcggggtgcctcccagttaagctgcttgagggtcaggggtcaggtacccacttgaggaggcaggctgcccgtcctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgt

SEQ ID NO: 591441 - DNA, 907 bp, Homo sapiens
ctcatgggccccattccaggacatttctgagtacatcattgcatgtcatccgctgtaggacactgatgaagaacccttacaggtcagggttcctggagcttctaccagtggcactctgacaggcctcaccaaaggtgccactctagaacagtcatagtggaggcactagaaagatcaagcgagcaggcgataaggttcggggaagaggttgtttcctgtgggcaacatcgtgtcgaacgaaggtttgaattgaatctacgggatgactcgtgctttgaccctatacaagtttggcccgattatggaccgggtggaagatgagtgggaactgaatgtctgaatctgggcgtttaaacttggttgtgcctagggcttatggttttggaagtggtcgatttcatgatgtgagtgtcgatctaaatggtggtcgattgacaatggtggtgagagctaccaacgatgtggagagaagtgggaccgtcgggggagaaaatggctggatgatgatctggaaatgtcttgggaacggcaaagggtgaattcaagttgtgaccctcagtgaggcaagcgtgtgacgattgatgggatagaggataccaggtagcgagaaaggagtgtcctcgaaggcatatcttgcggtggcatattgcttcctgaggatgcttgggatggcagcggggctggtgcctgtgacaacttggcggttgaactgtgtggtgaaacccacgtcccggaggcactaatggccagttcttaccaaagcagtattctccgagataccactctagagccaaccgtcaacgtttgattggccatggcagttgtcttgcctttgatcttaaaggctgcggaaaaatccgagaacacttttcaaccaaggaacagcgtgtcttcaaaaactgttatg

SEQ ID NO: 591442 - DNA, 269 bp, Homo sapiens
  misc_feature (78)..(78): n is a, c, g, or t
taggtaaagcaaaattccagtcaaagggggtcgctctcccctccctgggggcgggggcccggccctgtgttaatgttnccatgtttttaaaagcccaaaaaaaaaaaccccccaaagtttttttaaaggggggggaaaaccccccagccctttaattcccatggccccggggaactggcggggcccaaaagttttcctttcccccccccgccaaacccggaattttgtattttgttttgtaaaaatttaataaaagtccaaaaccttta

SEQ ID NO: 591443 - DNA, 370 bp, Homo sapiens
ataatttcacggacatttggaaataacattggggattatacagacaagaataaactcacttcaagctggtctgttttaataaattttcaacgaaattgtctatttttttccctcccatctgcaacagaatacatttttttcagtctttatctaaatgaggtaaagggaatcattcttatggagctcttggagagtttcaggcctgtgcatgtgtgtacagcatgaggtaatatgctataatgtctgctgtaataatttgttaaggatatgctatggatcattttagcttagggtcagactttttctttttccaaaaatttgtgttacgtttttaccttctaacaattgacactttatcttattttaagga

SEQ ID NO: 591444 - DNA, 449 bp, Homo sapiens
gccaaccacaccagcatctcctcgctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtgatttccctccccactactccttctccttctatgatggtaacagacgagcctagtaccatgtcgctgctgccctggtgacgccagtcttccactatcagtggcacagtcccttccttggttcttctgcagcccgtgagatggtcatgcttcctccggtgtcatgccctatcttttaatatgcttgctcagctccaataaagtaatatagttcggcagtcagtataaaaa

SEQ ID NO: 591445 - DNA, 127 bp, Homo sapiens
  misc_feature (8)..(8): n is a, c, g, or t
  misc_feature (10)..(10): n is a, c, g, or t
  misc_feature (17)..(18): n is a, c, g, or t
  misc_feature (28)..(28): n is a, c, g, or t
  misc_feature (30)..(30): n is a, c, g, or t
  misc_feature (50)..(50): n is a, c, g, or t
  misc_feature (59)..(59): n is a, c, g, or t
  misc_feature (74)..(74): n is a, c, g, or t
agggtggntntaagttnncctaccttgnanttttttttaaatatatttgntgacataanttttgtgtagtttanttatcttgtacatatgtattttgaaatcttttaaacctgaaaaataaatagtc

SEQ ID NO: 591446 - DNA, 356 bp, Homo sapiens
cccatccacatcttttgttgtgaagtgatattatactagagtactagtatgcattcgtacaaatgcttatgaaggtagcactggcatattagtctatatctcatcacctaatttaaaaacccagcacttgataatataactgacagaaatgattgtacccactgatgaagtaaatgcaaatgcagacaaaggaaaatattccttccttcaatggcgtcagtttattttttacttaagtggcatctatgtaagttagacaaactatatattaaaattggtaaactttgaatgtttctcctgttttgattcttagattatgaggaggatcagacagaataagactccacacttttgaa

SEQ ID NO: 591447 - DNA, 336 bp, Homo sapiens
gggagaaagtggtggtggggattgtggtatggaagatgtttaagggaatgggaataggaaggaagatgattaaggagggtgaggaggatgaagatgtgaatgaagtagggaaagtattgaagattgatgaagagtgaagggggagagtggaattgggaaagggagtggagggggtgagaggaggtggaatgggtaaaggaggatttttttattgaggagagtttgtgtgtgtatgagtgtgaatgatgaagtggtttgtgaatattttgaagtatgtaggtaaattgttaatgttgagatagtgaaataaattgtgattgttgtaaaaaaaaaaaa

SEQ ID NO: 591448 - DNA, 406 bp, Homo sapiens
gcttggtgatctctacaggatccccatcatgggtctggaaagaacataaggcggttatagaggtgctggggctaaaagcaaagcctaggggttagatggacatgcgaggcctggattgtttctggggcatccaggtaaaggagttgcaagcagaaagaggaccctgtgattctgcacacagcagtgccccatcttggagatgccatgagcacagacagaaggtttactaggtgggcggcacagtgacttctccccagcactccacccgtttgtcagtagtgtacacgtggaggggtcaccaagatataacggcacaggcaattaagacacagtttcaaggacggcaaccagccctgcagctcatgggaaggaaagaatccttcaggtcatgattccccaccatttg

SEQ ID NO: 591449 - DNA, 867 bp, Homo sapiens
gactacgtgccgcttcttttgcgtagccagtcgacgtgcacatcgctcaaagcaccatggggaaggtgacggtccgcagtctaccggatttggctcgtattgggtgcctggatcagcaggactaagcttttaagtactggtgaagtggatattgtagacatcaatgaccctttcattgacctcaatatctggtaacatgtccaatatgcattccatgccattggcaagattaccatggtcacgcgtactagaggcatgcagaacgggcaagcgttgtcatcgactcggaaatcccatcaccatcgtaccgaggagcgagatccctctcaaaatcaagtggggcgatgctggcgctgagtacgtcgtggagtccacatggcgtcttcacgcaccatggaataaggctggggctcatttgcaggggggaagccaaaagggtcatcatctctgccccctctgctgatgcccccactgtgcgtcatgggtgtgacaccatgacgaagtatgacaacagacctcaagatcatcacgcaataggctccgtgcacgaccaactgcttagacccctggcaaggtcatccatgacaactttggtatccgttggaaggactcatgaccacagtccatgccatcacttgcagccagaagactgtggattggcccctcccggggaaacctgtgggttgatggccggggggctctcccagaaacattattccctgcctctacatgggggccttgccaaggctgtttggcccaagggcatccctgaagcttgaaccgggaacatacctggagaagaggcattccgcgtccccactgcccaccgagtctctgggtgggacccacccctccgtgttttaaaac

SEQ ID NO: 591450 - DNA, 560 bp, Homo sapiens
gcccagaatcccgatttctaagaagtccccaaaaccccgtctccgttaatgtcacatcccctgccagatgtcagcccccgtataatgggcaaaagagctggggacattactcagttttgaaaaataggttgcagaaccctatttctaaatgagtatctatgtaataaatgcctatatacatggcaaaattggctctcactctgatcacagtgttgtaggggagcagctaacgattcctcaaagttcctcatggaggtttctgccataaagagcgtaagagccgggtgcggtggctcacgccggtaatcccagctctttgggaggctgagacaggcggatcacgaggtcaggagatcgagaccatcctggccaacacagtgaaaccccgtctctactaaaaatgcaaagaattacccgggcgtggtggcgggcacctgtagtcccagctacttgggaggctgaggcaggagaatggcgtgaacccggtaggcgaagcttgcagtgacccgagatcgtgccgctgcactctagcctgggcgacagagcgagactccgtctca

SEQ ID NO: 591451 - DNA, 132 bp, Homo sapiens
gtcacatgcatctacagagacagagaagaatagcggagtacgtggtggcgtgactatgcatgtagctgggactgctgtccacagagaacaggaggatccactagttacacagctgccaaaggtgtgggtcga

SEQ ID NO: 591452 - DNA, 683 bp, Homo sapiens
tccctctactatttgtttaaccaaatcaacaacaacctatttagctgttccccaagccttttcctccgacccccataatcaatcctccctcctaatactaagctaccgtgactcctacccctcatcagatcatggcaagccaaggccacttatccagtgaagcattatcaggaaagaaaacgtctacctctctatactagtctccctacaaatctccttgattataacattcatagtcacagaactaatcatatttgatatcctcttcgaaacacacttatccccaccttggtatcatcacccgatgaggcaaccaggtcagaagcccgaacgcaggcacatacttcctattctacacggcctagtaggctcgcttcccctactcatcgtcactaatttacactcacaagaagcctaggcgtcacgttaaacattctactactcactctcactgcccaagaactatcaaacatcctgagccaacaacttaatatgactagcttacgcaatagcttttatagtgaaagatacctctttaggagactccacttatgagatccctaaagaccatgtgaagccccatcgtgggtcaatagtaattgccgagactcttgaaataggggtatggtataatacgctcaactcattttaaccctgacaaaaagatagctaaccctgcttga

SEQ ID NO: 591453 - DNA, 261 bp, Homo sapiens
tgtctctacaggatcccccatcactcgatcgcggagaagatgtggttaggggattcgggctggggcttgtgtgccctctgtatctgcgctctttcacgttcgctgctttgtgtgttctacattgccgggccctgtcttcgcggccagcatttctactccgtggagagcatggcatattgcgagggctgctacctggccaccctggagaaatgtgccacgtgctcccagcccatcctgtaccggatcctgcgggctatgggg

SEQ ID NO: 591454 - DNA, 331 bp, Homo sapiens
ttatgtgtgcatgtatgcatatagatccatgaagcaggcgtaacacagtacaatcctttggttgatgcgtgtgatacttgcctctctattctatttatatagccaatggtgactaaattgattttacagctcactaacagatcttgacctacagtttgaaacacagagtactgaagagtctggtaacctattatttagaacagtgcaaggaatagtatcatgggtagagttgtgcgttgtacactacctttgatagtcatatcgttaaaccaaaaacaatttctgtagtgacattgaaacacataaagacttgatatatcctgacagcata

SEQ ID NO: 591455 - DNA, 140 bp, Homo sapiens
atccgggagtgttgagagagagtgcgcgcgcagagagagagatcagagaacgggcatgccagctgcccgggggcttcacttgcagtcatcacctgtacaactcttcatattgacctggccatctccatcgatgtcagcct

SEQ ID NO: 591456 - DNA, 83 bp, Homo sapiens
cctttttctttggggggacctttttaagaaaccaaaagggcccgggggattttttcttggaaaaaaagtttgaaggtttttta

SEQ ID NO: 591457 - DNA, 607 bp, Homo sapiens
  misc_feature (355)..(355): n is a, c, g, or t
  misc_feature (362)..(362): n is a, c, g, or t
caccctatttaatacccgaataatgattattgcacatatgtcccatgtatatgtagccagtctccaggacgtgacttggagctcactataatcatgtagagtcattgatatcaagtcagaaaaattgctatggatttagaaacagaatagtcttatttacatattccctcgacttatcacaaaatagtttaaagttgtttctaacaattgtgcgtacaacacaatattataaacacatgagtagccaggagcagtgaaagtgaggcgccagtcctgcgacagagattaagcagatgaaggggctgggatggtggtggcaggaggcttaaggaacagaatccccaagtgatgtctntcatagnccattgccacggcaggccatgcaggctcttttcaactcactcttagcggtcttatacttcttgggtcagctggtatttaaagactcaccttggacttcattctcacctgactgtgcactttttttggctatacatagggagatggactatataggtagagaaatatatttcttacaattggaactacttccttggctgggtggatatagccatgcttgtgtgtctattcccggtgtgtgcgggtg

SEQ ID NO: 591458 - DNA, 693 bp, Homo sapiens
  misc_feature (693)..(693): n is a, c, g, or t
ttgcggtcgcggtccggactttcggcggagggtccggccccaggacagttttaccgcattccgtccactcccgattccttcatggatccggcgtctgcactttacagaggtccaatcacgctgacccagaaccctatggtgaccgggaccttagtcctcggagttcagttccagggcggagtggtgattgcctcagacatgctgggatcctacggctccttggctcgtttgcggaccatctctcgcattatgcgagttaacatcagtaccatgctgggtgcctctggcaaatactctgatgctcagtatcagaagcatgtgatcggacagaaggtgattgatgacgagcttctgcgtgatggacacagctatagacctagagctcttcattcctggatgaccatggccatgtatagccgacgctctaagatcaaccctatgcggaacaccatggtcatcagacgctatgctgatcgacagagctctcttggccatgtagacatgcatggcgacatctatgaagccccttccttggacactggttatggtgcatacttgggtcagcctctgctgcgagaagttctggagaagcatccagtgctgagccagacctaagtccgccacttagtagaacgctgcatgcgaatgctgcactaccgacgcgcggtcttacgaccagttttccgacctgtn

SEQ ID NO: 591459 - DNA, 542 bp, Homo sapiens
acccaaaagtcttggaacatttgtccatacctccctcattgtttgaatagggtacatatattaatgattcctgataactaggaaaagttatttttatcaggggtaagaggaggggtagaaaatttactttctagtatatcacttttgggatctatggctgttaaaaattgttttcattgttatttattccattttattttattgaggctatttggaagttactagaaattatggcataattccagcactttgggaggccaaggcaagaggattgcttgagcccaagagtttgagaccagcctggacaacagagtgagaccctgtctctacaaaagaattttgtaaattagcctggcttggtggcacatgcctgtagtcccacctgcttgggaggctgaagtgggaagattgcttgagcctgggaagtcaaggctgcagtgagttgttgagccatgattgcaccattgccctgcagcctaggcaacattgtgaaacctatcaaaagaaagaaaagaaaaaagaaaagggaaaaagaaagaaag

SEQ ID NO: 591460 - DNA, 788 bp, Homo sapiens
  misc_feature (191)..(191): n is a, c, g, or t
  misc_feature (193)..(193): n is a, c, g, or t
  misc_feature (698)..(698): n is a, c, g, or t
  misc_feature (704)..(704): n is a, c, g, or t
gtttacttgtcgcgttgagctgtatccgctatagctcaaattcagtcaatttctacttataatcttagctgatagatgctgttcagatatgggttccatggatatatgtgattacgactgtcctacttcgatgaggtggagtacttttgcatagtgagtggatacgctatcttgatttatttgagaagagntnatgcatatttaaaatgttgtttgcttccagaattagctctttgtttgacatatacttcttatcaatgtacttgcttagcatcatgttagtaactctctgtattcgtattagagatgtggccggtttgtggcatctgagttgggagtgatcaatttaagagccttcgcttagtaattgtgctgggaaggatttctgtatatgaagaatggcgcaactgtccctatcatgctaatagattaaattactctgctttcacgcctgtattgatagggaagtttgatttggggctatgacattgcctaaaagacggcaacatgttgcgcgaaacggactgacttaatattgttatatgcatggaggtattttataacaggtaggggtttcgataaatcttcgaataattattgggttgagattggttaccgacatcatccccgtgaataggtgagtattattctccgatattaaagtgtcttgtcccgatagggtctaagcaaattaaggnaccccnggggtctcataactgctgagaaccacggtttttttggggtatatacactgggaacacatttctattgttgtttcagggcgtttc

SEQ ID NO: 591461 - DNA, 846 bp, Homo sapiens
cacacgcctctgggctgttgtgcgcgtgtgtcttttgcgccgacacggttaaggaccgcgcgcctccaagttccccgtaatatgcccattccgctggaagatgatgagttctcgcctggataatgtcgctaagcttcgggttagggtgtcccgccccattttcgcggggactggcccaagtgtgaggttgccgccatgttggcaactgtttgcaaaaccagaatatggggcacctgcactcccttttatgacgccttgttttatgccagccccacccggtggtaggctcgtccgcgcccccagatggggcagccccggcctgaccaggagatcctcccggcccgtagtctctcaagggagccgagaggcctccaccaaggtagcgagaaagtggaagaccccaccacagctagaaaaagagatttgtacaaaaaagagtttcacccagggggatctctttcgttaagttcaataaagcgtgagtgactgggtaactcaagcaaagtattgtggtgaaatagccccccctgacccctggtaccaccagtagcacccttcaaccctctgacatgataacgcttacaccaataccaatcaacacacaccctttccactaagattgtaatttcattctcaatccatgatcaaatatgagagttattcccgcatatcgcaactctcgcttcacaccaatccaaaaaagaattcaggcccgatcacgcgtggctgcccgccctgttcaccctacgccttcgggagcgctcgaaatcggaggatccccctgaacacccagagttcccctgaaacccaaacccgcccgggccaccccataaaacccggctttcc

SEQ ID NO: 591462 - DNA, 323 bp, Homo sapiens
  misc_feature (19)..(19): n is a, c, g, or t
  misc_feature (122)..(122): n is a, c, g, or t
  misc_feature (125)..(125): n is a, c, g, or t
  misc_feature (201)..(201): n is a, c, g, or t
  misc_feature (274)..(274): n is a, c, g, or t
cagctctgcaggggcccgngagggtcctggcaactcctagctgcaggatctcaagagacattatcagctcctcctgtgaccggaggggaccgtggtgtttcaacaaaaaggaaacccctgcnganggctttttttacttcagctgtgaaacacggtccaggagcctaccagaggacttggtttcccttttccttccttgcncctggagacagtccgtccagaacaggggccctggggtggcccaggggcggttgacctgccacagctggagcanaagtcgcttccaggttcagggcttctcctctgtcctgactcccaccatt

SEQ ID NO: 591463 - DNA, 130 bp, Homo sapiens
  misc_feature (11)..(11): n is a, c, g, or t
  misc_feature (19)..(19): n is a, c, g, or t
  misc_feature (21)..(21): n is a, c, g, or t
  misc_feature (37)..(37): n is a, c, g, or t
  misc_feature (39)..(39): n is a, c, g, or t
  misc_feature (44)..(44): n is a, c, g, or t
  misc_feature (48)..(48): n is a, c, g, or t
  misc_feature (61)..(61): n is a, c, g, or t
  misc_feature (79)..(80): n is a, c, g, or t
  misc_feature (83)..(83): n is a, c, g, or t
  misc_feature (90)..(91): n is a, c, g, or t
  misc_feature (96)..(96): n is a, c, g, or t
  misc_feature (113)..(113): n is a, c, g, or t
  misc_feature (121)..(121): n is a, c, g, or t
  misc_feature (124)..(124): n is a, c, g, or t
caaattggccnaaatgggncncaaccataaaccctgngngatanctcncgcgaggatggtncgatttgcgccgctgctnnctntgatttnngaagnttgatggttgaagattnactaaaanacnaattaa

SEQ ID NO: 591464 - DNA, 137 bp, Homo sapiens
tgtctgagacccgatgatttcacagtttaacagttttttattaaagccatttaattttctatttcattttcctttaagttctgggatacatgtgctgaacgtgcaggttagttacataggtacacagggcccgagag

SEQ ID NO: 591465 - DNA, 183 bp, Homo sapiens
ttaattagcaggtacaattttataacttgctttcactcctaaataatagtacaagtgtaatcctaaaactgaactctgtcaagttacattataaccttgagcagttttcatctctttaggcctcagataccccatctgttaaatgcacatgacacttacaagattataatgacaattaaatga

SEQ ID NO: 591466 - DNA, 173 bp, Homo sapiens
gtcgtcccgccaggtcccctgattccggcccttattccgtgacactcagtccctgtatcccaggtcggccctgctctctaagcatcacttgctttatcccattcaaaactcacactaccttgatgcgggtcaggtcaccgcccagctgcatccaccgttgcctgctgcctaga

SEQ ID NO: 591467 - DNA, 192 bp, Homo sapiens
gctcctaagacctcaagcgtagtgggtacgatgagtagatgtgctgtggtgaagagtatatgggtgtggtgtggaactttatagtgtagagctgatattatgagaaggggcggtgatcgggaggactattgggcggggctttgtatgattatgggcgttgattagtagtagttactggctaaacgcctctca

SEQ ID NO: 591468 - DNA, 2356 bp, Homo sapiens
ccacgcgtccgggaggcgcccgcggctgcagagctgcagagcggggtctcccggccctcggcgtcccagccctttgcacatagctgggccagacaacaactcattctctcggcgcggccgtcagggccccagcggtcggcaagctggctccccgagtagccaccgggacccccgagcccaatggcgggggcggcaacaaaatcgacagcaccgtggagatcgcccccggcgccaatggacaggtcgggagcctcggagatgcggtcccccccgagcagctgcagggtgagcgggagcgccggcgggagggggagggcgacgcgctgggcagcagcctgtcgctggccgcgcccccgggccccctcagcttcgaggctctactggcccaggtgggggccctgggtggcggccagcagctgcagctcggcctgtgctgcctgcccgtgctcttcgtggcgctgggcatggcctcagaccccatcttcacgctggcgcccccgctgcactgccactacggcgccttgccccccaacgcttcgggctgggagcagccccccaactccagcggcgtcagcgtcgccggcgcagccctagcagccagcgccgccagcagagtcgtcaccagtacggacccctcgtgcagtggcttcgccccaccggatttcaaccactgcctgaaggactgggactacaacggactgcccgtgctcaccaccaatgccatcggccagtgggatctggtgtgtgacctgggctggcaggtgatcctggagcagatcctcttcatcttgggctttgcctccggctacctgttcctcggttaccccgcggacaggtttggccgtcgtgggattgtactgctgaccttggggctcgtgggcccctgtggagtgggaggagctgctgcgggctcctccacgggcataatgactcttcgattcctcctgggcttcctgctggctggcgttgaccttggtgtctacctgatgcgcctggagctgtgcgacccaacccagaggcttcgggtggccctggcaggggagttggtaggggtgggagggcacttcctgttcctgggcctggcccttgtctctaaggactggcggttcctgcagcgaatgatcaccgctccttgcatcctcttcctgttttatggctggcccggtctgtttctggagtccgcacggtggctgatagtgaaacggcagattgaggaagcccagtctgtgctgaggatcctggctgagcgaaaccggccccatggccagatgctgggagaagaggcccaggaagccctgcaggagctggagaatacctgtcctctccccacaacgtccaccttttccttcgcctccctcctcaactaccgaaacatctggaaaaatctgcttatcctgggcttcaccaactttatcgcccatgccattcgccactgctaccagcctgtgggaggaggagggagcccatcagacttctacttgtgctctcttctggccagcggcacagcagccctggcctgcgtcttcctgggggtgaccgtggaccgttttggccgtcggggcatcctgcttctctcaatgactctcacggggattgcatccctggtcttgctgggcctgtgggattatctgaacgatgctgccatcacaaccttctcggtcctcggactcttctcctcccaagcttctgctatcctcagtaccctccttgctgctgaagtcatccccaccactgtccggggccgtggcctgggccttatcatggcacttggggcgcttggagggctgagctgtccagctcagcgcctccacatgggccatggagctttcctgcagcatgtggtactggcggcctgtgccctcctctgcatccttagcatcatgctgctgccagagaccaagcgcaagcttctgccagaggtactccgggatggggaactgtgccgtcggccttccctgctgaggcagccacctcctaaccgctgtgaccatgtccccctgctagccacttcctaatcctgccctctaagcagcctctgagcctggtgggaggctggccatttagaaaggtgacggagggctggctagcaagatagacggagaggcaaggccaccctgtacatacaaaaggctccaaggcgcctcacgccatctaggagagctcagagtgccattcccaaccccctctcctccccgctgctttctgttcacttcatcagcaagagtcaggacggggatagcatctcgctataaccgttaggtctgggatccatcctatgcccaaagacattttcccagaccttgctctttctcgctcttcattctgtttcaataaaagacattttgaataaatgagc

SEQ ID NO: 591469 - DNA, 259 bp, Homo sapiens
aacaagctgttgctgttggcaaaatgtctggcccagcaggctttggacctggtcctgaacctggcaaaaaccctggcaattttgcactgtgtggctcagcccctgctcctcgccctattttgccagcagggcacccgcaaccttttgccctttttgcccctccctgaaggatggttttttcatttggacacccctggaagcaaatcctaggtttttttcccccaggcaacctgaattaaagtttacccagcctttgtgg

SEQ ID NO: 591470 - DNA, 292 bp, Homo sapiens
tttttatacccgttgggggggggggggcccccccccccccagggggggttttggggttaataaaatgggggaccccccccccgggcccccccaaggtttttaccccccttacgggatggggggggggggggggggggcatggaaaaagccgggggggtttttgttaaatggaaaaaggcccccggggtttttttttttggttaatttgttttggtttttggggttgttttttaggggacgggaatgacccaagggcgggaaaccccaggcccaaaaaaaaggggggttttta

SEQ ID NO: 591471 - DNA, 1165 bp, Homo sapiens
gacgtggctggtcaccaccacgccgacgagctcacagttcctctaccccaatggtgtgctggccagcgaggagcagtgagtttcgccgaggtgcttcgtcaatggccctgcgaggatttacacaagcatgaaccacgctctgtgctgcggtgctgcggcctgctgcccgaaaggctgcctgtcgtaacgctgaagcctgaatgcatgctactgctgtgtgctgtgcgcctgtgtggtgcagctgtggtgtgtgctgcctgcaggactgttgtctgcccatatctgcgttgctctggaccacccttgttgccacatttaccacgagacactggacacatggcccaagcacactccacaaaggggacggacatggttcttgcagtcgcgccccatggcctagacatggcaacattgtggcatttgcgtggcaatccaaaaggtggaaccagatagccccaccatgaactgtgatgcacccccgaacccggttgacccagaagtgcatctccggtgtcagaaggaacggccctcggcgccgagaaggcacgcggcggcccaaatatcggaaccaacgttgggcaccagagcggcaccgacgaggaacgccgggcaatcgatcacaacgcgggcagctgcacgcatcagcgcccaagaggacctggggcactttggcacggcctcaagagcccccgggcaacattcaaaggcacccaggagaccgattccccgacgaaagtgtatgggcccagggacacgaagcaggcccggcccacagacgggcccgtctggggaacacgcccagccccacagttcaccttccgaggccgaggcccaccctatcggcggcacagaacgcgcacgcgcagccacgactcgctcgacgcaccccggaaccgcgcccatttccaaccaccgcaaacgcgttcaccgccggcataactcgctccccggagggcacctgccacatcgggtgcccggggattccccacccgccgcgtggcctggcaacaggtccccctttggcacatcttggccacgtccgcgcgaacaggcccactacctgtaatttagcgcacatggcccatacagcctcgctcccaaaagtcgccctactgtcaaaaaacgaggtgggtgtccccgcattccacactgggagcccccccaa

SEQ ID NO: 591472 - DNA, 173 bp, Homo sapiens
ggtgagccgccagcatggatgacaatcttacaagggcttgcgggtagagcagcttgacaagaagagcaggaaaaatgaggttcaaggcagccttcgacaatcttcgtgctgggcgctgaggatggcttcattcgaccaaggggctgggcaaggtaatgagggtcttggccaga

SEQ ID NO: 591473 - DNA, 507 bp, Homo sapiens
  misc_feature (488)..(488): n is a, c, g, or t
  misc_feature (505)..(505): n is a, c, g, or t
attcggcacagttcaagaaggagttccctagtataactgggattttgaacatttccaatgaggagtgggttgtaagggatgatgatacaacatcacaaataaccatataaatcttagcttccaaaagatctttttaaatctggtttttcattatattagatgtgtgtcctcaggaaagtcactcatcttccccgagtcatacttttcttctctgtaaaacttggataatacataaaatagagtttgtattagtccattcttacattgctataaagaaatacttgagactgggtgatttataaagaaaagaggtttaattggttcatggttctgtaggctgtacaggaagcatgatgctgcctctgcggcgacttctgtgggaggcctcagggaaacgtattatcctgggtggaaaggcaaagtggggagccagcacttcacacatctgggagtaggaaaggggagggggtggaaggggagggaggtgnccccatacttttaaacntt

SEQ ID NO: 591474 - DNA, 239 bp, Homo sapiens
gtcctggttattcacaaacactgatacggctctcctaaacttccgactgtgtcccagtctgtggtttccatggagtgtgaacacgaagttaagagtgatggctgcttcagagcccctgtgcccatgtgtccatccagactccaagtggagtgtagggctcccatgggcagagacggggtggtgatggggcatgaccctgacccaggcatgtcctcaccattggaacagggacatcatga

SEQ ID NO: 591475 - DNA, 495 bp, Homo sapiens
atatgcagtatctttaattgaacctcacagaaaggttgcttggttgaacaagaaacaagtgtgatttttaatgggggttgtgtagacacccttatcatggcgaacacatatgaatcgtcagctgacctacaagccaagaaccttgttcctggacggattgggagactttaatagcgccatctatacgctgaggatgctctgtgtagcatcacctgttttgctcatcttcgcaggagaaagagacgtcatcaccatggactattgcatgtttaatacaaaagtggagtaatactctataacaccggttcaccgctgtggtgttgtctagaggtaatgttaccagaagctttacaagtgcggatggcagatcagtttgccagttctggtcagaaagagtgcataccgtccatccagaggatgttcgtcatggcatccaactgtgtgtgaacttctgtcataaagagttgcaaaacgcaggatagttgacaagatcat

SEQ ID NO: 591476 - DNA, 126 bp, Homo sapiens
acccgggcctttctgcctgtgtgatctggctcgtcacctgcttggtgtttgtttttaattttattggactgtggttgacttacagtgttgtagtagtttcaggctacagcacagtgattcagttat

SEQ ID NO: 591477 - DNA, 86 bp, Homo sapiens
  misc_feature (20)..(20): n is a, c, g, or t
  misc_feature (86)..(86): n is a, c, g, or t
tttttgagaggccgggcggnaccacctgcatctggtttattgttctgttttctccaaacttagcagagcagaatgtgccgcaccgn

SEQ ID NO: 591478 - DNA, 186 bp, Homo sapiens
tcgctgccacggtcgacctctcagagcgatcccccgactaaacccatggcgcatcatcacggcccaattcgcccagcgccatctacccccgcacaaggataccgagcagcaaacgccagcgaactaagcaaagcccagcctatccagactaaccttgcctgctgcaccttcctactgcatcgtgcc

SEQ ID NO: 591479 - DNA, 126 bp, Homo sapiens
attgtcactctcatttctctttggtgcctttgtcgctaaacaattgaagaacataaaacaaggacagctggattggaccattaggaggaagtattaaagaggtcttgtaagggcaaaaaggggaat

SEQ ID NO: 591480 - DNA, 290 bp, Homo sapiens
tttcaattccactgtattccattcctttcctttcctcgccactctactccattccattccactccattccatttcactcttcctttcctctccattcggtgccattccattccactccattccattccattccattccactccattccactccactctattccactgcattccactccattctaccccaatccactcccctcctttactttctattccactacattccgtcccattcgattccattccactccactccattccgtacaattccactccgatctgtcgacg

SEQ ID NO: 591481 - DNA, 215 bp, Homo sapiens
acggtactctagacggactccccctaggtggaaccgcgactgtctacgtgtggacacacgacgtctactgtggacaacgcgaccgtctacgtgtggaacacgcgaccgtctacggtgggacggtgtgttggtacgttcatgcttgtaacttccaaccaccttgtgaagacttgacggtgggacggcttggctccacgctcaagcgtttgacggct

SEQ ID NO: 591482 - DNA, 881 bp, Homo sapiens
  misc_feature (1)..(1): n is a, c, g, or t
  misc_feature (652)..(652): n is a, c, g, or t
  misc_feature (881)..(881): n is a, c, g, or t
ntcagggaaaagtgaaatgactcctcactgcatcagtgtgaaacctttggtaccacataactactatgataacgccggcctgctctcgtgaaaaacctgataccacaacactgatggtccacattgtgcccccgctgtactccctggctgttcacctgtggccctcttggcgcaatgaggcggtgccgatgatcctcataaaatacaagacgctccaaattatgaccaacatctacctgctcaacctgtccagtttccgacctgctattcctccacacaccttccattctgcatccactatgtcagaggggcataactgcgtttgcgcacatggcatgtgtaagctcctcttcagggtttatactcacactggattgtacagatagatctttttcgtaatcctgctgacaataaacaggtacctgcccattgtccatgctgtgtccataccttccagcccggactgtcacttttggtgtaatcaccatcatggccaactggggcctgccagtgctgacaactatgactgcattcatcttctattagactgaacatttggcgcaatagactctctacactgctctttaccgagaagatacactatatatctcgttgcatatgcacactctgtatatgaccatcatccgtctangtctccatctgctgcgtatggccatctgccacacatgaactatcagcacgactgctgggtgccccagtacaaaaaagactatgccatacggctcattttagtactatggcggagatactactttctgcaccgctacatgagcgttactttgttattctatcatgcatgtatttgaaatgactgtaacgagcgagctctgccctgttatctgaaaacaggtatctctttn

SEQ ID NO: 591483 - DNA, 388 bp, Homo sapiens
atttactacccatagtctttaggttcctttccatctttccttccttcctttgggctcctcttcttcccagataaaaagctgagaaatttagagtctcgccctgtcgccaggctggagtgcagtggtgcaatctcagctcactgcaacctccacatcctggattcaagccatcctcctgcctcaggctcccgagtagctgggactacaggtgtgtaacaccatgcctggctaatttttgtattctttagtagagatggggtttcaccatgttggccaggttagtctcaaactcctgacctcaggtgatcctcccaccttggcctcccaaagtgctgggattacaggcatgagccacctatgcccagcctaagtttcttgacaaagaaaa

SEQ ID NO: 591484 - DNA, 254 bp, Homo sapiens
gggaacagcagcacaatggacctgacgctcttcgcagctgaggccatcgccttaaccgccagctatctcagcacgagagaacgaactagcagaggagccagaggcactagctgatggcctctgctccatgaagctttccctcctgcagtcacgctggcccggagacgcttggccaggcaggccgtgtgaagacaggagccgccaacagcactctaaatgctccatacacttataggcctagtcgcaggatttcc

SEQ ID NO: 591485 - DNA, 258 bp, Homo sapiens
ccccgcgagttccagcgcctcgaaaagcacctggacggggctgcactacctgtgcaagcacacctccacgggcgagtcgatgaagatcaaggtgctgaacgcctccaagaaggatctggtgcgcgacttcaaaaccgcgatcgacttcgaccagagcaccctcttcaagaaggtgtacgaggaggagttcggcaccttcggcggctcgccgatcggcgcgctcatcggcgactatgagatcggacggcatcccgagga

SEQ ID NO: 591486 - DNA, 133 bp, Homo sapiens
attgcacacattccccttcaccttcaggtaccggctgtgatacatgtggcgatctgatctatcttagattcactggtatctatctgtgcagcctggcgcacaaatcctccaattccatcatacctatgggacg

SEQ ID NO: 591487 - DNA, 867 bp, Homo sapiens
ggaaaaaactcgtctcgtaattttgtcttctccgcacgactgttagcagagggctatgcccgacggccgttctctctcctgtggcgataaatggcaactcttaagggaaaaactacatgtgcgtccacggctctagcggcgagaatgagcggcaagagttccgaaggataacgatcactgttagatgggtgtaggatctaagttgtgttattggtagtgtgcatgagtgaagatatttgctgttgacgttctctggtctgactgaactttgcgtctatgatggagtgtctcggaagataaagcttaaaggagaaatgatggatctggtgcatggaagcttatttaactatacaagaaacaccataaaattgggtacgcacgaatacagcggagttaactatctgcagaaccgggccaatttcctaaggactatgcaacgatgggtttgacctggccaggatgcccgttcaaggtgtgaagggtccgacaaggtcggccacaactcttgtgtgccccgaagatgaatgtttaccccggtgcaacaaagagtctcactaaactttgccttcggggaaaccggacacacagtccgaggtacccttgatgtggcgagtcggtacacatcgacgcgtattaccaaacccccagctggacatttacttaacgataagtgataaccatgaggaaagctaaagttgggataaggcgcagaacaaataagaagaatgaatatggaagattcggatggtaatatgtgggaattgtagggaagaatagtaggtaaccattacaatgggaatagaccaaaacttggaaatatgcactacaagataggtaggcaaagagaattgaataatagaggaagat

SEQ ID NO: 591488 - DNA, 116 bp, Homo sapiens
gaggatccccgtcactcgaaaccctgtcatcaaaccctgtcatcgaaaccctattagtggtttaacaatccaacgcttggtgaattctgctgtcagggtttgatgacagggtttga

SEQ ID NO: 591489 - DNA, 286 bp, Homo sapiens
aaaaccccggaaaaccccccccgggtttttttttgggcttttttttccctttttgggggggggggaaaccccggtttttttttgggcccccccccttttggggaaccccaaaaaccggggggtttttttccggggggggccccccccctttttttttgcccccctttttttaaaaaaaagggccccccccttaaaaaattggggggggggggggggggccccccaccccccccccttttcccccccccccggtttttaaaaaaagggtttgtttttttttttttta

SEQ ID NO: 591490 - DNA, 615 bp, Homo sapiens
  misc_feature (15)..(15): n is a, c, g, or t
  misc_feature (162)..(162): n is a, c, g, or t
  misc_feature (203)..(203): n is a, c, g, or t
  misc_feature (245)..(245): n is a, c, g, or t
  misc_feature (253)..(253): n is a, c, g, or t
  misc_feature (314)..(314): n is a, c, g, or t
  misc_feature (333)..(333): n is a, c, g, or t
  misc_feature (359)..(359): n is a, c, g, or t
  misc_feature (399)..(399): n is a, c, g, or t
  misc_feature (421)..(421): n is a, c, g, or t
  misc_feature (424)..(424): n is a, c, g, or t
  misc_feature (441)..(442): n is a, c, g, or t
  misc_feature (450)..(450): n is a, c, g, or t
  misc_feature (472)..(472): n is a, c, g, or t
  misc_feature (489)..(491): n is a, c, g, or t
  misc_feature (493)..(493): n is a, c, g, or t
  misc_feature (503)..(503): n is a, c, g, or t
  misc_feature (509)..(509): n is a, c, g, or t
  misc_feature (540)..(540): n is a, c, g, or t
  misc_feature (557)..(557): n is a, c, g, or t
  misc_feature (566)..(566): n is a, c, g, or t
aacaagtataatttncaaatattacaaggatgatttccaaatctcatttgacctctttcccaactgcaaaccctcatttagtctttagtgacaacaaaaaccaaaaacaaccacccacacatctcatgtgaaattctggtggcttagaaatccctgaaaaancagtaaactgattattgaaaagctcagaacactggcaaggnttaagtgcaaagtatttaatagaaggccacaagaactgtttncctaagangagctaggaactacaaatgtcatttagtaatgcattgaaatggcattgcctagtgtgagtnttgcacagaaacttcaggncacttcttctggatctattattttgnataagcttccactatcataacatggccctgccctccaacngcacacgcgcccctaagccatnctngcctccttctttccgtnntctgtcgncagcagccatgaccaacctgcngccagtggctccaaatnnncngtcccagggncagacntccaccccagttattaaacttctccaaaggnggcaatccaaccttggntttcctacncatgtagttttctgcaaaccaatcagaatccatggctttccaatttgcc

SEQ ID NO: 591491 - DNA, 261 bp, Homo sapiens
  misc_feature (231)..(231): n is a, c, g, or t
  misc_feature (243)..(243): n is a, c, g, or t
agagaacaaaaaaaaacaaaggattaacaaaatgaaaaattgatttttttgaaaaagtaaacagcattgataaacctgtagctagactaaccaagagagaagacccaaataaagaaaaacagaaataaaaaaggagacattacagctgataaccacagaaatacaaaagattatcagacatgattataaactacaatacacttaacaaactgggaaaatctaggaaggaantaaataaatttntgaatgtacaatctaccg

SEQ ID NO: 591492 - DNA, 271 bp, Homo sapiens
gatgctacatcctgcactgacgcctggaatggtggtactgcatagaggaatgcataatatagatgcgatagagccgtggtcagcagtggagaggtggtgaattcttcactgacgcctgagcttgtcgtgctgacaggtagagagtgttgtaggcagatgatctggggctactatggacagtggtcaatctctcactgaggccaggcgtagtggtactgccgggtaacgctgtcgtttccattgagcctgaactgatgggtagaggctcaaa

SEQ ID NO: 591493 - DNA, 676 bp, Homo sapiens
acaaccactcctcggagttcactgtcacccgcaactacctagactggctcacgtccatcccttggggcacagtacagcaactgagaaccttgacctgtgcgcgggcacaggcagtgctggaggaagaccactacggcttggaggacgtctaggaaacgcatcctggcagttcgattgcgcgttatgccagactccgcggctccacccagggcgacgatcctctgcttctatggcccccctggcgtgggtacagaccagcattgctcgctccatcgcccgcgccctggaaccgagagctacgttccgcttcagcgtcggcggtgcatgactgacgtggctgagtatcataggggcctacaggcggaccgtacgtgggcgccatgcccgggaagatcactccagtgtttgaagaagaccaagacggagaacccccttgatccgtcatcgagcgaggtggtacaagatcggccgaggctaccagggggacccgttcgtcggcgactgctggagctgcttggacccagagcaggaatgccaacttcctggacctgctacctggacgtgccccgtggcacttgtccaaggtgctgttcatctgcacggccaacgtccggacaccatccccgagcgctgcgagaccgtatggcgatgatcaacgtgtcgggcgtcgtggcca

SEQ ID NO: 591494 - DNA, 1031 bp, Homo sapiens
atcggctgctgcagactctttgttcgctttctgatgtgtctgtcttcgtccggttcatcgttctctgctacactgctggttccttcctcgcgattccgtttccgacgtctcttcattgtcgcctagccgtgtgatgtgtgcctccatgccggctcgcccctgcatggttcccggttggtccctgtgcgtccgcgaagatggtcggtcctcgtccaattcacattccggtccgctgtgcccggtctgttgttgtccccccgcccagttgtgtaagaaatttttccctctccacgggggtcccgaaccacctttttctgtttgacatttcgcccggacttcctccattccccgttgtcctggcagagccctatgtccagggttattaccctttttgaaaacacagaaggtgctccccccgtgcgcatgctccccaggagtttcggcattgtgctggggaccaccttctcgttgtggttcgtgggcccccgtccgcccgaagtaccagaggtttgccctttgcggggcaccccgctttgcagaaaggcgccttatgtccctaatccttctgaatgtatctctctaccatctggcgccccaagatcactccagggcggtctcccttttctgctcgcccctagaatcgagtttatggaaactgcaagagcggccgcaaaatatttttcggaagaaattcctcctgccccccgatgaagagtattcccgattctgcagttcttcggttaatcgcccacttcttcctcggatatttataggggtccccacttaaccgtggcataagggagctattcctttatattatttggagacccagcatcacggattgtgggccacactctcactaaattgggggattttctaatatagagaaacacaagccaccaccactggggggacaatatataggaggccgaacagcgtcccattgatccccctaatatgatttaaagtttttaaaaccccttttttgggggccaaaaaaaaaaattttcccctaatcctaaacccaaaaa

SEQ ID NO: 591495 - DNA, 205 bp, Homo sapiens
tagaggatcccacttccagactagatgatgcatcttggtttctggacactggtttgggttggggagttctggttggataggttccttctttatgtctttaccaccatttagaatacgtggccctcacaaaagaactgattaggatgattcaaagaaaagccacaatcatccacattgtgtatcatctcaaagtatatttgacagg

SEQ ID NO: 591496 - DNA, 310 bp, Homo sapiens
  misc_feature (187)..(187): n is a, c, g, or t
caaaaaaaaaaaaaaaaaaaaaaagagagagtcaattatgagtgcagtgattgtcaaaaaagtttattagaaaactagaagctttccatttagtaggcagcaccagtggatgtaatgaaaatgataaatcattctcaaattatatttgttacacattagggtattcattcaggagaaggaccctacngatggagggaatgcaggaaagctaagaagaatcacacctcattgcaggtaaaaattaaaatctgaaagtccaaaactctttgaatatcttgtttacggggggaaatctccataggttccagtg

SEQ ID NO: 591497 - DNA, 627 bp, Homo sapiens
  misc_feature (71)..(71): n is a, c, g, or t
gtgacttaaggatcctttagtcgggacgagaagcagaaatgagtctggagaaaatctcagaggacatatanccccaaatgcggtaggagatggagtgggggcttcttaattctggagtacagagcccattttggaatacttgggaggcaaattagatcccagtttagttttctgtctttgcatttttttcttccatttctccagagggtctcatggcgcagcagtgcgggcttgcccctcttgatttaggggctggggaggcttggcaggacgggaggcgtgggaacatggcaccccctaagtggccccctgttttggactagaggtgttgcttgctagctagggggatttttcaaaccttcaggggaataaaggctggtagtgacggagtttgagcagtgggacttgggggtggggggacgccagaagcaggcctgagggaagaactttggggtctgggaaaagagaagcaggagaagggcttatcatccctgagagtgaagccatgatttcggaacagactggagatacagaagagggaacaatttcttcttggatttgggaggaaacctgcggtccgcctaacttgcggtccgacttaactggggtacgagctcaattcgatca

SEQ ID NO: 591498 - DNA, 1184 bp, Homo sapiens
gcggagccgcaatgcctaaaggaggaagaaaggtgaggccacaaaggccgggtcgaggcagatatacaagccctgtaggagatcgacctgctgcagtatgctaggcttgatgaaggcagaaggccagggaacgaagaggagcaaaaagaaggtggacgatggggctgcaggttgaccccagataaaggagaatgaaatctctagactcagatgagagtgaggatgaagaacgatgactaccaggcaaaagcgcccaggcgttgatagggctcatctgacatcgagaaaccccaagccggtgtgtgcagcagagcaaccgaagaagaggtcacagaactggagtctggacgggccaaaggagcttccgacggagacgaacgagaagagattgagaagcagaaggcaaaatgagcgttacatgaaacatgcgacttggccgggcaagacaagagcaagccaagtgctgacctggccctggctggtcatcatccggcatacatgtgtgcgatgcagtgctgccccggcaagtaaggcagcagcgaccggaaaagcaaaagacgatgccacatttgtccaggaaacacgaatgcagtcactcttcccctgaaagtaagtaacatgagaacccgtgagagggaaatgccgagggaccttgggccgggctgcaggacactttgctgtgtctagaacaacactgtgccctggcgccgctgcacaagacccattcattgacctggaagcgccaattgagcttgaggcctccatctatcaatcttggggacagacaatatgtagcgaggaattagaggtatacactagggaaacagggatagcaaggagaattagacaacaacaaggagaagagaaaagaatatagattttacaattcaaagatcgacagagaggttaacaaaatcaaagccactttcatgaggagttcatggcaaaatagaaaaaaaaacaccaacctacggcaaacatcaaagacaaggaaaactaccaaaaagacaaacaaaacagtgacaacatcaccaagtataaccaaacaacacagataataaaacctaacaccatacaaacaagaacagaacacaacaaacaaacaataaacaacaccacaaaaccaaagaaaaaacagatacaaattttaaattatcatctataatatataacaacaaaacaaa

SEQ ID NO: 591499 - DNA, 349 bp, Homo sapiens
cccctgcggttcatcatatataggtaaagctctcacgactcctgagccaacttttatgtaactggcttatcctaggcgggggctatgaactaatgtaaagacgccacggagttcagatctagatagcagagaagtacgtctcatactaaaacattgcaactaactgtatagagtccaccccatgaagctgtaacagatggtgtatctttgactgaattctcataagtatatatggtacagactaaaacaaatgttgctagctaggtgggctgtgctagctcagtaggacatggcacagactccagctatcaccctctgaagaccttggacctaagtgccacatgcataa

SEQ ID NO: 591500 - DNA, 410 bp, Homo sapiens
ttagctggtgcggtgctcataatgaggaaggtgtcgtcaacgctgccctcgctgaccgcgccgcccatccgctcctctctgctctcggacaccgcgctctcgtcgatatactccagtgagatccgcatgctgcaccgacagctccgacagctgccagtgctctgtgcaacgggctctgctcctgtggttgcagccacggcttgaagtgagtgcaggtgcttctgtttccactcggggtacttgaggcacgccttgtacatcttcttcatggccttggtagccaggaacttgaaaatatttattcaccacccacttggttaaggatcctattggggtccaccttgggccagtgtatggtgatgacgcatgctcttgtggccctgtgctcatggatgaggtagcccgtctgg

SEQ ID NO: 591501 - DNA, 1873 bp, Homo sapiens
  misc_feature (1873)..(1873): n is a, c, g, or t
gctgcgcgccgactctcactcacagcctcccttccttctttctccctccgcctcccgagcaccatgctgcgctctgatgctgccccacagtggatcccatcacccctgcctgccagcagcccattatggacgggatggaatgtaaaggtgaatgatgtgagacgtgaatgtggagatgacctgtgaccagcacatcacgccgacgaagcaggatgccgcaggtcgcacatgggcagtgtatagtagcgatagacgcacgcagggaccacagacacacagccgcacaatacacgaacaaacaagacaaacgaaacgcacacacgcacgcgactcaaagacaacagacacaggagaaacaagcacaagcagcaaagaacacaacgaagcaagaagtgacatgagagtacgacagagactaatccaggaccgataggcgagtagaggagcaccgagagcacactaccgtagtatgacaaaaagatagtgcaagaagatgctgatgactagacagagcagcatcagcatgagagaagtgaagcagcgacagacaacaaagaaagagaccaagaggagcaaagaggagaacgaaacgaagaagcggcgcgcggagtagggacaggagcagcgagcgacgagggagcgaagcacgacgcagaggagaacaggcgatgaggaccacagcagcgaggacagagatgagaacaacagagcagggaggcaagcggagagagcagagagacaggaacggcaaacgagcagacagacggacggagagatagcgcagaggggaggagggagagagggagagagcgcgagaagaggaagagatagagagcagagagaggcgcacaagggagagacaacaaccagaagagacagcacagacgaacagaaaaaggcaacgcaggacgagagacagaaaaacatgacgacaaagagcagagagacgacagagaaacacgagaggcagcaaggacgcaatgaggacagacacgacaggagagcatcggaaggagcaaaacgaaatatcagagagcgaagagagagagagaagacgtaagacatgaaaagcaggaaacaggaactggataagagaaagtagagggacgacgcgcggagagcgcatacgcgaggaggaacaggtacgacgcagatacgagacagaaaaggacgaggagcatagagacgcgagcagagtcagaggaaagcaacgagtaagagaaaagacagagcagcacgagccccgcgccgagagaagaagaatgaacaaatgagcgagcatcaacaagacgcgcaccgagagattacagacatacgaggacatacgagaacaccaacacggagaagagagagggcaacaagtgacagtcagcgaggctcgagcagggagacaaaacagaaaaggaggcgagacagcgcgacagagagaacgacaaacaaccagagagacacagacaagacgaaagacaggacagaagacagaagacgaagagcgataagatatgcagacgacgatcgccagggagcacgagacagcgaaaggaaggatgaagacgcacagacacgcagacgaagcgaagagacagcagtaagcgcaagacagcgagacgcaaggctacgcatgataactaaccgagtagcgacacgctgaagcagggaaacagagacaggacagtgcacaagtacaaggatcacgacggacactacgagcagaagcatagcagcaaagcagaacaacaggcggaacgacgagcccgcagaggggtcgacgcaaagtgaagagaggagagaacaaagagaaataagaagagagcaagacacaaacgaagcgagaaataaaagacagacaagagacaggagacaagaaacaggn

SEQ ID NO: 591502 - DNA, 209 bp, Homo sapiens
  misc_feature (65)..(65): n is a, c, g, or t
agcaaggggaccttggcgctttcagctttccctgccacatccagcttgttgtcccaatgaaatantgaaatggtgggctgtctttcccttccaggaatgttgggcccccagcctggccagacaaaaagactgtcaggaagggtcggagtttgtaaaaccagcatacagtttggcttttttcccattgatcatttttatatgaaataaaa

SEQ ID NO: 591503 - DNA, 551 bp, Homo sapiens
tactgaatcactgaaagatttaattttatttagtttgctaagggagaaggataaatacatttatatgtaacatttttattaaacaatcagacagttttaggttaaacaaaactatcagaagaattaattcaaacacccttagtaggaaaaacaaatgttggctagctagcacatgagcttcaataccctggccctagctgaattacagtaagtaaaaatcccatttttactaataatgaagttttaattacatagagtcaataatcacaacagtaatatgaaataggataacagtaatttgaagagagaatttataatcaataatactccatggataaataattgagaactgtaaaaattaagactcaatttgcttttttgtcaatctgaaggctacaactagaatataacaatatcttggtcaagtgtggtggctcacacctgtaatcccagcactttaggaggccaaggtggaaggattgctggagcccaggaattcaagatcagcctgagcaatgcagcaagacctcatctcaagaaaacccaaaaaa

SEQ ID NO: 591504 - DNA, 212 bp, Homo sapiens
tcaccgctttatggtgtaaacggcctcgcaggcgctcggctggtgtcttgatattatcatctgctgagtggtggagctgatgggtggaatggggagtgagctgacgctcggaaggtgtcttgagattatcatccgctcagggtggaagcggcccccgctatacgctcggctaggtgtcttgagtattatcagtctggctgagaggtggagct

SEQ ID NO: 591505 - DNA, 684 bp, Homo sapiens
  misc_feature (3)..(3): n is a, c, g, or t
  misc_feature (68)..(69): n is a, c, g, or t
  misc_feature (113)..(114): n is a, c, g, or t
  misc_feature (116)..(116): n is a, c, g, or t
  misc_feature (153)..(153): n is a, c, g, or t
  misc_feature (158)..(158): n is a, c, g, or t
  misc_feature (170)..(170): n is a, c, g, or t
  misc_feature (188)..(190): n is a, c, g, or t
  misc_feature (235)..(235): n is a, c, g, or t
  misc_feature (237)..(238): n is a, c, g, or t
  misc_feature (249)..(250): n is a, c, g, or t
  misc_feature (258)..(259): n is a, c, g, or t
  misc_feature (297)..(297): n is a, c, g, or t
  misc_feature (313)..(313): n is a, c, g, or t
  misc_feature (316)..(317): n is a, c, g, or t
  misc_feature (352)..(353): n is a, c, g, or t
  misc_feature (410)..(410): n is a, c, g, or t
  misc_feature (433)..(433): n is a, c, g, or t
  misc_feature (468)..(468): n is a, c, g, or t
  misc_feature (480)..(480): n is a, c, g, or t
  misc_feature (483)..(485): n is a, c, g, or t
  misc_feature (487)..(487): n is a, c, g, or t
  misc_feature (615)..(615): n is a, c, g, or t
  misc_feature (649)..(649): n is a, c, g, or t
ganctcgatgagccccagcaccaacaacctgagcaggtgtgtgagccagcgtgcaggcatggcccacnngaggtagggcagtgtgtggaaataccagacgtagaactggtagnngngggagcggctgaagcagatgccaatgaagttgggggngaagngggtagaaacgntctggttgggtgtggggnnntggggtggggcttccttttggagggatccctcagcagcgacaagntnntttcccctgtnntgtgccanntgcggagggcaaacagcaggggcggggtggggtgggcngtcaacagggcccggnggnnggctcgatgcggggagagcgcctctgggaggaagnnccagttcactgtccagtggaacagaaactggcggccaaggtcaaaggagcgggacangtagccgctggggttctccagcnggaagggcagccccagcaccacctgaaggccagcncagattcccagnttnnngngggcccacggaagccaaactgtgtgaggagaagaaacagtaacccaggggcgaagagcagcacattcatcttcacagagactgccaggctgaaaaagcagcaaccccagccccagcgctgggccagcnggaggttgatactgaggaagagcagcaccatggncactgggtcattgaagagccgcagcacaaagatgg

SEQ ID NO: 591506 - DNA, 190 bp, Homo sapiens
gtagaaaatacaagtttcactcttagacataggaactatatcaataccattattgttaatttactatagttgccccattgtgctagcaaacactagatcttactccttctatgctaactgtattttttacccactaaacatcccctttctactcccctttccactaccctttccagcctctgctaaccac

SEQ ID NO: 591507 - DNA, 325 bp, Homo sapiens
gaattaacggaatccccaatgtaatgactgaaaagacgtaaaaaacagaaagaaaatgaggtaatatgtagaatcataccatctatacatcatgcaaacatgactccccatatcaggatgcctaaatagaatatagatacatatccttagtacacatctttctctccctctgtgagtacacgtgtacttgtccttgcaatgttcaccgaggctacatgtggtaatgggctaaatttgctagcacaagagtccagaatggttttgtttcttactgaggatatgttctaggtattctctaaattcctaacggatatccgaatacacc

SEQ ID NO: 591508 - DNA, 203 bp, Homo sapiens
atccgccagggcctcccaaagtgctgggattataggcttaagctaccttgcctgtccgttttcatattttttggagagatgaggtctcactgttttgcccagacgggtctccacctctgggcttcaagcagtcctcctgcctcccaaagtgctgggattgcagttgtgagccaccacacctggtcgggagttttacttaccat

SEQ ID NO: 591509 - DNA, 244 bp, Homo sapiens
  misc_feature (105)..(105): n is a, c, g, or t
  misc_feature (171)..(171): n is a, c, g, or t
catttttattaaatgaacaagttgttgattcgataattacaagacttgtacaacaatttcacagcgcctgtaaggagcctttggttggaactggtgacacctgtngcctctccggcacagaggacaggaagtcccacccctgccttccatgcagcagggagccttgtgtcnttggcattcccttgttccgcttgctcccacccttcactgtggcggacaaggggggtacgaggctcgaattcgt

SEQ ID NO: 591510 - DNA, 186 bp, Homo sapiens
tcgcataccactgttgcttatccacacatgtatcgtgcatgtgagctgccaagttactaagttgaggaaggagcaggtcctgagtaggtgacaggactgcccacactcgcttgggatcttgtgatctgagctttacttcctctgcatccatttctagttaggagcatggaccctggagagaccatg

SEQ ID NO: 591511 - DNA, 102 bp, Homo sapiens
tccgttgttttactatcggtcttacttggaaaacccttgcggtacaggactaggaagcaaataaggaaaatgattatgagggcgtgatcatgaaaggtgata

SEQ ID NO: 591512 - DNA, 3018 bp, Homo sapiens
  misc_feature (26)..(26): n is a, c, g, or t
  misc_feature (2332)..(2332): n is a, c, g, or t
gcacgagggaacaacctctctctctncagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactgggtcttgacccctggaatttaagaaattcttaaagacaatgtcaaatatgatccaagagaaaatgtgatttgagtctggagacaattgtgcatatcgtctaataataaaaacccatactagcctatagaaaacaatatttgaataataaaaacccatactagcctatagaaaacaatatttgaaagattgctaccactaaaaagaaaactactacaacttgacaagactgctgcaaacttcaattggtcaccacaacttgacaaggttgctataaaacaagattgctacaacttctagtttatgttatacagcatatttcatttgggcttaatgatggagaaaaagtgtaccctgtattttctggttctcttgcctttttttatgattcttgttacagcagaattagaagagagtcctgaggactcaattcagttgggagttactagaaataaaatcatgacagctcaatatgaatgttaccaaaagattatgcaagaccccattcaacaagcagaaggcgtttactgcaacagaacctgggatggatggctctgctggaacgatgttgcagcaggaactgaatcaatgcagctctgccctgattactttcaggactttgatccatcagaaaaagttacaaagatctgtgaccaagatggaaactggtttagacatccagcaagcaacagaacatggacaaattatacccagtgtaatgttaacacccacgagaaagtgaagactgcactaaatttgttttacctgaccataattggacacggattgtctattgcatcactgcttatctcgcttggcatattcttttatttcaagagcctaagttgccaaaggattaccttacacaaaaatctgttcttctcatttgtttgtaactctgttgtaacaatcattcacctcactgcagtggccaacaaccaggccttagtagccacaaatcctgttagttgcaaagtgtcccagttcattcatctttacctgatgggctgtaattacttttggatgctctgtgaaggcatttacctacacacactcattgtggtggccgtgtttgcagagaagcaacatttaatgtggtattattttcttggctggggatttccactgattcctgcttgtatacatgccattgctagaagcttatattacaatgacaattgctggatcagttctgatacccatctcctctacattatccatggcccaatttgtgctgctttactggtgaatctttttttcttgttaaatattgtacgcgttctcatcaccaagttaaaagttacacaccaagcggaatccaatctgtacatgaaagctgtgagagctactcttatcttggtgccattgcttggcattgaatttgtgctgattccatggcgacctgaaggaaagattgcagaggaggtatatgactacatcatgcacatccttatgcacttccagggtcttttggtctctaccattttctgcttctttaatggagaggttcaagcaattctgagaagaaactggaatcaatacaaaatccaatttggaaacagcttttccaactcagaagctcttcgtagtgcgtcttacacagtgtcaacaatcagtgatggtccaggttatagtcatgactgtcctagtgaacacttaaatggaaaaagcatccatgatattgaaaatgttctcttaaaaccagaaaatttatataattgaaaatagaaggatggttgtctcactgtttggtgcttctcctaactcaaggacttggacccatgactctgtagccagaagacttcaatattaaatgactttggggaatgtcataaagaagagccttcacatgaaattagtagtgtgttgataagagtgtaacatccagctctatgtgggaaaaaagaaatcctggtttgtaatgtttgtcagtaaatactcccactatgcctgatgtgacgctactaacctgacatcaccaagtgtggaattggagaaaagcacaatcaacttttctgagctggtgtaagccagttccagcacaccattgatgaattcaaacaaatggctgtaaaactaaacatacatgttgggcatgattctacccttattcnccccaagagacctagctaaggtctataaacatgaagggaaaattagcttttagttttaaaactctttatcccatcttgattggggcagttgactttttttttttcccagagtgccgtagtcctttttgtaactaccctctcaaatggacaataccagaagtgaattatccctgctggctttcttttctctatgaaaagcaactgagtacaattgttatgatctactcatttgctgacacatcagttatatcttgtggcatatccattgtggaaactggatgaacaggatgtataatatgcaatcttacttctatatcattaggaaaacatcttagttgatgctacaaaacaccttgtcaacctcttcctgtcttaccaaacagtgggagggaattcctagctgtaaatataaattttgcccttccatttctactgtataaacaaattagcaatcattttatataaagaaaatcaatgaaggatttcttattttcttggaattttgtaaaaagaaattgtgaaaaatgagcttgtaaatactccattattttattttatagtctcaaatcaaatacatacaacctatgtaatttttaaagcaaatatataatgcaacaatgtgtgtatgttaatatctgatactgtatctgggctgattttttaaataaaatagagtctggaatgct

SEQ ID NO: 591513 - DNA, 840 bp, Homo sapiens
gccacgagatactgttgacgtggcaatgccgttgaacttcactggaggtcaatggcacagcagaatgttccagagattttcctactgagtagttgctgtcattagcaggtagaaccgtctgagctgccaagtttccataaggtggagcctctccgtgaagaatttgacaattgaatgagaagttaaagaagtttttcaatgtctataactacgaatacgagatggctaagattgagtttatttcaagcaactggaaggtagtatagagtatccagtatatggtgtccaggtggcatccagagaaagcacgcttatgagtggaagaattcggatggcatttcgcgcatgcacctaatgctgtgaaaaggcggcattgttattgtagcagagtttttggttaatgaagctcggaaaagcaagcatcattttaaatctgaatctgaagaggagaaagcattgattgatcagtacagtccaatttatacctggaaatatttcttcatttcagcaatgttacatattggattgaagagtcttcaattgggttaacagagcagaatttgaataattccatgattaaactgttagaataacttgtactcatggcaagattaggaagtcacagattctttactataatgtggctgggtctgattcttcattctgtatgtgactaatttatataacaattagagtaattacataggtgagaacataaatagagtgttaacaatgggaaaagccttcttatttctgaaggattggaacaaaataaatttatggaacaaaagagaaaacagagagaaaaaaaaatagatgtgggaggcgacagaataaaag

SEQ ID NO: 591514 - DNA, 245 bp, Homo sapiens
tatggcgacatttcaatcagaaatgatggtgcctgcatcagtggttcagagcctggttatacatattagatcactcaggcagctttggaaaaattaagatttgtcagccctatctcaaagcttgaatcacaatttctggggtgtgggcacaataatctgtaattgtctttgtttatacttcccctgatgccactggttccgatgccactggccggcgggccagattggaaatggtcgccaatccg

SEQ ID NO: 591515 - DNA, 115 bp, Homo sapiens
ggaagactgccgtgcagaaggtgacctgtctcagtggagctgggtcatctcaggctggatccttgaacttttggccgccatgtgcttcccgaaggtccttttttatgacatgaag

SEQ ID NO: 591516 - DNA, 153 bp, Homo sapiens
agcttagctcccacttggttgccaggctggtcgtaaactactggagctcaagcaatcagccggtcttggcctcccagagtgctaggactacaggcatgagccaccatgcccggccaggaacttgttatctggcaaggtaaacatttcaagtat

SEQ ID NO: 591517 - DNA, 371 bp, Homo sapiens
atactccaatgaccagtcaatggggtcagcgcctccttacgtgtcactccttccgtttttaaaatatggcacatttcttcaatttcagcaacagcctttttcaaatgctctttgggaaattaaggccctccttgcttgtggtaaaatgccgagtccttttcatatgtgttgcgccttcacctatatggtgaccggtggaacacaggcgttttctgctctgcccactatcacttcctctaagggtgtcccattcgtgtgtaagaagacacaggccagtccttgggcagaggctcagtggctttgtcgtcagctgcacaggagttccgagagaacgcggtatctgtctgggtgctctggaaagttcgctgcat

SEQ ID NO: 591518 - DNA, 894 bp, Homo sapiens
ctcgggggcggtgcctgccttgcagcctcccctcgcgcgatcgcgcagccccatctttgtccggcctccgcgctttgttctcggctgcccgggccttggccagcctggccagccgccgagcatgccccacgcctgcgctggcgtcgtcctctgcctccctcgcctgcctgccccacgcgctgcggacgggccttgccccccatggtgtcccggccagagccagagggcgaggccatggacgccgagctggcggtagcgccgccgggctgctcgcacctgggcacgcttcaaggtggacaactggaagcagaacctgctgggccatctaccagtgcttcgtgtggagcggcacggctgaggcccgcaagcgcaaggccaacgtcctgtatctgccatgtctgtggcgtccacctcaaccaggctgcatacctgccctctactgtgtctcctatcgcgctgtctccacaacagaacgcatattcaccgagcatgcgaaggcgaacgcggccacaacctggcccatagactcctcgactgcactgcgagcgcatccaacagaaacactagagcccacggacctccatccacagaccaaacgacatgccacaataatcgcccaaaacaccgaccaagcgaacaaccacgccacacacagcccacacgcacgaacgcgacgaccaaaccccaacaaactctgagagacaccagacccacaaccgagcgagcaccagcaactaggcagcaacgccacaaacacccggaaacccggcagcaacacgctccaccctcgcaacgtcggacccagtaagctctcgccatgcgcctgaaccaaaacccaggacaacacacaaagcacaacgcaacccgcccccgcgcacgccccaggacccacca

SEQ ID NO: 591519 - DNA, 213 bp, Homo sapiens
  misc_feature (19)..(19): n is a, c, g, or t
gaggttcccgttatccggngaggcaacacaggtagatggcatgagctcaggagttcaagacgagtctgggcaacattgtgaaaccccatctctacgaaaaaatacaaaaattagccaggcgtgttgccacatcctggtagtcccacctactcaggaggctgaggtgggatatcccagattctttttgaacaagcagatctccccgggatacag

SEQ ID NO: 591520 - DNA, 998 bp, Homo sapiens
  misc_feature (269)..(269): n is a, c, g, or t
  misc_feature (276)..(276): n is a, c, g, or t
  misc_feature (278)..(279): n is a, c, g, or t
  misc_feature (293)..(293): n is a, c, g, or t
  misc_feature (295)..(296): n is a, c, g, or t
  misc_feature (306)..(306): n is a, c, g, or t
  misc_feature (317)..(317): n is a, c, g, or t
  misc_feature (330)..(330): n is a, c, g, or t
  misc_feature (341)..(342): n is a, c, g, or t
  misc_feature (344)..(344): n is a, c, g, or t
  misc_feature (355)..(355): n is a, c, g, or t
  misc_feature (453)..(453): n is a, c, g, or t
atggtaatgatgaaaataatcagtacaactatcaaagattggccaggcacggtggctcacacctataatcccagcactctgggaggccgggtgtggtggctcacacctgtaatcccagcactttgggaggccaaggcagacagatcacaaggtcaggagttcgagaccagcctggccaatacgtgaaactccgtctctactaaaaatacaaaaatcagtcaggcatggtggctggcgcctgtagtaccagctgctcgggaggctgaggnaggagantnncttgaacctgggangnngaggttgcantgagccaagancatgccactgcantccagcctggnngncagagcaagantccgtctccaaaagataaataaataaatttgcagctaaaaatgatgacatttagcatttttcaggttcatttttattaggctcacttcgtttcacatncatgttcagttaagaaggcattagagttaaggctgttattcaaagctgaataaaatatccgtgaaaaataatcttcacagtatcaagccttggaaaaaaactattaattctgaagaaatctgttaagttctaacatgatgaggttaagaatcatgagaaactgaatgaaattagtgtgaaagaccctgtcttctatacttgcttaatcttttagaataaacattgatttctttagcgagtgagcaaaacaaagtagagccatgacaaatcaaggactccgaccacctgcccagttgtacttttattagttgataacattaggaattaacagcgtggttggagtgtaagtctaaataggtatttctaacaaggtcataagaggagatcatggcaatcttacaatatttgtattctgtaaaattattttcattctataatttattaaacaaggcgttctaagatacattgttgtgaaagttatatatagtctgtatgtgcttattgggggtatagagaaaagaggtatctacctgtgatattaagaa

SEQ ID NO: 591521 - DNA, 276 bp, Homo sapiens
ggatccgccgcctcccaaacatctgacctgattatcgcacccgcacgcggcggcttgccgaggttacgttctcgattcaggtctgtcgtacatgttgttgcctaaagcggtgctgcgcctagcgtgcgcagtgcttgtcctcagctatccggcgcatgccgggagcatggttcgcgtgcgatttcgctcgttcaggcgctgcagccgccttggccgccaacccccgcctgacggccgccgagcgggatatcggcatcgcggccggacttcgaattc

SEQ ID NO: 591522 - DNA, 204 bp, Homo sapiens
  misc_feature (164)..(164): n is a, c, g, or t
  misc_feature (190)..(190): n is a, c, g, or t
  misc_feature (200)..(200): n is a, c, g, or t
cccctgaactcctaatctatggtgcgtccgaattacagagtggggtcccatcaagattcagcggcagtgggatctgggcacagatttcactcttcaccattcaccagttttgcaacctgaaggatttttgcaattatttactgttcaccagagtttacagtaantttctacatttttgggccagggggancagggttggngatt

SEQ ID NO: 591523 - DNA, 153 bp, Homo sapiens
tgaccaggatgaactggatcagctttccaaggctgctgtgacagccctggctctctctacgggaccaagttcaactatgcgcatataaggcaatttatcaagcagtggaagcactattgactggacctacagccaggcatcaggtactccttc

SEQ ID NO: 591524 - DNA, 373 bp, Homo sapiens
ccccagactcaccttggcaggttatgggaggctgtctagaagtcatccaaaagctattagtgagagtagagttcgaagtccttgagagaggattatgatgcgactgtaagtgcgttcgtagtttgagttcgctaggccgaatactaatgatgattgctcgtccgtgggcgacttatgacaatgactgcgccggttaagcttcagggggtttggcttagaatggctgttactacgaggtgctatgtggctgcttcatgagtatgccatgagcgattttaggtctgtttgtcgttaccgctgattgtgcttgttatgattatgcctcatagggatcgtacgcggaaggggtaggctctgtgtttcgtccgggggt

SEQ ID NO: 591525 - DNA, 1044 bp, Homo sapiens
gagtccccatggccccagcagcaagcccctgcctctctcctgtccggctgctgccccactctgaggcccaggttctcttctcccaagagcgagtgcgttgggtcaaggtcaccccatctggaagctacctagaccccagcaatgttacctgacctgtgacacctttgttcctgtgtcctcctctgtgccgcccatggtgaatgtggcttctctgtctacatggatgcactcccaccacactgggagcttctggggcacaggagtcctgctttacttcctatgttgagcccagggactgcccaagataatgcccagtgcaggaatgtttccaccaggggtcacaggaatggctctgctgccctgggggctgagttggccacctgtctggtgccaccaagttaacaagcaaagcagcatgaaggcagtggctggggaatcaaccctgattatcaaggataggaggcctgaagaaccacatgaagagagtgcccacaacccagaggatctcctggatacagctgtgttaccatgatgtccagtggaagacaccacaaccccattcaggagggacctccaagcctgaaagcctcagagtgatggtttgactcacaccaccagtaaaataacttccaacaagctgagcaagaagaaaaggggaattgtggcaaattgcattttccgaaaatggtcaccttaccactattccatcaagaggtggtgctatggtttgaatgtgtcccccaaagttcatgcgctgaaaactttacgtaaacacaaatgcaatagtgttgaatggtgggacctttcaacactatcgcaagggtgattaggtgctgatggctctgccctcatgaatggattgtcattgttgagggagtgggttcctgatgagagaatgggtacagcctttccctctttctcacatgtgctcttgtccttctgccataagatcatggagcaagaaggctcttgaaagatgccggtcctggaccttggacttcccagcctccagaactgtaagaaataaatctctgttcgatatga

SEQ ID NO: 591526 - DNA, 935 bp, Homo sapiens
  misc_feature (746)..(746): n is a, c, g, or t
gagtccccatggccccagcagcaagcccctgcctctctcctgtccggctgctgccccactctgaggcccaggttctcttctcccaagagcgagtgcgttgggatccagacctcgagtaaccctgtgcgatggcaggccttcaccctgggactggccaagggccctagccccttcatcagaggtcacccatgactctcccgccctcatccgtttctgcacattcctcgccatgcccatctccctcctgcccatcccggagcccaccggactgcacagccagcatcagcacagcctgtcctgctgagtggggctgcctgcagtccatggcacgagatagaggcagaacctggaggcaggccgaggtcgccgtactcctggcacttccagaccaccctgccaccatcctcccttcagtccacggtccagacttcctggaaggcaccttgcagccttcgtttgccgaattgtgagatgtgtttgctcaccggctcctcccgctgagcgtccctggtgtctgacccacctctgtttccttctgtatgcacaggtgtttgtgcatgactgaacgacattgaggaggggacacggtcagtagaaacttcctttaagatgcatacaagctgcggcatagccaaagtgtgtttaccaggagtcctgtgtggggctgggcagggcatcagctgctcttactggggacggatggtcgtgatgcaaccaccagaggtaggtgggcagcgcacccttgnataatagggcagctgggcttcccggcgtgtgaggcctgtccttggtgttcctctacatgttcctggagaacccaggtggctttcctggggtgccctcgtggaaagggttcgtttagccccgagttgcacgggccgggccaaggaggcgcaaagaggggcctctaccccggcagggagtgcgccgagagc

SEQ ID NO: 591527 - DNA, 499 bp, Homo sapiens
tttaaaaaatgaacatttttgtatttactttttttccaaagtaaaattgattcctaaaaattactgtttcagagggtattaacaaaaactttttaatggggggcctagaaaattttaattatatatggggttcaaggtaaaattccaacgccagggctgttttataaaaaagaatgcttttatattatttcatgataaaaattcccaaatttggccggggtcggtgggtcccccccgtaatcctagccctttgggaggctgaggcgggtggatcccccaaggtcaggagttcagaccagcctgacgaacatggagaaaccctgtttttactgaaaaccccaaaaattaaccgggggggggggcacaaacctataatccccgctactcgggagggtgaggcaggaaaatcccttgaacctgggaggtggagggtgcaatgagccgaaatcgcgcccttgccctccagcctgggcaacaaaaaggaaaccccccccccgga

SEQ ID NO: 591528 - DNA, 224 bp, Homo sapiens
ttttttttttttaagggccccccacccctatagtgtgaatgtttattttcagaggatggctaaaagaagaaaaaaaagttggagtaagtgttttggtttgaaagaatgtttaaagagggaaccccaagagggacccaaaaaggtccacccaggttggggggtgtaattagggagggaaggggttgcccccttaacacccctttaataaacagtttacagaccca

SEQ ID NO: 591529 - DNA, 161 bp, Homo sapiens
gtaaaccttccccagttttttttttttatacttaaaaccccggctccccagggcctgggcccttactggaagctggcttcctcttataaaatagctttggccggaaacatagtttttttttaggcagatcccaacaatataatggaaggggagggggggat

SEQ ID NO: 591530 - DNA, 384 bp, Homo sapiens
tcagcaatattacaatttgagcaagagccccataagagcaacatgaattctgctcaagcatcaaagcaccaaattattaaacattattgtgcaaacatagagtcagacagaatggtgaaatcattgatgtttcatgcacaatgccccaacataagtcaacagtttacacaatagatgattcattttaagcacagagacaagttggtgttaaagcatgaagcccacagcaagcagaccatccacatcaatctcactaggcaaaagtttcatcttttttgtgacctaattgaaaatgactgacaacagaataaacaatagccaataccatagacatctcaagtggttcagcttacacaatttttacccaaaaaattatgcttaagc

SEQ ID NO: 591531 - DNA, 871 bp, Homo sapiens
acaaattatttattagaagcaagacaaaagtttaatgtcagcttaagtgcttaaatatatcactgctgaccagaatcctgttatttttactctgcatcataaaatttcccatttctgcattaaactaaacagaggaggggggtcaagtgatacttagactacttggcacacacaaggaacaactgattggcaggcagtatcgatctttatgaagagaaagctgaagctttgaacaaccttttcaaaccttcttctagattacaatccaaatttttcaagacttctgatacatgcttcttccaaaggtgaaaagtaagatacgacaagtaatcacttgctctgctgctgacttacagactacggcattactccagtcgtgcactagccccttggtaacaacgtgcccacttatatactattttacgatggcttaaacttctgtggttacaactaactggtacgttattatactacgcctgcatagaaaccaagccatatactccaacactatattactaacaactacttaactctacttcattgatcttctatctcaacacagcgcaataacatacacaaaaatgacgtttccattccaagatctcaaattatgattcacgccacagtcaagttgtcacagaaggccaagtagccatttatattaacaaagtaaaaggcgtttctgtgggtcttcggtaaatttaacatcgggcttccaaacatggtactcgaactggtcaatttcgaacgctgcaaacgggattaaggcacctgaaccacaccatttagaccattgtcaaggcccctttacccgccccaatgtaacagtaatatacttggtaaacaacagtacttgtttacggagacttgg

SEQ ID NO: 591532 - DNA, 305 bp, Homo sapiens
ccggattttagttagtctttaatataactccaactttttaacggtaaacaaagatgtacgtacaaaacatcaaaatacgttaccagtagttctaaacagccatactactcaccgtgccagaacctgaggctcactcacattttcaggaaacataattccctctacttcagtggaatccatgttctggcagttggaaggcacacgtgacccttaccttgtgcaaaatgtatccactttatctcgaaagcagctttcttttctgtcccttccttggcattttcaagaacccgttcctttcccttttt

SEQ ID NO: 591533 - DNA, 557 bp, Homo sapiens
  misc_feature (134)..(134): n is a, c, g, or t
  misc_feature (166)..(166): n is a, c, g, or t
  misc_feature (370)..(371): n is a, c, g, or t
gtgaaaggggaagtgcggcgcccaaagatggggaccaggttcacatgccctcacccattgccgtgattaatgagggcgagcgcttgggggatattgtccccctgggtgtgaccaatatgacatcccgtgacatngaagaaaagggtttccgcatccttaagggaangacactcatccccaccctgtcatgggtgttaaaggatgaggcggtttgggaaaagcccttccgtttcccccccgaacattttttgaatgcccagggccattttgtgaagcggaaggccttcctccctttttaagaaggccccggggaatgcctgggggagccccgggccggaaaggggttttttcttttttttcccctcccggnngaagcatttaagtttttgggggcccatgggacagccccggcccaccccccagggggtttttgtttttttggggggcccacccccctatgagttttgtgttgggccccgttaaaatggggtccctagtccccagccggctcccaagccaagggttttaatgtccaaaaaaacaatggggtggttcca

SEQ ID NO: 591534 - DNA, 275 bp, Homo sapiens
tcgtgatctagaggatcccgaaacctaattacgcacaacgaaagggtcttaattcacttagagttgtggatatcctgataatcaatttgatgtgaaaaaaatatagatctgaaccacaaatcttacaatattaataagcaatgagaatttggggtcctaagcaaatcccaagatggcatttgggggtttcttacaagatccttgggcttagaacctctttagaaaatcactatgatgaacgaagtgattgtcaattactgtattaattcttcccc

SEQ ID NO: 591535 - DNA, 165 bp, Homo sapiens
tatcctatccaaccgaactaacgcggacacgggacacctaccctcagaacttcaaaggggcaagatcttttttccttcactgattgctgaaaccaagagcacaattcccattgagagaaagatctctgcgctggaaactaaaacaaattgagcattccttccggg

SEQ ID NO: 591536 - DNA, 1380 bp, Homo sapiens
  misc_feature (1)..(1): n is a, c, g, or t
  misc_feature (933)..(933): n is a, c, g, or t
ngcgtttgtcagcgccctgggttcatgttgttcaaggagtatacttgtgggttgctctttgtgaatactggggcgcacgtgttcacggcctttttcctcctggggtttccacaagggtggtcgccgaccccccgtgtggtgtgcgccaaccatttgttctaagatgttgtctccccacacagtcccacaggtgggcccacaccaattgggggggcccggaagaaggaccggccccctggtgtttgtgaccccaggatagggttccccccccccggcgttgtccccttgcttctacccatcgccgccccgtcattcgtcttgtttggagtgttacccgaccgtcgtcgctgggaccacacccaactggcttctcatgtgggtgggcacccaaactggggagagcgctcgttaggtttaagaggtgttcttttagcttgcgcccctgggaaccgaggccctagacttgggaggaccccttttgggggacccaaccctctgttcctagggaacgcggcccctgcacattggtgcccggagcccaaatttcttcggacgctgtaatatttagaagattccccgcgggatattgtcttgagacaccacgatttgggccagaatatttggggaatttgcggaattcccctggttggccctcacacccccaagacttgggttatatggaaagagaggtctcctctcgaggttcctcattagaagagaattgtggagcaccgagattgtgggtataaatatcgcctcgccccactcgagatgtctcggagaattcacgccacactgagaaaggccccactgtataaacttcgaggagacgcacactttggctcgttgagtttcacacacaggaatatgagacccctctggtgagcacacaccacgcgggcttgcgcctcgagacacccatccgcacacacncctctctctctcgagaaatgtgagaagtgtgagactgaccacatgcttctttctgagacactcacgaactcccacgggcgcggacacacacagttgcacaaaggtgtggcacaccctgtataactgctcacaccccccacaaatgggctgagatggggagggctcgtctgctctttcacaggggcccgctggcttgtataaatatacctctccacggaaagaggcaccacttgcccacacctcttggaaaagggagaggaatattgcctcttctccctctggttgttccccacgaagttttaaggaaaaattctgttaagggagatgggtaagatgtccaactgccttaccccgtcatactgatctttagccctccgattgatttttttcacccccagctctgtttaccatccgcagaggtgttcctgaagaaaattctgttccaat

SEQ ID NO: 591537 - DNA, 271 bp, Homo sapiens
tctgctctagagccttgttactcgacttatttgaccgatggagcttattagaattgcataataatcaggtcccactccagccctgtgcaacatgagtaagattctgtctcccaaaacaaagttcggggagtgagaatccttaacattttgcacactggcttagatcaatgtttctcttacttcatgtgtgctggacttacctgtggatgttgttaatatgtatgttttgattggtacattctgcattggggcctgattattctgcatttct

SEQ ID NO: 591538 - DNA, 611 bp, Homo sapiens
accctctgaatgtgtttatgtgtcaagtgcctaaagaaccgtagaaacagtacatcaaaagctcttatcaaaagaacaaactgattgaacattcagcccagaaacaacaatatgcatttacattttccatcatgggttgctgggcactgaatacccttaacaacctcaagcagatgtgcagtggggcacaccatgtctacatggcatcaagcaaagttgcatcccctactgacttatttgtaccattggcaatctaacgtagagacaatgagcctttttacacgataggcccaagtcaagaaaccgttttaaaaaagaaacagcacaacagcgcttaccaccccagttaagatccaccatggtgtatggcccttttcgcacatctaccacaacactttggcacacaggggtgcaaatccgaaccgtgggctcacaaaattaagaggatcggtataacaatagccgatatatcaagctgtcaacacggtgatacctaaccggttaagaaacatataattccccattataaaacagggggcaaaattacacgaagagtcaccgcaaacatatttttgcggtaaacgagatctccacaggtaggtgctaattaa

SEQ ID NO: 591539 - DNA, 544 bp, Homo sapiens
  misc_feature (163)..(163): n is a, c, g, or t
gagccactctacctggcctaatttaaatttaaatagccacatgtggatagtagctattgtattggacagtgcagctctacaagttggttgaacctacaggaataccaccagagcatgaaactggcataagataagaggatgagaggccagagtctttgtagtnagtactcttaagagtccatgagacaacagatgcaaagattctgttttagatttaaatttagcacaggagaggaagatactttagagtggattgaaaggaggtttttatttaaaaatacacctgaagttgtggtaggagtggctaaacaaatgattgggtgtaatgtagcaacaaagcaaattccaagaggtggtgataggaaagttaataagatgatcgctggtatagcattagatacttaactatttttatggaatgaccctgcaaaagccctgtactgatgggtagtcccagacagtcattgacattgaagagatgacaccttctacttatttttaaggaggaatatatatttttgaaggaatagaagacttctaagct

SEQ ID NO: 591540 - DNA, 111 bp, Homo sapiens
actcaagcggtgtcgcccttccacctggtcatctccactgagtcgctggactgtgaaggtcaacaataatggccgtaacagggcagttcattccaaatccagcactgctgt

SEQ ID NO: 591541 - DNA, 136 bp, Homo sapiens
ctctgtcttagataggtgcatgtagtagtcttcagtcccatcattatttccaatgcttgtggtggtggcctctcttgctgattgccatttctatctccttggatagctctaagggaactgccattgggccaggggg

SEQ ID NO: 591542 - DNA, 477 bp, Homo sapiens
gggaaattcggccataatggccgggggaaagtttgacctgaagaaggagggtcccctttttaggggggattaaaatttttttggggaagggatgcagttgacttacttgcaaacttttcttttgttggcagatggattaatcccaattactgttataagggttttaacaccaccattaaactttttcccttaccttaaattagtcaattaattaaactgaagtaacgttggcctgaaaaaaaaaaaaaaaaaaaaaaaaaaaaaccttgtgggccgcttgggccaagcgaattttagattgggccaggttaatgattgcggccgaatttggggttaattgggccaattggccttatggggggcggattaccatttaatgggccgcggtttaacaaggtcggaattggaaaacccttggggttcccaaattaaatggctttgaagaaaatccccttttggcaagttgccgaattacca

SEQ ID NO: 591543 - DNA, 269 bp, Homo sapiens
ttgggagtactgtgaatgtgatcatgtgctcactccagcctccacctcgaggctcgagtgatcctctcaacatcagtctccctagtagctagtgatcacaggagtgtgccaacaccccattcattacatttttactgttttatgcgcagatttgagtcatacctatgttgcctcatggctgagcctcatcactcctagggtctcaaatcagtttctcaccatcctcgggctctctcataaagtgccagaatatatgcacgtgctcttat

SEQ ID NO: 591544 - DNA, 1144 bp, Homo sapiens
ggcagtactatacggtcttaggtagcgaggctgggtggctggtcatggaggcctacgagcaggtcacaagggacccctaagctgaaaggcggtcgcacgagctggtgagtgaccaatgcggaagaagacaaagaaggacacagacaaagctggaaactcctggaagcaatgggaacgagcaaaaagaacgaggaggagaagcggcgcggctggacaagcggaccccggaccaggcttggccttcgagaagaatgcaggagaagcggcaaatggaaaggatcctaacagaaggcatacaaaaaccaaagcagagagtggaggaccttcaacagacacctggaaccaaatcacggagccattacgacattccacaaaagtcagctggacgaagtagccgccatgcccccagatatggagcagcatcgaggtgtacgcaaaaggacacaactggggtagattgtgtgataaccataggatatattcttggaaacatggcataaacaaacccataggcatctactgctacagaacgtgcgtagatcgaacgactgtgtacaccatcaatacatgaacccttgacatcacacggatacgatcggtcccttagaacgtcagaaaaaggctccatatggcaaacaatacaagagagataccaccgctaacaggaacgggactgggacacgttctcgtacagtacactccagcagcgtaacagcaccaattgggatgatgaaccatgggatcatggtaaaacaagtgtatcagcaacccggacgttgggatggataaagaattcatgaaggagccagacaagacttgtcttactccctagagatggagaacagaagatccagaaagggttaaagagagatagcagcccaatggtagggcatgaagtattgcaaaggcacaggagaggaaccgaaaagttgggcacagcattaccatggattcgtattaacatatggggctactgctggagcccatagagggcctaagggaagagacgagtagaagctaataggagacaacaaaactagtccatcaaacaactgggacagacaaagggtaacgggggataaggaacaaaacacgcaaagcagaaatggagggacgaactgttcgcttatggaaggggacacag

SEQ ID NO: 591545 - DNA, 233 bp, Homo sapiens
ttgacgagtcctcccctgacgcactactgttggaggcaaaagactgagggtcatgatcaactcagtataccactggaggttatatgagtaagcagcaaactgtttttcataaatgcagaatgttggcaaactgacagactgcgtatgccacccacgaaggaatgctgaaggcagtcatgcccaacagcacagtgtttcttcgtgattaggtacatctgcacagcctgttagta

SEQ ID NO: 591546 - DNA, 236 bp, Homo sapiens
atcagcaggcagctagatataagataaatgtatatgtgctgtgaggaaaataaagcaggttgatatcataaagaggtgattcatggccaccgatagggattactttagtattgggcagtgagagattccctttccagaaaggcgacccagcttgtgaatgcattgattttgggtgtgaggagaactatttcaggcactgagtcacaggacgagactccattctcaatataaaaaaa

SEQ ID NO: 591547 - DNA, 642 bp, Homo sapiens
ggtctggctcgttactctacacgggaggaatgggcactgcaatgtacgtggctctggggagacctcatcatcctcatcagtatttggcccgcgtggactgtgatgttcggctaggccatccaggtggggtccctgggcatcttcccactggtctatgccatgccccgctcggcctcagtaccggagtgccgattgtctgcctcgaattgccagagcaacgaccagggacatggagtccgagcgggaggctggtatcgtcacgctggtgcagtcctcatgcgggcccaggttctcctacatgtctctagaaggaaattgctgccttcctgccctacctggtcttcaacatcctggtgcacagactgcaccatcagtcatggcgagctcccccgtgtcttaccattcccatgggcttgctcccttgtagagacagtttctgaagccaggccgttcaatgaaagctgcccagaggactgcgaaggctcgaacctcctgctgggacttttctatgtcttgtggcatcattctggcgaccagcgaggcagtcttgccaaagatttaaggggacaagtagctccccccacgacatgtctccctttcttagaatatattaaagtcagagtctctgaggaaggaatgtga

SEQ ID NO: 591548 - DNA, 730 bp, Homo sapiens
agcgaaggaaggagagaaaggaaagaagaaagaaggaaggaaagaaaggaaggaaggaaagaaaaaagaaggaaagaaaggaaggaaggaaagaaaaaagaaagaagaaagaaagagaaggaaggaaggaaggaaaaggtaaatgaggaaatcctctttctcttccttctcccagtccagcaatagggaaggctgctttgtatactgagagaataaagttgtaatttaaaatgatgccgagaacagaggcctggatcgttttactagtgaggtacagtgcgtgcttagaaggcacgcactctgcaactctgtccttacgcagaagactgtcagcagaagtttagggacatatgctcaagaggagatctcatgactgcattatcagtggggactcattaagctgccctggagacatttttgtgtcatttatatcagtctacttcctggctgcattttgcctttgatacgtattttctacagagagtgggcggtatttactaaatctcaacatctgctgctcttatggatatttagtgatgattttttccatttgtattgatctccaaactctttcatgaagagcacactagtgtatacaggggatttagtggtcatgatggtatctcatagagtagacctgaagggtataatgcttttaattaaacaatgagtattataatatactctgtgtgtgtgtgcgtgtgtgcgcgtgtgtgaaggggaagaggaa

SEQ ID NO: 591549 - DNA, 820 bp, Homo sapiens
  misc_feature (819)..(819): n is a, c, g, or t
cacactgtggaaggttgttctttgctctttgcaataaatcttgctgctgctcactgttgggtccacatgcttttatgagctgtaacactcgccgcgaaggtctacagcttcagtcctgaagccagcgagaccaccaacccaccaggaggaacaaacaacttcagacgcgctgcttaagagctgtaacactcaccgcgaaggtctgcagcttcactcctgaagccagcgagaccacgaacccatcaggaggaacgaacaatccagacgcgccgccttaagagctgcaacactcaccgcgaaggtccgagcttcactcctgagccagcgagaccacgaacccaccaaaaggaagaaactccggacacatcctaacatcagaaggaacaaactccggacacgccacctttaagaactgtaacactcaccgcgaaggtccacggcttcattctttaagtcagtgagactgagaacccaccaattccagacacacagctacagcaagccctctttgcttctctgggccagctctctggagctgaattgtggtggctggtttgaggagctgaatgggcatttctttctctgaatccagtaggtctctgctgtattatagatcagtgtggaatgcagctctaatttaaggagctcaatagaacatgaagtcgcgtatttgcagatcgtggcagtgaatgtttaagaaaggacgtgctggagatgttgaagggaggagtgtgtaacagattgacatggacgtgcggagggaaattaaaggggatcggaaggggggagcgcgttattgttttgttgttatttttttgng

SEQ ID NO: 591550 - DNA, 103 bp, Homo sapiens
ctcgctactccttatggccacgcatgaagcatctgtagataataccgacattaaaactttaatgagccgggctcgccagcttacccttcctgtgcagagatgt

SEQ ID NO: 591551 - DNA, 274 bp, Homo sapiens
tcaaaagcaattattaagtaaagtggtgaaagaatggctagtccatagacacagcagcccatgggctgctctgtttatttttatggctatttcttgatgatatgctaaacaaggggtggattattcctgcctcccctttttagaccatagagggtaatttcctgacattgccatggcatctgtaaactgtcatggcgctggtgggagtgcagcagtgaggacgaccagaggtcactcttttttttttttttttttggaaacgggatttgccgag

SEQ ID NO: 591552 - DNA, 228 bp, Homo sapiens
gtgaactgctattttttcctgcaatgcactggtctttggtttgggaaatgtgctatatttggaccgtgcttttaacataccccatggttttaaataactacttttctttaaagttagatgtaacattttaatttaaatgtcatccattaatcaggcacagtttgttaggttgtgcgagcgttaaagctccccagttttaggcctggagaccccttctgtcgtcttctc

SEQ ID NO: 591553 - DNA, 816 bp, Homo sapiens
tgtgtcacttgcataaggctacaggtgttagcctggactaaaggcatccttgtcttgctgagctattcacctcagatagaaaaggatctaacgggaagatcactgtagtttagtccctgttgacctgtgcacctaccccttggaaccatgtctgctggtatttctagattccacaggtcatcagatgcctgcttgataatagtactataacagactacagaaacaaacgtgtccatcttcttcctagttgtacagtcgtgtgccatggatctgagtctgtaccagtgaccctacataaggctggatggcacctcaggctgagggccccaatgtatgtgtggctgtgggctgtagggctgggacgtgtgtctgctgagtacacggacacacgacttttacaaagattctaacatgctcatacttctagagatgaacacacttaatgatgaaatctcagatctggatcaagagtccggactttctaacatgttccttgacttggggggcgtgtgctgacaacttaggctcaggtgccttaggcatcttgttcgtaatcacagtgtgtgtcctatgagtcctgcacctcacggtccctctgtccagcaatccctttgctccctgagaccctactgaagtggctggtagaactaggggcctgagtggcaggattatcagtatcacgatctgccggatgcccttcgtggcttcattctggaaactgtgtgcccaggctgcttgtcttaagctgcccacatctgcctgggggtgccttcctggcctgtccttcgcacatcagtcctgctccccacggcgtcc

SEQ ID NO: 591554 - DNA, 533 bp, Homo sapiens
tgagatggggtctcactagctcaggctagagtgtagtcacagctgcactacacagcaaaatcacagctcactgcaacctcaacctccctgggcccaggtgatcctcccacctcagcctcccaggtagctgggactacaggggtatgccaccaagctcagctaatttttaaaaattttgttgtagagacagggtctcactatgttgcccaggctataataaagcagagttttggccaggcacggtgaatcatgcctgtaatcccagcacttttgggaggctgaggcaagaggataccttgagcccaggagttcgagaccagctcgggcaaccacagggagacctcatctctacaagaaatttaaaaattatctgggcatggtggcacatgcctatagtctcagctacttgggaggctgaggcaagaggattccttgggccatggacgttgaggctgcagtgagctgagatcataccactgcattccagcctgggcaaccgattgaaaccctgtttcaaaaataaataaataaaa

SEQ ID NO: 591555 - DNA, 309 bp, Homo sapiens
  misc_feature (15)..(15): n is a, c, g, or t
  misc_feature (135)..(135): n is a, c, g, or t
  misc_feature (171)..(171): n is a, c, g, or t
  misc_feature (176)..(176): n is a, c, g, or t
  misc_feature (217)..(217): n is a, c, g, or t
ggagatggccaaccnccccgtgtgttaatgcccccctagacccttacagtgggataagatgtgtggatgtagaagacagtgatattgattacccctgaaactgtgtaggcttcagcctagtatgggtgttagtgnctttgtttttaattaaaaaattaaaaagtaaacaanaaaancttaaaaatttaaaaaggcttatagaattaagatataaagnaaatatttttgtacatcttacaatgtgtgttttaagctaagtgttatttcaaaagagtcaaaaaattttaatattttaaaagtttgtgaggt

SEQ ID NO: 591556 - DNA, 137 bp, Homo sapiens
tcccaagatgagaaattggacctgtgcactactggtgggaatgtaaaatgatgcagctcgtatggaaaacagtatggcagttcctgaacaaattaaaagaagagtcataatatgatctagcagtttctcatccttgg

SEQ ID NO: 591557 - DNA, 219 bp, Homo sapiens
caaatatattgaatggaaggtctaccaaaaaaaagacatggatgaaagacgacgacttcattgaacagaaaacacaagaaagtcaaaaaaagaagcaacaagatgattctgatgaatatgatgatgacgactctagcagcctccaacttcatttcaagccacagccatgtatcaacctacagacaagggtaatattcctaccaactggacacagaccca

SEQ ID NO: 591558 - DNA, 235 bp, Homo sapiens
acaccattaagtctacggcaggaaatacacttctcgcagccttcttcgtgatgtgggacaacgattctggggacctacatgccctactcgctcgagagagaggaacggagggaggtttcgaagcccggccaatcaaactcaagagctgatgaatcatcgatgccttccttggattccaactaaaacatttgttttgcattctacttatatattgcagcgattgctgataaataag

SEQ ID NO: 591559 - DNA, 471 bp, Homo sapiens
  misc_feature (7)..(7): n is a, c, g, or t
  misc_feature (138)..(138): n is a, c, g, or t
  misc_feature (178)..(178): n is a, c, g, or t
  misc_feature (239)..(239): n is a, c, g, or t
  misc_feature (246)..(246): n is a, c, g, or t
  misc_feature (268)..(268): n is a, c, g, or t
tctaganatccaggtgtcatccccccaagcatctgtggatctacacaccttatgtcatactactaccatctcatgatggatcatgggcatccaggtaacacagtcaggtcttcccccaatttggtttcatttctatgnagattcctcttaggtgataagggggtcctcctctagtgtngtcttggttggtaacaataccagctgtcatgcaagctcagggcctgcgccttccactcaanctcctgncgacctgcagcacactctctgnaccgcactgtcatcggtcttctgcacaaccttggaagtaacagtgtgtccccagccttgggggactttgcacatgctgtttcctcctcctggaggtcttgtttccctgtcgtatctagttaacttcctggtcatcctattatatttcaggcactgaagtcactttcctcgggggggttttgctttaatccctgcacgagtaag

SEQ ID NO: 591560 - DNA, 447 bp, Homo sapiens
  misc_feature (37)..(37): n is a, c, g, or t
  misc_feature (71)..(71): n is a, c, g, or t
  misc_feature (283)..(283): n is a, c, g, or t
  misc_feature (299)..(299): n is a, c, g, or t
tgcgggaagcggtttatatggcgtggtaggctgattncatggtcgaacagcatctgatgcaccttttagtngtccagctcatctgatgccgacatgccgctcagggtctgcagcgactggctgaccgtttggtggcccttaaagttgggtgggaggtggcttatgcggtgcatggtctccatcagctctggcaggttgggctggatctcatccatggggcggattttcaggcgcacttgttcatgaccgttatgaagagcgagaccacgtttgcaatgcagcngttgaggttgcccttntggtccttgatggtgatgggccggtcctccttgatccgctccatggccagcgggcagttcaggcggaacttgcggcagattttgtcaatagagctgatttctgatctctggacctgcctgaaggcagctttgtattggaccaggagcc

SEQ ID NO: 591561 - DNA, 133 bp, Homo sapiens
gcggccgcctactactactactgctcgaattcaagcttctaacgatgtacggggacatgaaaagttatttatgctataaattttttgaaacacaatacctacaataaactggtatgaataattgcatcaaaaa

SEQ ID NO: 591562 - DNA, 182 bp, Homo sapiens
tacccctcagttcatttcaaatcaccaatggtcagtcgacagatatttccaaaaagaatctgttctaggaccacttgcgctgagagcacacccgggggtcacagggcagccaccggggtcaaagggcagccatcaggtactccccatggaagggcttgcggccaccagtcactgcaaccccg

SEQ ID NO: 591563 - DNA, 238 bp, Homo sapiens
ttcactcactaagtggctaggatacagtgccagtcttggtcagccactccaggattttcattcacagcgaagtcaaatatctccaatttttcaaactaagttgtaaggcttgaagatgagagaatatactccaatactgtcttataaataggatctagattactactgaagtgtcctccattcatgagttggcaaaatcttcagagtgactgttggagcaaggagcctttcatgtgct

SEQ ID NO: 591564 - DNA, 216 bp, Homo sapiens
cctgcatcactcaggtccatggccggctgctgtgcccagggaggcaggtacaggacccccgggagaaggggcactgaccgagggcccagacagcaggaggtaagcagaggaccctcaccaggtcatagtaggcccataaatcagctccaggacattccgggcattgtcaaactccggcttccgctcctcttcagcttcttctcggagataatcctg

SEQ ID NO: 591565 - DNA, 545 bp, Homo sapiens
tgacaagcaattcaatggcatttaaacctggaactctgctaatcacccatgacctactgatctacaagaggtggtgggtttgtgaggaaaactaggtgatgagaggagttaggaagacagtagctcctatttccttttccttgcctatccctccccacaaggcatgagatttttcattcttacattttatttcctttgcatctttcagtttcattcatcttggtaattactttgccttcctgcctgctcctccttcctttgctcctgccactggggaagaattgggcaagaaacagactatgctgccagatacagaaaatacggaagtggcagatagctgttaatgacttctcaaattcagagcattttacacccttctacgcccttttagtcctagagtactcgtcttttggtgagtggcatggagggggagtttttgcctgaaggatgatttatttttgtctggcttgctgttctctttacctgtttttttctagtcgaagtaatggcatcgtggagagcttgggtatctgagttgttaactt

SEQ ID NO: 591566 - DNA, 170 bp, Homo sapiens
tgggccctcggctcttgcctgcttctgggcccctcggcttcttgccctgcttctgtgccccctcggccttcttgccatgcttctgggccccctcggccttcttgcgctggttctagtggccctctccctttttgccctgattctgggccccctcttgcctttttggggct

SEQ ID NO: 591567 - DNA, 843 bp, Homo sapiens
  misc_feature (214)..(214): n is a, c, g, or t
  misc_feature (255)..(255): n is a, c, g, or t
  misc_feature (258)..(258): n is a, c, g, or t
  misc_feature (263)..(264): n is a, c, g, or t
  misc_feature (287)..(288): n is a, c, g, or t
  misc_feature (327)..(328): n is a, c, g, or t
  misc_feature (366)..(368): n is a, c, g, or t
  misc_feature (380)..(380): n is a, c, g, or t
  misc_feature (394)..(394): n is a, c, g, or t
  misc_feature (404)..(404): n is a, c, g, or t
  misc_feature (434)..(434): n is a, c, g, or t
  misc_feature (499)..(499): n is a, c, g, or t
  misc_feature (511)..(511): n is a, c, g, or t
  misc_feature (513)..(513): n is a, c, g, or t
  misc_feature (519)..(521): n is a, c, g, or t
  misc_feature (843)..(843): n is a, c, g, or t
ggttagtctccggcgagtgttgcctgggctggacgtggtttgtctgctgcgcccgtcttcgcgctctcgttcattttctgcagcgcgcagaggatggccaaagcagatctatactcggacaagtacttcgacgaacactacgagtaccggcatgttatgttacccagagaactttccaaacaagtacctaaaatcatctgatgtctgaagaggngtggaggagactgggtgtccaacaggagtctaggctgggtncanttacnntgattcatgagccagaaccaatnntcttctctttagacgactcttccaaaagatcaacaaaanntgaagttatctggggatcgtcaaatctttttcaaattnnntgtatatgtgtntataaggtagtatncagtgaatanttgagaatgttacaaatctttcatccatanctgtgcatgaggtgtattcttcacagaacagagctcagttaaatgcaatgtgcaagtaggttacntgtagaatgttnangataannngttcttccaatcagttttctcttaaagggcctgttgagttactgaaacagttactttgtgtccaataacggcgatgtgcttctaaaacacaacaaaaacgaaacaaaaatttgggggggcgcggcccaaagagttttaaacatcttgtgggcgcgggcccgagtggtattgacacggacaacttgtccaaaaaccgccaaaagtgtgggtccacaaaaagccgggcacgggtcaaaacaaagcgtgggctcggttcacgccgctactccctctgcggaaaacacaaagacacgccacacaacacccagcacactcagcaaan

SEQ ID NO: 591568 - DNA, 396 bp, Homo sapiens
  misc_feature (329)..(329): n is a, c, g, or t
  misc_feature (346)..(346): n is a, c, g, or t
ttcaataccctgattactcaatccatgccccccacacaccaccaccaacaccacaacgtggcagggatggccccatgcccagctcccggcacacctgacatgaacctaatgtgctgagtcttgtaagagcagtttccctatttctgttcctccctcctcactgtgttagcctccttcctcccagcctcactcacctcgaagctccatacttccaaagcctgcttttagtgccacctcctccaggaagccttcctggattccctctgccaggatgcttctaagagtttccagagcaatccatctgtgctcagctctctgtttgctccctnaagtggacttacagatnaaaacatagattctcctctggttggttcctggcccagtgggattgacgta

SEQ ID NO: 591569 - DNA, 126 bp, Homo sapiens
gtttcggttgctgtgttataacctctctgaggggagcttcttagagtcgcaggagcctggacctaattgttttagagagctctttggacacatgtgtgcaactctaagctctaaggtgtctctata

SEQ ID NO: 591570 - DNA, 148 bp, Homo sapiens
actaacacgtacatataatataggactcaaactataacctacactaatctagctgcggtgccgccaactaaatataaacactatatacataccaaacataccactatatggcttacgaaagccgaccagcctagataactaggacata

SEQ ID NO: 591571 - DNA, 514 bp, Homo sapiens
gatgcgtgtggtcgacgtctatagaggacccgcgcgcgagcgcccgaagtccacccagttcagcactaccactcacctaagagttcagtccttatggcctagacagcctttcaaatttacttagagacccagagccctttagcccatcatggcaattgacctctggggattagtgattcccctctggctagggctggtccaaatgcttcctctgtgggtggatataagctgagtttggtttggtttttctttctggtctaacagacagccttgagttcatcaatgcctcacacttgctatgctctccctctccccagcacccagaaatactctccacaccatgctgcactgctgcggatgagggaaggatggtgtcggggcttcaagactgtttttcctacctcttcagtgcctctttcagtgatatgaagttaaaaccaggtactatgagtgctcacctgatttgtggttcttatggaggtgctttgctcgtgccacttggggcgttcgtgcc

SEQ ID NO: 591572 - DNA, 909 bp, Homo sapiens
ggaggggtgtggcctagaccactaagggccgtgacgtggtgccgctgagcttggaccccgaccagaagaaagagattgaaacgatgaggaaaacgaagtgcctaatccccgctggacgctaactgcagggcaagctccccagtgttgtagttgtgtttcggaggccgagaaccgctatcgggcttcctcggactctggccctggaggggggaaacggcgagggagaaggcgaaacgagtctccagtgtgttcttggggcctggtgcgaggccagagaattctctgcaggcctttgcccgggcactgattaaggctgcgaagagacgcaccgggctgcgggcttagtagcttcaggcttctgaagtcagagggagggctgagagcttacacttctggagctccccgggagacggcaactacccaaccgtgtgggtgtgtttgtgtatgtgtcttttgttgagcttcggctggctgtgttattcattcaacaaatatttatcgatcttcggcagtgtgtcagacataccttcttctcaaatcttcacatcaaacctgaattatctccatttaatgatgaggaaactcgggctcaaagaagttaacgtgttctagccaagactgcatagtaagtggcagataaaacctcaaagttgggccgggcgcggtggctcacgcctgtaaatcccagcactttgggaggccgaaacgggtggatcacctgaggtcaggagttcgagacagcctggccaacatggtgaaaaccccgtctctatttacacaataccaagattaccctggcgtgggtggcgggggcgccggtaatccaagctgttccagaggctggacggagaatcggttaaaaccaaggaggtggcggttgcactgagctggaaatcgggcattggatca

SEQ ID NO: 591573 - DNA, 738 bp, Homo sapiens
  misc_feature (689)..(690): n is a, c, g, or t
  misc_feature (723)..(723): n is a, c, g, or t
  misc_feature (733)..(733): n is a, c, g, or t
ggaggggtgtggcctagaccactaagggccgtgacgtggtgccgctgagcttggaccccgaccagaagaaagagattgaaacgatgaggaaaacgaagtgcctaatccccgctggacgctaactgcagggcaagctccccagtgttgtagttgtgtttcggaggccgagaaccgctatcgggcttcctcggactctggccctggaggggggaaacggcgagggagaaggcgaaacgagtctccagtgtgttcttggggcctggtgcgaggccagagaattctctgcaggcctttgcccgggcactgattaaggctgcgaagagacgcaccgggctgcgggcttagtagcttcaggcttctgaagtcagagggagggctgagagcttacacttctggagctccccgggagacggcaactacccaaccgtgtgggtgtgtttgtgcacccagaaatactctccacaccatgctgcactgctgcggatgagggaaggatggtgtcggggcttcaagactgtttttcctacctcttcagtgcctctttcagtgatatgaagttaaaaccaggaacatggaggagacatatttccacctatttctctccataagtataaaagaccataaaagaccatctagggacttcagaacccaaataatgacacaatgttaatttgcaggttctccctctnnctgcacccaccagcaaggaggagaggaagtgtngagaagggangagat

SEQ ID NO: 591574 - DNA, 639 bp, Homo sapiens
ggacgcgtgggtcgagccttggtacaaaaaaaaaaaaaaaacctgctggttgcccagatacctaggcttgcccattttatgcattccagcaaagtcatggggatactatggcaacttgggaatactgggtctgcatcaaggttaatccggtagttggaccgctagtatgttgggaagttattgggatggttttgggaattttggactgggctgaattatggtgggtataaaggtcatgtgtataacctggcaggcttattaaatctgtggcactgggtaagcttaaactgggtccggtatttattctaagagataagtttatacgtcaaggcaattaaattctggcagagaatttggaaccaaattaaaaaaacaaaaaaagaaaaagaaaagaaagagagaaaagaaaaagagaagaaagaacagaaacagagaaaacagaagaaagaagagaggaagaaaagaagaagcaagagaggagggagggggagaaggagagacccaggcggagcacgagagacggcgcgagaaggggggaagaggcgcaggaagagcgacgccgagggaggagggggcggaggcgacggggaagagagcgagacagcggagaagagcgcgggagcgagagcggggagggga

SEQ ID NO: 591575 - DNA, 612 bp, Homo sapiens
  misc_feature (563)..(564): n is a, c, g, or t
  misc_feature (597)..(597): n is a, c, g, or t
  misc_feature (607)..(607): n is a, c, g, or t
ggaggggtgtggcctagaccactaagggccgtgacgtggtgccgctgagcttggaccccgaccagaagaaagagattgaaacgatgaggaaaacgaagtgcctaatccccgctggacgctaactgcagggcaagctccccagtgttgtagttgtgtttcggaggccgagaaccgctatcgggcttcctcggactctggccctggaggggggaaacggcgagggagaaggcgaaacgagtctccagtgtgttcttggggcctggtgcgaggccagagaattctctgcaggcctttgcccgggcactgattaaggctgcgaagagacgcaccgggctgcgggcttagtagcttcaggcttctgaagtcagagggagggctgagagcttacacttctggagctccccgggagacggcaactacccaaccgtgtgggtgtgtttgtaacatggaggagacatatttccacctatttctctccataagtataaaagaccataaaagaccatctagggacttcagaacccaaataatgacacaatgttaatttgcaggttctccctctnnctgcacccaccagcaaggaggagaggaagtgtngagaagggangagat

SEQ ID NO: 591576 - DNA, 425 bp, Homo sapiens
  misc_feature (376)..(377): n is a, c, g, or t
  misc_feature (410)..(410): n is a, c, g, or t
  misc_feature (420)..(420): n is a, c, g, or t
ggaggggtgtggcctagaccactaagggccgtgacgtggtgccgctgagcttggaccccgaccagaagaaagagattgaaacgatgaggaaaacgaagtgcctaatccccgctggacgctaactgcagggcacccagaaatactctccacaccatgctgcactgctgcggatgagggaaggatggtgtcggggcttcaagactgtttttcctacctcttcagtgcctctttcagtgatatgaagttaaaaccaggaacatggaggagacatatttccacctatttctctccataagtataaaagaccataaaagaccatctagggacttcagaacccaaataatgacacaatgttaatttgcaggttctccctctnnctgcacccaccagcaaggaggagaggaagtgtngagaagggangagat

SEQ ID NO: 591577 - DNA, 1227 bp, Homo sapiens
gagacgttcttcgccgagagtcgtctggggtttcctgcttcaacagtgcttggacggaacccgtgtgctcgttccccaccccggccggccgcccatagccatgccctccgtcacctcttcaccgctaccctcggactgccccaaggcccccgctcgccgctccagtcgctgtcgcagccaccgccgccgccgccgcctctccttagtcgcctgccatgacgaccgcgtccacctcgcaggtgcagccagaacataccaccaggaactcagaggaccgtcatcaaaccgccagatcactcctgaagcatctacagccatcatacgctatacccttgtccaatgctcttaactacatttgaaccgtgcgactgcactgtgcgctaggagacgaacatttgcccaaacttaacattatccttcagccaactctccattgcagcgacgaaggcgcaaccactgcctagacgacaacttggactgaccgccttgacacgacacccacaccgacgagtggcactgaaatcctatcccattacagagcattactcccactgaaaacccaagcacctgatgaactcgccccggacaacagaagcggggactgcattttgcaactggtatgtatgtggccattcaccctttcggcgaaacaaatacactggtagaacttcaagatcatctaacttggaatctggcgccagaaactgtgcccactgacactatcaattgacccccacatatagttgtgacactatcaatatggagaaccacatttaaacccctggcacattggaaccatctggcgagacaaggccactaacaacgactatcgggagctcgacccactgtagaaccccaaacattaggcgccaaatgatcgtggagaagcagcacaccagcaacaatctgggcgtattcgggatagcgatacttaactcatcacgtatgatgaagccaaagcgataaactcaccctattggtgctaaccactagttcagatataatgtaggaatgcgtaaactccgtacaggtcgccaaacttctgcctcctcatatactctagtagagtaatgaacttttcattgtgctacacacatgtcaagagagcaatatcttatcagtcaagagtgatcatctgccagcttgatccataagaatgttactagcactcacattctctatctatacttctgtgcagtatgagctgacacctctactgactctaag

SEQ ID NO: 591578 - DNA, 397 bp, Homo sapiens
tcattagttcctttgcatgtgtaagtcaataattagtaaagcttccaaataaaaagtaatctgtatcgtaatggttatgttggaaagaagcttatgtggttaagtgtccttgctctctttcatcagaattatcacctaaagttagatgggaggaataaattctggaggtctgtggtacaacatggtgactgtagttaatgataatgtaccatatacttgaaaattgctaaaagagtagatttgaaatgttctcaccacaaaaaatgatcagtatgtagtatgcaaggtgaaagatatgttatttagcttaacatccccccggttatacaaaaaccaatttttcccattgtatcccttaatgttttcaataaaaattgccccctatacaaaaaaaaat

SEQ ID NO: 591579 - DNA, 969 bp, Homo sapiens
  misc_feature (47)..(47): n is a, c, g, or t
gcttctcgcctaacgccgtcaacatggtgttcatgtgcgcttcgtgngaggttggccggcgtggcctatgtctcctttggaccatcagtgcccgagaaatcggtcgtcgattgtagatgatcatccgatcagaacagggcttgcggtcgatggaccttgcactcaagtgaggagacaggccatgccttacaagtagcatgcaattcactgattgcatcctcaagtatccgcatcagtgaccacgcaaaagtatgtcctgattaaagcctgtgactagaatggcagacatcaatacacataatggggcacggcattagtgattgggccaatgaacgattttgaagcctagtaacactaaggcaaagaccgagagcgatgaacagcaattttgaactcgttgtttaacagcttactgaaggtcctcagaatatgacggaaccagtaataaattcaagatatgtacaggttaaaggaatagtctgtccgaacagtgtgcagcgctcctcctgataagagcttgtcatgcccaaaaaagaagccacgctgggtgtacctaaagggggatagctggctgtgctggcatgcctgtgctgtgcttgtcatgcgatgcgtgcgtgcttagcctagagtcttctcgagcaatacaaagagattcatccccgcgcagcaggacggtaaatacagaaggcttccaagcacacaggagagagtttccttgtcccaagaaaacatgccaacaacggggccagaacaaggcacgtgcacttgcttccgaagaagggctccccgaaggggttccaaaaaagcttcccaaggcaccaagaaatagcaacccttgcgtaccgataaggtcaattcctggcaaatgaaatggcattaagttggcaaaatcacttaaaaacgttaagtaaatgggttacgtttatggaccctgttgaaaacaacatagcaacaagctggagaccgatg

SEQ ID NO: 591580 - DNA, 433 bp, Homo sapiens
gattcccgagcctgctgagatcgtgccattgcactccagcctgggcaacaagagtgaaacttcgtctcaaaaaaaaaaaaaaacgtgggggcccaaaacccctccatttatacccaacggcggtgcctaagaaggtttatttatgggctttttttttccccccgaaaaagggaagggaagggcccccctggggtggcataagttttccctcaggggtttttttccaggccggcctaaaaaggggggggccttttcccccttaaaaaaaaggggctttttggaaggcccccctttacgttaatattcccccccagggggcgggtttttcccttgcctttaaaaaaagggggttttatttccttgggttaaacttcctcccccatttcaatggggtctcattccaccccttttccccgggggcccctccgggtgg

SEQ ID NO: 591581 - DNA, 271 bp, Homo sapiens
tagtcctatgctcagatgtacagattatgaagattttctcccactctgtgggttgtctgtttgctctgctgactgttcctttagccatgcaaaagttctttaatttaattaagtcccaggtatttatctttgttttcactgcaattgattatggatccttagtcatgaaatccttgactaagtccaatgtctagaagtgtttttccaatgttatctcctagaatttttatcgtttcaggtcttagatttacgtccatgatccatctctagt

SEQ ID NO: 591582 - DNA, 558 bp, Homo sapiens
gaagtgatgctcctgcttgagcctcccaagtagctgggactacaggcgcccaccaccagagcctggctaattctttttatttgtggtagggatggggtttcaccatgtcagccaagatggtcttgatctcctgacctcgtgacccaccggcctcggcctcccaaagtgctaggattgcaggcgcgagctactgtgcttggccctgtctttaactttaaacgtgccagctgcggggggatttactacgtaacaaatctcttccctcatatagatccatcccacttctaggtggatgactcatataggtaactcttgtgaaccaggagggtctttaacagccctagactgaaataattcatttctcattgaagttttattcttggtaagaaaatgattcatggtaggaacaaattaagcatattatatgtaaaaggttgatagataattaggtcacctgataaaacagcattatatggctggacccatcattattaatgacctatattttacgtaacagtttatatagaatgcttcaaatatgtatcatgtcggtaagat

SEQ ID NO: 591583 - DNA, 363 bp, Homo sapiens
  misc_feature (1)..(1): n is a, c, g, or t
natcgagaaggaaatgaaatagggcagaagaaaaaatggcatatggctaagaatactccaatagtgacaaaggacccaagcctcagattcaagaaacagtataaattcaaggcagatgaaagcaaactccacctagacacatcatagtgtatctgatgaaaaacaaaaacagaaaaatcagctcagcatggtggcttatgcctgtaataccagcactttgggaggccaaggtggaaggtttgttcgagctcaagagtttgagaccagcctgggcaacatggtgaaaccccgtgtctactaaagacacagaaaaatagccaggtgtcgtggtgtgtcttgtagttccagttactcgggaggctg

SEQ ID NO: 591584 - DNA, 938 bp, Homo sapiens
ttgtaggcgtctctgtgcgcgcggcatccggtggggcaacatagcgcctccccaggggggggggcgcctcccccctctccttgccccccctcacatatttggtggcgtcccctcccgtccctgtcttgagtagactttctcttttggaggccgctcaacagcgagtcctatcttcttctatgtggggggccgacacagcttgtgataccacaccacaggggggtgcgctcttgtgggttgtgcgcgtctgtccacaacaacaacttttgggcgcatctctttctccgccctgggaggggaaccacatccgccgtgttgtgtgtgtgcgcgaaacacacacacacacccccggggactcatgttgtcccgcacaaaacacccacgcgggtgccaaacacgtggtctcacacagaaaggatgctttcccacgcgacactgatctgtgtggcttcttcggtgtgagacgcgccccccccctcatatttaggggagatatatcccggggtaggttcacactgggggccaacacacgtttcctcttttcaagcgctattttcttgcggcggtcgttctcttggagaatagaagttctcttaagatagctctgctatataagctcgcccctcgggggataatactcggggcatattagttctaaactcggggcggactatgtttgaacactttgcccattaggctccgaccactcttttctcgcttcagggatgtggccgtcgcacccgtgagtttatcgttgcccggagtggcacaaattctgaaggtgggatgataaatggtgcgctgttgaaggaaggatgttcttttttttttcttaacaccatatttctgtagaactaggcagaagaaacactttggtttttcggaaagtgaagttttttttgagcccaaattttttatggaaaaaatttttaatttta

SEQ ID NO: 591585 - DNA, 188 bp, Homo sapiens
cgagtggaggtcgaaagggaagggggggggaggacgcttctgctaaggacgttgtgttctttaagatctcatattcagctctgggaaataattatttctctgattatcccttcaactttggagagaggaccagatttctcaacagcaatactgtggtctggaataaaaggatggcctcgttggcctca

SEQ ID NO: 591586 - DNA, 327 bp, Homo sapiens
  misc_feature (11)..(11): n is a, c, g, or t
  misc_feature (72)..(72): n is a, c, g, or t
  misc_feature (83)..(83): n is a, c, g, or t
  misc_feature (86)..(86): n is a, c, g, or t
  misc_feature (108)..(108): n is a, c, g, or t
  misc_feature (112)..(112): n is a, c, g, or t
  misc_feature (119)..(119): n is a, c, g, or t
  misc_feature (132)..(132): n is a, c, g, or t
  misc_feature (136)..(136): n is a, c, g, or t
  misc_feature (140)..(141): n is a, c, g, or t
  misc_feature (145)..(145): n is a, c, g, or t
  misc_feature (152)..(152): n is a, c, g, or t
  misc_feature (168)..(168): n is a, c, g, or t
  misc_feature (180)..(180): n is a, c, g, or t
  misc_feature (184)..(184): n is a, c, g, or t
  misc_feature (186)..(186): n is a, c, g, or t
  misc_feature (189)..(189): n is a, c, g, or t
  misc_feature (196)..(196): n is a, c, g, or t
  misc_feature (200)..(200): n is a, c, g, or t
  misc_feature (212)..(212): n is a, c, g, or t
  misc_feature (216)..(216): n is a, c, g, or t
  misc_feature (254)..(254): n is a, c, g, or t
  misc_feature (324)..(324): n is a, c, g, or t
tcctcctcggnctcgccctcctcctcggctgtggcatcctggtactgctggtactcgggcaccaggtcattnatgttgctctnggnctcggtgaactccatcttgttnttgntctcgcncgtgttccagtgntggntggnnttgngccgggncatggccgtgaactgntcggtggtgggnttgntnagntcctggntggncgtgctgttgcnaatnttggtggcgggcattttttgcccccggggtggggtgtnacagacagccgttttcacattgttggggatccactcaacaaaatagctgctgtttttgttttgggcattnagc

SEQ ID NO: 591587 - DNA, 105 bp, Homo sapiens
taaacctctacactacgcgcaatttcatgcatcctgcagcttcgagccaatggtgagctccttctggatcaggccattggactcctcgtggccatcttccactaa

SEQ ID NO: 591588 - DNA, 870 bp, Homo sapiens
tcatttttcagggtttgtaatcttcccaaagttttcctttgaaaataggataatgggtggaattttcagagtgattacatacctcaacatttttattaacatacaacaatgggaaagttcatcatccatatactgcagtcacttaaacaacagccaattattgcaagattagaattggagatcttgtcctcaaaagtataaattgtcctttgagttatagaaaataatggaattgggatttctacatatcattattatacctattttaaatttaatggcagccaggcatggttccagctacttgggaggctgaggcaggaggatcgcttgagcccaggagttcaaggctgcagtgagctatgattgcaccactgtattccagcctgcacgatagagttagaccctgtatcttaaaaaaaaaaaaattaatggctggtatatagtaaacttaattcactgtgcccattgttctaaagaatttttttaaataaatgtttcattaaactcttatgatttaaccgtgcttgccctttttgccagctatgtggcagtttacggcagaactgctgtcagtgtgctggtaagccctctattcatccctccctcagagccccagtttccagaactgcttatcactgtgcttggtagcccctcctggtattcatccctcttcagagctcagcttctgggttgtatttcctccatgagttttattaattgcccttgaacaaaattgttgggagccgagaaagtaaatatctgcccgttaaaactttggaagaactgccacacgagaaacatactttggcttgtttgaaaattcctcaaacccttgctggacaacaaaacccattgtctttgtgccgtaaa

SEQ ID NO: 591589 - DNA, 1913 bp, Homo sapiens
  misc_feature (340)..(340): n is a, c, g, or t
tgaaatgacgatctctggaccgctaccgcaacattagacacgtcgttgatatgtgcttgcgtgggagatgtacttccgaatcggtgtggtctacttctcacgcattcaaacgtggtagatcagcattgcgtgcgatagacatggttcacaacgagttcgacatagtcccgtcactgtttctgccagtcgagaagctcttgtgatttatacatagactcgcaacgaacatagtttggaaagatagcttttcctgcttctcttcttaaacaaatacctggcataaatgtatataggttaggacgaacgctactgagaactgctgtgactaggggtgagatgnctagagggaaagagcatagtgtggggattatatggtaacagttaaatatacaatacgtggttgtacatagagaggggcagtaaatttgcgcaagtgcattggatggatacacactcgagccacttttctccacgcgtatcatgtcaagggtctttaggttacgtactatactaatgtggtcatacgtagagcgctcacttcgcgcaaggagcgaagcgcaaggcgtaaaactttgcacgcttgggtagcgtaagggaagaaggaccacctataccatttttgtgtctccataacttgtggggaaacactacaaacttgtctttgggggagggttttggagttcacaaagaaaattcgcgggacagaatattgggggtatggttaggttaatgggggtgcgacaatacgtggtcccatttctcggtcgtataacggccgcgtaagttcgtctaatttacggttggcgcaataaaggaaagcgtaataaaggcaaactgcggcacggtatataaagaaagaccccagaaaaaaggaattgtaaagttctgttgcatagaagctcctctggtaaacacccacctccataagtaggtcactaactaagggcggtttaatgcaacttcgacagagtagcgtttggctaaccaacgggcgccttacccgagctggcactgagggcaaggcgtactttggcacctccaaagacgcgtggaagatcggacatctgtactgttagaacgaaaatttggggacaccggcacatagtttgcccccaaataaattaggcaactcattgccaggagttacccctcatgatatcaccaatcaaaaaagggttgccgtcccggggcacacacacgtcacacacgacgattgtacagcggcacgttgccagtggggcacagaaattttggcgcgaaataatgcccatcatgtaagtgccttttggagccccatcgggtcgcaagtgaatcttgccgcatggcgcaatttgttttacaagccacacgagggtagcgtcctcacatatactctctagcagcaccgttgtgtggctacacaggaatgtgtcgaacaaccagtgtcagtagaccacgccgacggtcggcatcttatctatacgaaatgggctcccaagaggggcggtggcattcactcatatagagcaccctttctggggaaagtgaaagcaacgatacactgctgcgacctaagtcagagctgtctttgtaacaacaccacgctagaggggcgtgccacccaggcaacaattatttgagaggggggaacgatcccccactagtttgcagcagaaccagtcgtaagatgactgttgcaaacaaggagcaaccgaggtattcatcaacgtagcagtaggtacccaagagagaaacgtggtatctcccatgattggatgcagaactgccctggtgtataccacaccccgtgggaatgatgggtctacgctaaagggaggaagactcgacactccttccttgaacaactacatgcacgggatggttatcacacaacgcgtggctgtgtcgtacttctgcaccgacgctcctcacga

SEQ ID NO: 591590 - DNA, 199 bp, Homo sapiens
  misc_feature (1)..(1): n is a, c, g, or t
ntaggtgtacgcccatattgtttctggagttggttcctgctggtgggttcgcggtctcgctgacttctagaatggagctgcacattagcccttatttcatctgaatttcatcacatgcttcagagttgtgtttaagtatttgtttgctgtgtcaggtacacagcaaataaataaatacttaaaaactgatttttaaccc

SEQ ID NO: 591591 - DNA, 176 bp, Homo sapiens
cgtcgacacaaattctgccagacctgggcagaccaaaataatggtgttccaaaaaaaggtccagttgccaggaccacaaatacaaattccatctagacaccattgccctagagcacaccaaaaactatacataccttggcctaaacatcagagccacaggtaacttccgtcgacgc

SEQ ID NO: 591592 - DNA, 234 bp, Homo sapiens
  misc_feature (9)..(9): n is a, c, g, or t
  misc_feature (15)..(15): n is a, c, g, or t
  misc_feature (74)..(74): n is a, c, g, or t
  misc_feature (101)..(101): n is a, c, g, or t
  misc_feature (177)..(177): n is a, c, g, or t
  misc_feature (180)..(180): n is a, c, g, or t
  misc_feature (194)..(194): n is a, c, g, or t
  misc_feature (226)..(227): n is a, c, g, or t
  misc_feature (231)..(231): n is a, c, g, or t
ttgaaattnattaangtgttggtctcccagagtgtagctgtcgtaaagcagaagacagagaaacctaagcatgncggggaaagggtgtaaatgtgaaagangcaaagagatactgagttatacatgctcagtacgtttcgcagtaccaggcaagagaaataggatggttagataganggnaaatataaattgcnaagtttaagacaacagacgtactactaatttnngacngaa

SEQ ID NO: 591593 - DNA, 283 bp, Homo sapiens
tatcgagctcggtaccgtgtagagagaagggggaggtgctacacacttttaaacaccaggtctcatgagaacatattcactatcatgataacagcaagggggaagtccaccctcgtgatccagtcacctctcaccaggcctttcctccaacactggggattacagtttgatatgggatttgggtggggacacaaatccaaaccatatcattccatccctggcccctcccaaatctcatgtccttctcacattttaaaatacaattatgcgttctctctccact

SEQ ID NO: 591594 - DNA, 824 bp, Homo sapiens
tatggcacaattatcaaatctgcacagaagtttaattggataatctgttctacaaaaatatcataaatgtacacaaatataaggaattacatcattaattattatcaattcccatgtagccatttaaaagcattaggtggatctctatgaaatgtgtcatgaattatttattcagaaaatatttattaatccatgaagctgtgatactgttggcgtgctgaaaaactcttcaggatatattacttgcaaaaactaaggaaaactatgataatatgatttcatatagtatgttaaaattaaaaagctgtggtgtattcatggtggtcatgtgattacttatgaaatcttctgaacaggatatatatattccaagctttaaacagtaatacagaacaaaagtgccgtgcggaataaggtcgtaaaggggaattttctttaatgcgtctatattaactgttcacaaataacatatgtatccatgtatggtactaaatttttaagatattccatattaaattttcacgtatgtaactggttgtcataacatttttaaacattcaagaactattaacatatcataaatgggtctgggacattggggcgatacaaaattctcataaccttgtaatgtcttttccaggattagttgtggcagtacgtatccacaggcagaaaaaatatttcctcttagtgtataccaaaggtcacacagaggttcctggtgagatctatcctgggcaaactgtgtaacactgcccaggtgacatgtcacacctttggacttgtctccaggtacacgttaaataggttggggggggggggac

SEQ ID NO: 591595 - DNA, 341 bp, Homo sapiens
catgctggttcaccagtcactgagcacagctaagggacttctcagcgcattcatcgtggctaccatcccctcattgttgccagcctccagaagccctcagatttgcccagcagtccttggtctctctctgctcctttcccccactggccttttcaaccttcagcaccctccttaagccacctgactctccaccctctccactgaagacctcatcctccttgactgctatcaggtgtactcctttgttccctcagcttcctgtcagacttatctctctgcctccaacctcatttcctgcccagtggtatctaggaggaagtctgaattctgaatctcctccc

SEQ ID NO: 591596 - DNA, 284 bp, Homo sapiens
tctgcacgaggctctattgcggccgcatgcgcgcctctgtggagtgcacctcgtggttgtgggcactgtgcccccagacccctcttctttggacctacttctgtttgccggcccatttggcctgctgtgggataagacaccccacgtgtctctggaggtcatacctaactggctgtgcccccttctgagcacactggggcccctggcactgcgaatgcgggccaccaacaccccccacatcaaccttaaccttaactgggctcttgctattccctgagcccttc

SEQ ID NO: 591597 - DNA, 452 bp, Homo sapiens
gtcaccaggaagtactcccacgtacacccaacctccatctgcaagtccgcacaggaaactggatgcttctgcaagctgcagcccctgcctctctgccaacttcatcaccggctgctcccattgccactttttctttgcttcctgttggtggagcccccactgtgttctcctttggttcttcatctttgaagtcatctgctacggtcactggggagcccccttcatattccagtggctccgacagctctaaagcaggcccaggtcctggcccatcaatcttctctttggttcccccttctaaagcctccctagctgccatccctgaagcgtctcctgtggttccatcagatgcttcattctcctttggatcatctggtttgaagcctaccctggaaagcagaccagtgccaagtgtgtttgctccaaatataacaatgaattgcgtattcccc

SEQ ID NO: 591598 - DNA, 840 bp, Homo sapiens
  misc_feature (513)..(513): n is a, c, g, or t
  misc_feature (521)..(521): n is a, c, g, or t
gcgggcccctagtgctggtgttgcgggacggggcctgatggcccggtcggttggggcgtggtgggcggagaggatgtgagcctccgagtgctgttaggcgactctgtcatctctgggcgtgcagtgcgtcgtttcctggtcgcgggccgtgtgatggtgccgggaggaagtgaagcgcatgtggagctagtgcctaacgttggagccggggttccggtgaggtgaggagtgcctggtgggattgtgaggatcttggctgagcgtgtgactcggctgaggctggggtcagacgcgagtcacagatagtgacgtgcgcgagagtcgcagcagaggaatccttgctggtgaagctggccggagaggggctggtagcactccgcctcgccagtatgtgtaagactatgctccagagtcgcgtaagggagcagagggcgaccgtctcttcgattcatgctcttgtgagtgtataacatacattgtcatcaggcatgagtactcgctcgagcaaccaantgtcgaancatggtgatgactgacagtcaatatagggcatgaccgcttgcagttcgagccaaggcgaacatcacttctcatgggaagcgatgcaagagaacctgcatggaaccagaagaagtcctcctgtcatggcgccagagaggaagaagggatcgtcttgtctcgagataattccattagtcaagatgaagaactatcagcatctcccttacgcacagcaggaagcaatagaggagcctctgagccttcaccctccgaatgtatctccccgtcttggtacatccttggtggtcatcaacccaagggattgcagtcatggttgaa

SEQ ID NO: 591599 - DNA, 158 bp, Homo sapiens
aataaactacatgcgtgtgtgtgtgtgtgtgtgtgtgtgtgtgtgtgtgtgtgtgtgtaggacagtatgtgtgtatgtacgggagacagagagtggagaaagagactcagagagagtgctgctttgtgcccatgaatgagtacatatatggagatgta

SEQ ID NO: 591600 - DNA, 249 bp, Homo sapiens
accagcacgggaccgcttcgatcgccgcgtttagggcgagcaagttggttaagctgggaaatgcctttgatcacatccaggatgtgtacgatgttatcggtactaggcattaagggtaacgatctgagtgcaggaccggctgctctttttgcgaaagctccgacatcgcctgaataggtatgctccaccactttacgaccatcgtcagctatgtacgcatggcaccactggcatgctgagacgctgtca

SEQ ID NO: 591601 - DNA, 452 bp, Homo sapiens
ggaattaacctggtgctggatattttcaaattgtatctagtgcagctgattttaacaataactactgtgttcctggccatagtgtggtctgattagaaatgccccatattatactaagaaaagatccggctttattttttggtagatagaaataaatagctatatccatggactgtagttttttttcaacatcaatgttcattgtaatggtactgatcatgcattgttgaggtggtttgaatgttttgaccttaacagttttccatgaaaacgttttattgtgtttttaatttatttattaagatggattttcagatatttatatttttattttatttttttttaccctgaggttttttgacatgtggaaagtgaatttgaatgaaaaattttagccttgtttgcttattgttcccagacattgtcaataaaagccttttagttgaatgcga

SEQ ID NO: 591602 - DNA, 336 bp, Homo sapiens
taagtggagtgattaaagatttacatgaaggttgggcactgacgctcacacctgtaatgccagcactttgggaggccaagccagaagattcacttgagcccagagaatagcttaagccctatagtgaaaccctgtctcttcaaaaaatccaaaaccgttctgggctttattcaggtggcataaaattcactccaaaacccttacaaaagagccttaaggagctcatgggatccttccctgcctcggttcttgagctcgcggacagaggagggacacaggagaggaagaaagggaaatgctgacagtgttggtatctcgaggacccgtggaaagtct

SEQ ID NO: 591603 - DNA, 313 bp, Homo sapiens
cacgaggaggaaacatatctagattatgtgattccatgctttgttattgtcaactcagcacgaaccattttgcaggaaaatggatgtctgtctgatactgatatgttttctcaagctggattgagaagtgaagaagcaaatgagaacttagactttgtattatcatttttgaaatcaaatacattgcccatctcactgcagtctataagaagtagcctactgctacgattcaggacgtctatgaatataaatctttggagcgagataacagtattgttgtacaaggatggacgttattgccaggagtctcgag

SEQ ID NO: 591604 - DNA, 1412 bp, Homo sapiens
  misc_feature (798)..(798): n is a, c, g, or t
  misc_feature (1172)..(1172): n is a, c, g, or t
accaggtttcgtattatgttaacatatagtgccttagtaataaggaaaagaataaccatttagtgtatacattacgtttatgcgttcttgagctacttgatatataactcagggtgtcgtgatggctgtagtagatggtgacgacacagagatgaatgagtttgactcgatacggaataagagatataggagagaagacatatttcaaacgtccgtgtgatgtatgaaattgatctttggattccagctaatcgttgctgccaagaggttatccatagtcgtgaagcatcgcaatgataataaatctaaggtgaaagatcgaatagatgaaaatagtgaattttgggctagaaggatgatgtttgtgttaggcttgcttaggagatttcagaatctggtatacatatttgttggagcgaaaagtgcatgcgtttcatgtaacctgcttatttttgggtagtatacgacaaatataactgcacattcaagcttagaaaaaactttcgctcatcgttaatgaaaacaggacctacgtgtgacgtaaaacggctgtggtatgggacttcgagcttgtttgcacacaatatattgcattacgcataattcatgattaaggaaaggactggataatgtctgctcccattttcaataatgagcaaagggacgtaattcgatctacaacctcgaaatattcctccccccttcactggacttttcgagggtgacaatgaacccccaaccggcatgaggtatgcaaatggttcgattagggtggccaaaaaagaatttctccaattntatgggaactaattcgaataagttaaggaattactgtgtgtggtgaaaatcatataacctttttattatttgcaacaaattaaagcaccatgaaacgaaccagttcgcctttatattcctctgtgtaaaagtgggcgcccccggggagagaggttttcaccttctcttgtggcatctttagggctcaacagaaatggggtatttacaaccgccaatttgcttggaatataaccaattggaccattattttcatgtgcctaagatgagcgtggcttcgatttacaaatggtttgggccttagagcaatggctatgggaccatttatgccatcctgaaattgtaaaccattcggaggtagattggaggaagagggnacaatggggcgtattttggtgaataggaccgaaaaaacaagggtacgaatcatcataaagataggataagacagaaagagttcctttcccaaataaaaaatttcgttgggagggaatgagagactgctttctttggagaattggccacttgggcgaaaggtataacttagggaccttgttatcgcaaaggaaagaacttttgtcattaaaaaggagttggaaagttttgggacaaggaaa

SEQ ID NO: 591605 - DNA, 484 bp, Homo sapiens
  misc_feature (3)..(3): n is a, c, g, or t
ttntaaagagagaaagcagggattgcgtgaaataaaattttattatttatttctttatagacggtagtttcaccctgtcacccagactagagtgtaatggcacgatctcagctcactgcatactccgcctcccagactcaagcgattctcttgcctcagcctccccagtagctgggattacaggcatgcgccatcacacctgactaattttagtatacttagtagagacagggtttcaccattttggccaggctggtctttaactgctgacctcaagtgatctgcctgccttggctctggaagatcacgccttgggtccttggaagatccagtgctctggaagagcacatccaaagtgctggaattacaggcatgagctaccatgcccggcgggggagcttattctttaaaggcactttgtaactataaagggctgtacaagtgctatttgctgttcttatcatccagtcccttctgtcgtctt

SEQ ID NO: 591606 - DNA, 336 bp, Homo sapiens
cggaactgaaccagaggttcacaaaacaaggtagtaggttgtttctgcgtcacatgatcttggcctacagtaagctttccttcagccaagtgtttaaactgtacactgtccttcagcaggacttccagaatggtgagaaaacgacagtggaggatgctgatatggagctgaccagtagagatgagggtgaaggaaaagtggagacagaggaatttgaggtatctgtaagagaagaggaggtatcttggatgggggctctcggtgccaaaagaaaggagagttgctggcttactcaacaggcttctttgctaaagaatgatgacggtagtggtgctg

SEQ ID NO: 591607 - DNA, 367 bp, Homo sapiens
gtcgacggcagctgttgcagcatccagtttatctcacgaatttcagtgattaatcatgccataaaggttctggtttaaaacctgaactgaaaaaaggctaggcacggtggctcacgcctgtaattccagcactttgggaggcagagataggcagatcacttgagctcaggagttcgagaccagcctgggcaacatggcgaaacctcatctctatgaaaaatacaaaaacatagccaggcctgggggtatgcgcctgtagtcccagctacttcggaggctgaggtgggagaatcacttgagcccccgaggttgaggctgcagtgattgtgccactgcactccagcctgggtgacagagcgagaccctg

SEQ ID NO: 591608 - DNA, 510 bp, Homo sapiens
cgcggtggctcacgcctgtaatcccaccactttgggaggccaaggcgggcagatcacgaggtcaggagatcgagaccatcctggctaacacggtgaaacctcgcctctaccaaaaaaaaaaaaaaaaaaaaaaaaaaaaaaatgtggggggcgcgcgcccggggccccgagagagaaagccttccaagaacacaagccggtgggggcgcgcgcggggcgcccaatgggggtaagggagaacactgggggcgcataaccgcgggtccccaagagagagagaactcgcgggcgccagagagaaaagagggcggggagattctctccccccaatataacaaaacgcgcgccggggggagaaaccggagagcgggttcctggagaaaaaatctccaaagagggagagcgtctcgagagagggaccatataagcgggagatcttctataaacacagggggggctcaaaggagaacgccagaatattcaaaaattaacccccggacgggggggtca

SEQ ID NO: 591609 - DNA, 359 bp, Homo sapiens
gcgggtcgcaacggagctgctctgagatgccgctacaggctgtcaactgccggctcttggcacagagggcggcctcccgagtggccccgaaccgaaggcggtgggaccagcggctgaggccaggatgccatccacgcggcgcggtggctcctcactcatcccacatgttgcttatctttctgcagtagactgtccatgagctgaacattttccgtcattttgagccagaacttactattggcatgtctggtgattagctgtgtgactgtgtgctacctgtgccagcatgccatggaatgtcatcaccggatagaggaacgtagtcagtcagtcttggagagcacaatgactactgtggc

SEQ ID NO: 591610 - DNA, 1559 bp, Homo sapiens
  misc_feature (312)..(312): n is a, c, g, or t
  misc_feature (1289)..(1289): n is a, c, g, or t
gtaattcgttcgtcttaccctattatcattggaactgtggcactaagtcttcatcactttcaattgcctcattctaaatttcatatacttcaaatatccaattggacttatacagtattggaagaagctaacagcgactgagagacttgtattcgtgcattaatcacgtaccttgaatcacgtttattgccaattatattaattagactccgcgcacttagtacctactatgcagaaggtactattggcttcaccttctattgttaacactctcgcaacctctaatctaaatactaactcaaaacactcagngcgcaatgtgcacagttccccacatattactagaatgtcgtgtgtgactaagatgcattgttacttaggagaacatctatcggacgttctttatagtatttgacatataaaacttgactctcatgagggcctctatcgtctccctcttatacatccatagtgagacaggctaactccttaatcgaagccgactctcctttagtgcgctaccgaaataggcctaaggttctatctatatcttcagaaacaacgcatatcaacaagcgctttaacttgctacctaatctattcttccatagttgatagccctaatggcgtacccagaataccttgtcccgtgatatctccagggtatatataccatttaatcaattctttagagccacgagttctcctaaccaccatttaaacattaccaatttgtgacaaaacgtccaattataactccttgcaggaaacatagcgggttcctaaccctctttcatggcttatactaaatttactaagaacagaaattctaaaaagacactcttttcggccaccttttcttcaccaaaccatgatactcaccactccttttcacaccacacatttttccttaaaaatttgttccactaaacatatgaagccttaattccacttaagtgacaacacacttccaggacattgattacagagcccccttgtgcaatagtccccaaaagggcacctttaccccgagttatatatgcacacccaaaccattgttccgttagggtctacaccagggccctttctattaagcacatttgtgccaatccgcgcaagtagacatccaatcctatattaaagacgttggtagacaccagcaagagtgagcgagtaggtcaccagacacatatatgaggcgcgcttgcaatttctaatgtcatttcatggagtgaagcacagacagccgcccgacggattccgcctagttggtaacgtccgcaccgtanaacacaccaagagaggtggcacccccatgtactcttacctaagaggaagaccactatagactcctgacaaaactataggaacgcccttgcgctagggagggaccactgaatgagtctccagactggttatgagatatatactacccacctatctatcctgcaacgttgcagcccgatgttaaacgacgagccatcaacccgtaccattagaacttcgaagaagcgcctgtaacttaaagcgccaacaagataaaattgaaaaacccttta

SEQ ID NO: 591611 - DNA, 1315 bp, Homo sapiens
cagaggacagctcatgtgctgatccccaccgacaattcgaccccacaccacaggcaggcatctcaagcagccaagcattacaagcacaccacacacacacattgtggctggcatgcacactttctcaaccgttcacagcaagcaataggcacacagtcatcatcaggcacacacacagcaaccagcaatcatattcgtgttcttgcgagcaccggcacacagcacacatgctagctcttgcagcagccacagcaatcatcatggcgcatgcaacgtgcacaaacaacagcaatcacccacagccacaatcagcacagcacacgttcaggcacccaagcaccgcacaacatccacaggacacactcagagtccaccaccgtaggaactatagctgcagacaccataacacccacattgatgaatgcgccactatctagcgtctgggatctccttgctcccacacccgtacttcttcgtggccgtcgtacggcccaatcgttacaacgctgccaaagacctcgttcaaccacgcacgcgcaccatgtcacgtactcataacagtcgctagtaacgacaccacggacgggcggggcaccaccgcaccgtcacgataacgctaaagcacacacatcggatggacaacagggctcgtggcagtggtgcacacacctaccaccagaagccacacacatcacacctggccctccaccggttccataacaacctacgaacgcgggctgcactccacgcacatacaccccccagcccccccgctgacacacgcctgccccaccgagggccccccaccgccgcttccaccccctgccgacacgcggccgcgcacctcaccaccaccgtggcgacaacacaacaccgcccctgcacacgacctccccagcaacaagccacccaccgcacaccacatggccgctagtaaagatagagatcccatagacaacacccgtggatacaagaacatcgcagtaatgccagcaataacgggcaacagccatccccccaacacgtcccaacggcaccatgaggtaccctgatatcaccacttaaagaacacgcgcctcccaaccgatcaaccgacaatgagataggcacaagcgccacttggacagggccccagccggaagggacaggccccggccaacgtcccaacaccacaacgcggaccaacaagtcgctcgccacacccaacacaacgagcgcgccctaacacacaccgcgacagggaaaatgacggacgcactacacccacacaccacagcaagaagaccacacagcgcctcgccacgaccagctaaac

SEQ ID NO: 591612 - DNA, 300 bp, Homo sapiens
  misc_feature (14)..(14): n is a, c, g, or t
taaaagcccccccntttttttttaaggagaagggcccggtcttttcccaagtccccacagggggggggaaagcattgtttttgggtaaattatgaaaggcaaaatttttttatttttcccccaaaaactttttttttttgtttttttttgaaaaatgggccttggggcccccccttcccccttttttgtcccccaatttgaaaggtaaaaggggttttggtttccctgggggggggggggggcaaccggggtttccctgtccatttttttgagcccggttgaataaaggggcccccctta

SEQ ID NO: 591613 - DNA, 267 bp, Homo sapiens
atctgtagagtggacctgctagatgtctagcagggatctgacagtcgagacatatgaagaccaactccatagagtacccaccagccctccagggcaatacagtcatagctgtgtcctgcgcatgaacccccatctcagtaaatggcaagtccagtctaattactcaaccgcgaaaactccaggctcccttctattaccttctcacttccctcattatccgagtatccagtccactgggctaaaatccattcatcagacaagtaccat

SEQ ID NO: 591614 - DNA, 382 bp, Homo sapiens
cccgaggacctccgaggtggacggctgcttagtactgccaccttcttggtgaggggctttagcgcccgcctctgatgagatcaagacccttcaaaggtttttgtctccatgtttttcatcgactcctcagacattggacagcagcagaagaatactggagtcctatttgcagaaccacttgtgtgattggaagaccgctattatgagtatctcatgacccttcatggagtggttaatgagagcacagtgtgcctgatgggacatgaaagacgacagactttaatccttatcaccatgctggctatccgggtgttagctgaccaagttgtcattcctgttgtggctaatgtcacttgctattaccagccagccccctatgtag

SEQ ID NO: 591615 - DNA, 374 bp, Homo sapiens
aaatataggctccaagcttgtgagcagccaggacaaaaggataatgtgtctgcacagctttttttaatccaataaaacataacatggtactcagggtttttattccctaaatttgaacttagggaatatttttccttgcagtttttttcttaatatcagaagcatcatgtcttaattgctggggttattatgagaaattctacatatagcttttttaatgtcaatcctccatgaaagagaattatgcagagagcactattataagtcatgttcttaaaaggcaattttatatccttgcggggtttaatagcacgccacatacccgccaagggtaaaactttttgatgaactaatttgatatggaaataaaggct

SEQ ID NO: 591616 - DNA, 430 bp, Homo sapiens
ccaggggaaccaagagaacccgtagaatcctcaaccgtgcgggccatcaaccttcgagaaattccagttgtctttttcccagccgcatcctgcctgtaaatggccggggaaggctttaaaaaaggggcgcattgcgatccaaccctcggcaaccgattccgtttttttatcacggggtgggagggaaccgtggggtccctgcgtggggcccatgggttaaaccctccagtatttagacctaaagtccaaatgcttgtaggagccaatttgttttttaagtttttttttaaaacaaaaaaatcccgttttcccctttgtacttcagcgctagccccttttttgcccacccgagtactggcgagtatttttttttttgggcctccttctgcaaaacaataaacaaaggacccaaaggtcctcctgcctggca

SEQ ID NO: 591617 - DNA, 172 bp, Homo sapiens
tgtggactctgagtataagatgtggcttgcggttactgggtatgcgcttggtgttgacgggtggggatggggttaatgctatggtggtcattgcagatatgcaggccactcacggagcccccttctcccgccgctggcgaaagaaggggaccccctattgcgtctcacgcag

SEQ ID NO: 591618 - DNA, 299 bp, Homo sapiens
tacagaaccttcctctaacgaggatatggagcgtaaatacctcataatgttgatcacatttgccaatttacacaatgtgtagttgtccctaggtatccatggggaattgatactaggatctcctatggatatcaaactccaaggatgctcaagtcactcatacaaactggcataatatttgcctgtaacctacacagatcctcttgtgtactttaaataatctctagattacttataatatctaatgcaacataaatactatgtaaacacttgttatgatatttttattggcattattt

SEQ ID NO: 591619 - DNA, 154 bp, Homo sapiens
tgctgggattataggccatggtttaactacagtacagttgtgcacacaaccttcccacccctacccttgacccttcatcaggatcaagtctctgtattgaaccggatagcggttcaatacactgctgttggccaacattgaaccggatagcttg

SEQ ID NO: 591620 - DNA, 398 bp, Homo sapiens
gaggaagtgagagacaggcagacacttctgttcttcctgcagaaagtgctgcttctgcagtgactcgtcagatgctccccagagcccagcacagacccggctccacccacttctgtgggttggccagatgagtgagaaacacaggcacagcaacgagagggagctgaggccggacccaggagtctttttcctatggtcctgcctgatatagtaaccgggaaagggatgaatgtgatgcaatgtgctcttgtaatggagcatcacaagaacaggtcaaagacacaagccacacagcaacgagcgcggacagcagggcagacacagctgcacccccatcaggtacatttcaggtgctcagcagtgcacttgtgctttgtggctgccttctggacagcatg

SEQ ID NO: 591621 - DNA, 888 bp, Homo sapiens
cctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttgtttttaatttaaatttacaatttttttgcattttttggagaggtttttattgtagtttggttttggttgttagttgttgttgttgttgtttttgagacagtcttgtgctctgtcacccaggctgggagtgcagtggcatgatctctgcaacctctacctcccaggttcaagcaattcttgtgcctcagcctcccaagtaactgggactacaggtgcacgctaccacaacctggctgattttttttatgtttaagtacgagacagggtttcaaccatgttgcccaggtgtggtctcaaactcctgagctcaggcaatccacccgccttggcctcccaaagtgctaggattacaggtatgagccaccacacccagctattttttctttcgttttttactttctaacacgtgggggggggggtcctcacttggtttatcctggtagatctcgaactcccggagttaggcgatcctctggctccgagccccgctaccgagtctcggggtttctttacttaaaaggatcccttaccttttgttctctttttcttgctgcatgtggagatttgggtttcaccttccggccatagattgtggggcctcccggccgtggagctggtgttcctaacccttttggttctcgacacactccttttgatactagcagggtgtggagcggggcgctcattctccctggtggctttttgcccggtttc

SEQ ID NO: 591622 - DNA, 559 bp, Homo sapiens
  misc_feature (375)..(375): n is a, c, g, or t
  misc_feature (547)..(547): n is a, c, g, or t
gacgacgcttcgacggtgtctggatattgtctttattccatacagttactatttagaacaagacaagcatggcattggaaaatggttagcttttaaggttgtaacatagatttctaaaacaaagaaactaaaattacagtgttctggaagtctgtaacatgatgtgttgagaactagaatctgtgtttcccgggaggcctttcctgtaacataagccttttggcctgatttctaggcagcccgttggagtcttaataaaagcctcacaaatagggtaaaataatactttggtggtcaaatattttctgactgattatcaggttttggctgggttttgttaactgctgagctctttgaacaaataaaatatttggnctacaagtgctctgattatgaggtgggtgaacctgtagccttgccagtcaccctcctttaccaccttaacaggtcctcactatttaaaaatcactgttttgagttccctgttaggagactcagattctcccaataaggcattgctattaagcttaatttaagtacagaacancgtcgaaggggt

SEQ ID NO: 591623 - DNA, 398 bp, Homo sapiens
gtctttgagttcggacacgcaaggctgtgagactacctattgtagatattgccccctatgacattggtggtcctgatcaaaaatttggtgggggcgttggccctgtttgctttttattaacccaaccctttttgaaatcccacaaaaaaaatttaaccccatatgggttcctcttgttctaatcttgtcaaccagggcaagtggccggcaaaattcccgttttttttttcccaaatgtttgggacccgtataatttggcaaagaaaaatgatacttctctttttttgctgttccccccaataccattccaatgctttttgttttttttttttacccattcccatttccaaatgtctcaatggggctataataaataaacttcccccctctttttgata

SEQ ID NO: 591624 - DNA, 103 bp, Homo sapiens
  misc_feature (75)..(75): n is a, c, g, or t
cagacttgtctcttgtaaattgaaaaagggtttagcccaaagacttgcagttttgagatctctatttaactacanattagagtcctcgggttatatagttccc

SEQ ID NO: 591625 - DNA, 298 bp, Homo sapiens
cttactataatggccttaatgtcatccatgttgtagcatgtgtcacaatttcctttttaaggtggaacaatatactccattgtaaatacacacaccactcatctgttgatgaacacttgggttgcttttgcctcttgtgaataaggctgctatgaatataagtgtacaactatctctttgggaccctgctttcgattcttttgggtaggaacccagaagggcactactggatcatatggtaattctgtgtttaattgtgaggatcacttgaactcaggagtttgtggttccgtcgacg

SEQ ID NO: 591626 - DNA, 207 bp, Homo sapiens
atcatcaacctccttaccccatccccacgccctgacaccatccctgggatatcagctggcacctaatggcaggttgttatcactggtccacttccatcatgaagagatcattaaaataaatttgccttctaggtccacagggccttaaagaatgtcctgttctccatgatgggatccccacaccattgcttctgaccaggtcgacgc

SEQ ID NO: 591627 - DNA, 1030 bp, Homo sapiens
  misc_feature (325)..(325): n is a, c, g, or t
  misc_feature (728)..(728): n is a, c, g, or t
  misc_feature (1030)..(1030): n is a, c, g, or t
gcggagtcgcttccacgcgcaggacatgagggaagggcctggtgctagtgaatctatgccatacagaaaaagaagatgatgtgccacagttcacaggagtgcacggagaggaatcctcgataaatggtttagctgggaaagctgagatagagttttgaacatatctggaccacctctgaaggcagggaagactcgaaccttttatggtctgctatcaggacttccccagcgtggtgctagttgggctcggcgaaaaggcagctggaatcgacgaacaggaaaactggcatgaaggcaaagaaaacatcaggagctgctgttgcangcggggtgctaaggcagattcaatgacctggagacctctcgtctgtggaggtggatccctgtggaggacgctcaggctgctgcggagggagtcggtgcttggtctctatgaattacgaatgatcctaaagcaaactacagaagatgtgctgtgtcgggcaacagctctatggacagtggggcactcaaggagggtccgtgggcacgcaccacggatgtcctgttgtgctctctgggcgagaacttgtgctacgtccccattgcctggagacagccaacgcgcaagtgactatgactggcgaccaggatttgcccggcattacttgagcaagaactctccaaagtgctagttggaaacaccgagggtccagtactcaaaccaggtcttccgatttgaggaaccnggcactgggaacattgcgcactttgtggcaacacggtttcacatgccccaggtttgtggaatcactaccaagggagacgcatttgcacgaaccccccaggttgtggacaagaaccacacaagagggaacacacaacggcatcgcattgacgcaaaggaaggcgacgtcgcattatttcgcaccctttttaaatatgccgcaataacgcttaatgacgagaaaaacgagtagtgtaaaagacacaaatagtatgataaacaaagaacggatatcgatgtataatatagcaaatatgaaaggcn

SEQ ID NO: 591628 - DNA, 153 bp, Homo sapiens
gtcccttctcatagctacctgaacgaggtccgcagcacgacgtagcaaatggctacacggaggacatcgacacagcctgccccacactgtatgcagaggctgaccacgacagcctgcgggagctcctggtcactgagaacttctgtcttctga

SEQ ID NO: 591629 - DNA, 754 bp, Homo sapiens
  misc_feature (34)..(34): n is a, c, g, or t
  misc_feature (74)..(74): n is a, c, g, or t
  misc_feature (82)..(82): n is a, c, g, or t
  misc_feature (107)..(107): n is a, c, g, or t
  misc_feature (109)..(110): n is a, c, g, or t
  misc_feature (125)..(125): n is a, c, g, or t
  misc_feature (134)..(134): n is a, c, g, or t
  misc_feature (161)..(162): n is a, c, g, or t
  misc_feature (182)..(183): n is a, c, g, or t
  misc_feature (186)..(187): n is a, c, g, or t
  misc_feature (193)..(194): n is a, c, g, or t
  misc_feature (196)..(196): n is a, c, g, or t
  misc_feature (200)..(200): n is a, c, g, or t
  misc_feature (204)..(204): n is a, c, g, or t
  misc_feature (210)..(211): n is a, c, g, or t
  misc_feature (218)..(218): n is a, c, g, or t
  misc_feature (220)..(220): n is a, c, g, or t
  misc_feature (224)..(224): n is a, c, g, or t
  misc_feature (228)..(228): n is a, c, g, or t
  misc_feature (266)..(266): n is a, c, g, or t
  misc_feature (282)..(282): n is a, c, g, or t
  misc_feature (295)..(295): n is a, c, g, or t
  misc_feature (309)..(309): n is a, c, g, or t
  misc_feature (328)..(328): n is a, c, g, or t
  misc_feature (750)..(750): n is a, c, g, or t
agggcccctgctggacagcacgctccctggggangagggtgagggaccccaggactgcacagctggggacttgntgggaacntgggacaggtgagaggcccactctngnntgtggcgccagggcnttccacctntgcatccagccatgcacccaccatttnnccacagggtacaggggcagnnttnnttgatnnanagcnaacncttctnntgctgtntntggntgtnagtgagacccctctggaaagggcagaagcaggcaagcnagggagaagggggggnggggtggcagtangtgggtaggaatgngcagagggggggcagagcnttgctcgcttgtgggaggtagacaggtctcactgcatacatgggacagatgtgtgcacccacacacatatacatacacacacacacacacacacacacacacacagccctttgaacccagcactggcctgaggaaggtggccccggaggaaccctgaaggcacatgtccaccaggctataatgcccctgccaccctggggctcagctggccagactcccaggggtgggatgctgctgacccaggagcccaccaagtccccagggcagttctgggcagggccagaaaaccccacgcccagcccaccagcctgccactcctggcctcagatgccactcccggcctcagatgccactcccagcctcagacgcagatgggcccgagaggtgttcctgggaaacagttcacttagcaagacccagtncctg

SEQ ID NO: 591630 - DNA, 277 bp, Homo sapiens
gccccaggtatcaaatttcctaatcagagccccctgagttgactcaagtcgagccatttagccccgataaagctgcaagacagtgaataatacttgctgttcccagcccgtgtgtgtgtggtcttattttggataatccctgctgggtacagtaacgcatgcccatggtcccagctactcaggaggctgagatgggtggatcatttgagcccaggagtttgaggctgtagtgagccatgattgtgcagtactctagcctgtgcgacagagtgagacc

SEQ ID NO: 591631 - DNA, 211 bp, Homo sapiens
  misc_feature (2)..(2): n is a, c, g, or t
tnccgaatccttcatctctcatcagagaagggatcagacttcatgattccataagcaaacaaagccagtgatacagtctaccatcatctaggctcaactgaatctttgagtttactctgaatctagcactcttcataagacagattgttgattgaatttgcgtttcttcggtatttttatgtgcacatctctatgcctatgacagaatctt

SEQ ID NO: 591632 - DNA, 941 bp, Homo sapiens
acttggattgatttgctctccaggacatcagcacatggccctgatcagcactaccacatccaaacataagtcactgaaaaacacttaatatttatgagtggtaatgacaagggacatgtataaagtactattgctagattcatgcctcaaaagttattataaacagacctttattaaacacatctgaaagatgtagaagtccctctatagtctagtatagtttacaatagagttgtaagaccaaaaaaaaaaaaaaaaaaattcaaactcgttattcaggaaccgtgctttataaaatgtcagtgggattcttggcattgccaatcttgatgcgtgggaatgggtccatgaattagggttctgtgagcagttctgggcccagaaattctggcattgggttctagttggatgaagggcatgacctctataaagggtttcaatggctaaaatatttacctggggatactggggtcagccatttggactggagcagactaggggattcagacatggtttcagttatttggtttttaaccaaatcaaccaatgctccctgaaataagtcaatgaactcatgttccagcatcacgtgccaaagggtctgtgattggcactctggatttcagggagggcaagccagttcgtgtgtcttcatcgtcttccgttagagaaattctcctttttcttacagatagatctatatttttacaatatatttttacgcagatgaattttggtagatactaagaaattacattaaaagaggggtcagggaaaaaaaacttttttggaactaaggtggttttttacaataaagccggggtggccatgggaacagaggggttccgataaaacggcaggagagtaaggtggaaaggaaagggtacgtcgtttcacaaaaaaaaaaggggcaggacgactgagagtaagggcagaggtta

SEQ ID NO: 591633 - DNA, 105 bp, Homo sapiens
ctgtctcgtgcgatgccatgtggattgaatgaggccaaatcaaacccagactgattcttaattcccgtgcccttgctttttcttcttttagatccatcattagta

SEQ ID NO: 591634 - DNA, 615 bp, Homo sapiens
cagcccttcctcccgctgctgcatctgtctgagaggggaagctcttgttttcaccagctggaaccctttatgaggaaaactgagccgggtggccaaatggagaaaggagaccattttctaggttttcctacgcgtgatattgacgcgtgctttttctttgatttgaggtaccagcatgtaaataaccaaatttcccatattccaaaatggatccatatatagcagatgacatgagatgacccttttggattttgaagcaccagacttaaaatctggacccaggacccacccatgtaaaagatataaaattaggaaacttataattcccagcgtaaatttcagcgtttgacacccaccttactcccagtgaataggtggccagctccagaaaccaggacagcactgctgctgcccagagccagcgtcaccatcccagctggccacttctgtgagagctcccttcctgccgggcaccgtgtgagttccagcgtgggcccagagacttttaagcacattctgtcattccaaagggaaatgatgcccacccccgatgcagcatgtcctgaatgaatgatctgtttaaataccataataaaagcttatagtttgagtaga

SEQ ID NO: 591635 - DNA, 292 bp, Homo sapiens
caagaatataacaaaaatcagccaggtacagtatggctcatgcctgtaataccagtggtttgagaggccaaggccagaggatcacttggggccaggagtttgagatctgcttgtcaacatagggagacccctgtctctacaaaaaaacgtgtgtggtggtgtacacttgtggtctttgctactcaagaggctgaggcgagaggatagcttgggcccgggagttttaggctgcggtgagctatgatcatgccacttcactccaactcagcaacagaatgagaccctatctcta

SEQ ID NO: 591636 - DNA, 141 bp, Homo sapiens
  misc_feature (75)..(76): n is a, c, g, or t
tctctgctgctccgaggagtaggtcaaacgtgacaggaggtgaaatctgaagaagacctggaggaggaggcaagnnccaggagatgaggcagaagcactcacaggccgtggaggagctggcggagcagctggagcagacga

SEQ ID NO: 591637 - DNA, 362 bp, Homo sapiens
cgtcgacgggctggctggggacacggccaatgatatacatattattcccagattctgagtttgtttgaacagcatgcgtaacctgaccctcttgttctattgatttcaaagtgatatcgatatgagtgattgacaaataagtgttgcgtttctcttttggcgacccccctccctaaatcaaaatggatcactccaaaatgtaactgactgtctttagttatggcctagttatcctcagtctttagttatgtcctagttagtcttcagttatgtcctagttatcctcagtctttagtatggccaagttatccttagtctttagttatgtcctgttagtctttagttatgtcctaggtcgacgc

SEQ ID NO: 591638 - DNA, 495 bp, Homo sapiens
  misc_feature (252)..(252): n is a, c, g, or t
  misc_feature (349)..(349): n is a, c, g, or t
gctcttctgatcttcctattggtctgtgtatgaaatacatccctccccaccacccttgtaatacaaggggagacagctgataacggctgagatttttctactgcttgctccctctactctctccctgattgtgaccactaacatttccactgctcgaatcacacaaattacctcaactttagtagagggagcgacgacacaactctgtcaacccagggtacatgtaaccgtttaggctcacccttatttcanaattttcttataatcacgttgtaacagttttacaaaatcccaggatttcaatataaaaactctggatttcttagctcctcctgtaaacaatgtgaangacctgccaaccctggcgcttgcttctcctaatgacaaaacagagctgaataactgccctattagatcaactttccaggggacagcacaatcctccccagaatgttttactcatttatgttacctgcacggttcccttaggcattt

SEQ ID NO: 591639 - DNA, 332 bp, Homo sapiens
ttttcttttacaataccaaaatgcaatgaatattttatttaaaaaaatcaaattacatgtggtcactcatgcctgtaatcgcagcactttgggagaccaaggcaggagaattgcttgagcctaagaattcaggatcagcctgggcaacatgatgagaccctgtctctataaaaagataaagaaattagccagctgtaggggtgcacaactgtggtcccagctacctaggaggctgaggtgggaggatcacttgaacccagcaggttgaggttgcagtgagctatggtcatgccactgcactccagcataggtgacaaagtaagactctgtct

SEQ ID NO: 591640 - DNA, 199 bp, Homo sapiens
actgccatgcttgtcgggacatacttctggtgtgcactgtgcggaaacttgaggatgaaatcaaagtgagctgcatgcatcgttaaaggcatggcctgttctcctcacttgcagctgcaaggttccactcgaaccaaatgccctgattctgactcaattactcagtgtacagtccaggggttaccgagcctcgagattc

SEQ ID NO: 591641 - DNA, 186 bp, Homo sapiens
  misc_feature (19)..(19): n is a, c, g, or t
gccccaagttttttaaacnggggggtaagcattttaaagagaccccccaggggttttggcctgtgactaactaattgcccccccccagccgagacctgggggagactgtaactagtgatgtttggccacccaaagactttattttggggtttaaggagaataaagttggctcccttttccccccca

SEQ ID NO: 591642 - DNA, 595 bp, Homo sapiens
accaatgccatcccctctttgcctctccccatccctcgctggcctgctcctgctcccctatctacccatcctcccatacaaaggctctgcagtgagacattgaacattgaacaaaagcacgctgtactacccaaccaaccaccaactacagatccaacatagacacgacatcagacgcaacgaatggcattactacatggctcccactatacgcacacacatagtacatatcgccacgcagctgaacgagcacaacacaacgagaccagacacacgcgagacaaagaacagagcgctagcagctcgcaacggatgagcgcgtaggtcgcctcatgactatgtgcaccgacgtcgtgcgcacgacaagcgcaacgccacccagacgtacagagccgacaccatctcagcgacgcctacacgtgcatacaacgattcctcgatccggctatccaagctacatgagagcgcagcgaggccgcacaccgcacgataaggaggaaggcccgacgtggggtcatttcgtccgctgacgaggcgacagaaaacgaccgtcgttctatgcggtcctccagcacgaacccctggtctcactctt

SEQ ID NO: 591643 - DNA, 147 bp, Homo sapiens
gagtgactctgcaggagcttatcctctacgacatctgtgaccctcaccgtcgctggttcttctctgaccctcagcccgcctgcccttcctctgaccctcaccccgcctgccgcttcctctgagcactctacaactggcttttcatcc

SEQ ID NO: 591644 - DNA, 418 bp, Homo sapiens
gtggacttcatgtgatgctgccaggccagacgccagatgctagtgctctactctggccaggtgcaccatgcctaagcatgggtcactatatgctgtacactggttgagacaggctgacgcacatgtgctaatagcgcctatggacgctattgactactgcggtgtgtgtcagatgtgttgttcggtactcagttgtgacaggtctcttctgtgcgactacatatgtgtgcattaggctgtgcgtcttcccaatcacacgtgtagttactacgagactctcagagttgccagagcccagtctgagcactgttctgtggccgcacttagaggacgatgtctcatgagtatcctcagctcattagatttgttcggaccacttgtcgcaccagtgtcgctctgacatgcttacagtgattac

SEQ ID NO: 591645 - DNA, 141 bp, Homo sapiens
gtgaagttctccaaggagaagtacatcctggactcatcgccagagaaactcccctgcctacagcactgtaacccgtgtccatgccgcccctgcagccccttctgccacagcattgcctgcctcccctgtcgcccgccgttc

SEQ ID NO: 591646 - DNA, 363 bp, Homo sapiens
  misc_feature (1)..(1): n is a, c, g, or t
ncacagtctagagtacagtggcatgatcttggctcactgcaagctctgcctcccgggttcatcgcgttctcctgcctcaatatttttagtagagacggggtttcatcgtgttatacctggctaattttttaaacccatctgtagatatggggtcttgccatgttgcccaggttggtctcctggcctcaagcgatcctcctgctgtggcctcccaaagttctgaaattataggtgtgagcctctgggcttgccttacaaatattttagagttaaattaaatatatacacatttcaaaacttctcctttttatagaatatgtgccacaagcgcccaatattcgatctgttctctcactattttct

SEQ ID NO: 591647 - DNA, 323 bp, Homo sapiens
aacaattggggcctatcccgcgtatccaatgggaacaacaccactccaccgccgtgcgaagaaaacatgttatcccatcttttcgcgccatgaggaagaacatgctaatcacctcgggaataagcacctccgcgtttggcacaacagtagccccaaagatggggcacactgcgagagggaccccgctctcttctaagcaaggtgccatctctcctagtgctgcttgacacgccgacccgaatatcaacagcctgtagaggacttcatctgcggcgcctccggagggttttttttttaaaaagaaccctaacgcaaaaaaaaca

SEQ ID NO: 591648 - DNA, 203 bp, Homo sapiens
ggttttccccctccccatccgccccaggccccctgcttgggcttgccttgccccccctttgtttgggccccggggtttttgcattgcctgcctttttgccttccccttttttttttcccgccccctgcccattgggggtttcagcccccaggctgtgggctccttgggggcgggcccccaataaatttgaattgttgttgcca

SEQ ID NO: 591649 - DNA, 151 bp, Homo sapiens
gatcttgtgatcccctgctgtacagttgtggtctagtagtatagtgatgcagcagtaggactgggagagataggagaggtaggactgctgtgattaggatggatcagacgaagaggggcgtatggtatttgggttataggcagggtggttt

SEQ ID NO: 591650 - DNA, 338 bp, Homo sapiens
gtttggaggtgcttgccttaaagctagggaaacagctctcattcggaactagaagcctgtccctcagtggtagggagacagccatgagcggttttctgggaactgtgggatgtgcccttgggggcccgagcagaaggaagatgctccagaccattaactacagcctggtgctctctctgcaagtcctgctgctgttctatgacctctttgtcaattacttctcataactgctcctcttcaacatcatcatcatggtgctcatgtgcttgaacaccttgatcttccaggctggtctggacaacctcctataccataagttccggtaccatcatactgac

SEQ ID NO: 591651 - DNA, 220 bp, Homo sapiens
  misc_feature (31)..(32): n is a, c, g, or t
  misc_feature (40)..(40): n is a, c, g, or t
  misc_feature (51)..(51): n is a, c, g, or t
  misc_feature (89)..(89): n is a, c, g, or t
  misc_feature (121)..(121): n is a, c, g, or t
  misc_feature (129)..(129): n is a, c, g, or t
tcgtggtgggaagaggagatgttagctatgnnggtatgtnttatttctttnatccattaaaaaagccctgggagagtgtatattcaggncaacttgaatctgtgtttcctggttacagtcntcacactnggcctaagtaaaccccctacgagccccccaaagcgccacgcgaagtgccacacaaagggccacccgatgagccacacaaagagccgggtac

SEQ ID NO: 591652 - DNA, 434 bp, Homo sapiens
  misc_feature (206)..(206): n is a, c, g, or t
agacctgaagaggtagatgtccccaatgtgtgcctaaaggtacaaaaagaccagactaatatattaatatatatctgctgtccagacagcctgtatcttgggggacagggctggcccagtcctggtggccgctcaccccctcggtctcctcactcccttctacctgccactcacacagccaggtgccttggagggtcccaagctgncgcccagccaaccctcctgtcttcccagggtagcccgcctgccagtccctagctgcacagggcagttgggcccaaccctgtctgtagaggcgcctggtgtatctagcactggccctgcacggtggcctttgctgggggacgggggcgcaaagtcagcctctctcccagtctaccaagagaagcccctttcccccatgggaaggacggaggccttcgggccccagcccc

SEQ ID NO: 591653 - DNA, 381 bp, Homo sapiens
cacgagggcaagtacgcctgcgagaaaaaaactttaccgttttggcgagtcaccaacaggatttaacttcagttttaactctgctttgtgtccatctaagactccagccacgttgtttcagagtgggacttcagttggcactgatgaacaatcagatgttactcaagcaacaagagagagatggccagtacattgaacctgttgttcctttaactgatctacttgaagtatccagtggggaggaaaatgaacaagttgtttttagtcacagggcaaaactctacagatatgataaagatgttggtcaatggaaagaaaggggtattggtgacataaagattttacagaattatgataataagcaagttcttatagtgatga

SEQ ID NO: 591654 - DNA, 375 bp, Homo sapiens
cagccgatatatcagtagagaactgggtagggataggaagtacttggcagggaagcagcaatctagctgtgtatgatataacatgcatccttgggcaggtaggccttaaatcttacacagtggtgaagggatgtttgttttggtaatgctgcagtagagtgggagtacttagttctctggtggtccagtatatctaataagtgtctttcatataatttccacgtaagggaaataaggtagtacttttcttaatatatttctatgcttaaaattctctttcctagtcaaaaatggcccaaatctgtgttggctttcggctggctacattggtctcccttacttttcttgagctaaagacaggctttttccaccggc

SEQ ID NO: 591655 - DNA, 168 bp, Homo sapiens
agccgtggtcaggcatgcaagactggtcaggcatgcgagcttgcgcaggtcttgtacgcagcgcctcctcgagaagccaacagagcagtaagcgcagcagtccggagtgtggaagatgaccaggagggtcacctggtgtgccggatcggcgattggcttctcgagtag

SEQ ID NO: 591656 - DNA, 156 bp, Homo sapiens
gctcacagcctcctgagaagctccaacggccacccccgccaggaacctcaacgatacaaagttcattgaacataagctactgaccttaaccgtagtcatgctgcataagtcagtcactccgtcgtagatcactccaccctgcaacctacctaaagc

SEQ ID NO: 591657 - DNA, 411 bp, Homo sapiens
gtggaggtagatcaccagaggaggtcagatgtgcgatagcccatctaggcccagctgatagtcatgcagcacgcatagtgacacagaggctggaggaggacaggcacagacacctggtacacgtcagggaccgcctcattggccaagctccagtgtgcgctgatctgcacggccgggggcttaccctcctccgaacggtgacgcacgcggggagtgttgaccagcagggacaccatgctgaatcgctcctgttccagtgggttgaataggaccacaaacctgggcgaggaatccagctggatcaccgtgcgctctgggagggcgtcgtgacttaagcgagtgtcatccacttggaggaagggcgcctcagggtcacagtggtaggtctccttgtcccccagcaccagcacg

SEQ ID NO: 591658 - DNA, 1348 bp, Homo sapiens
ttcgaatgctgcggagctaggaggcggaggcagctggggaggtcctgagcgatgtgaccaggccgccatcgctcgtctcttcctactctcctgccgcctcctgtctcgaaaataactttttaagtctaaatgaaagaaagacaaaacgtaagtcgtccgcccctcacgcccatctcttcctctcagccttacagtccggtgaggaatgcccggcggttggttagctccgccgtacgggggccgacgcagaccaaagccctctggacggccccagggcgactgcccctctagaaccgccgcggcacaccattgcattcccctatctaacaacccctggcgcctgagaacccaattgactacgcgcgacgatccaggacacgcctggccccgttggtccctatccaattcttcccagacgtttacacccgtggagaccacaaactgagggggcttccaagctgatgcctggaatgcagaaccaagttcgtatggcacggacacttttcagaggcccacgaaatgcgctgtggaaaggggcaacccctttggcttcggtgccaccagacacccaagtttaactttaacagcccagcttccaaccatagcggaattcgccccgaagtgaaaatggaggccccatttagcaacaagagggaactcccctggcgagtattcaaccgcggggactgcggtcagtttaccgcgaccgcaatgtccaaagcgccgcaagtacgcacgagatacttggcgacattatcccagtctcgtatggcacatattaggcggcaacccaatggcgcgcacagcacaaaaccaaggcgcggcacacacatccttggcggacctctttgtcaatgccaccaagaggcttccaccgagaggaaagcagcatcatgggtcatacgacgcgcggcgcatatctccaatcccgccgccaagagtctatcgacacaagcctctcatgcgagcagctaccagtatggggagcaccttatcgaagagccgccccacgcatttagattatgaaaaacaacgcgtaggtggatccccccggtccaccacaaagcaacactacttttgctgggcgcaacatgacgcagcgtcaacttctggcgacctcccccccaaatatctttggcagtgccttgaccccatggactaatgtatggaagaacagccacgctatagacaacagcacgagccgccatgaggtgacggtgtgcataatgacccaaccttatcgcaaccacagagactacgcggcacaccccatacaagtcgtgtttgtggcccaaaccaattcttgtcggctcgacggcaaacgacagtgtcgcccagacgacaccat

SEQ ID NO: 591659 - DNA, 447 bp, Homo sapiens
  misc_feature (38)..(38): n is a, c, g, or t
  misc_feature (40)..(40): n is a, c, g, or t
  misc_feature (83)..(83): n is a, c, g, or t
  misc_feature (95)..(95): n is a, c, g, or t
  misc_feature (99)..(99): n is a, c, g, or t
  misc_feature (193)..(193): n is a, c, g, or t
  misc_feature (204)..(204): n is a, c, g, or t
  misc_feature (216)..(216): n is a, c, g, or t
acgcgcttccctgccactgggttagggaaggcttgcgnanagacgatttcggaggacagcaggtgttagccaggcagcggcgngccgccaacacnacgnaggggcggagagacgccgtgagcaaggttcctgacggagacttcgcccttcatgtggtccaacctgggcattggcagctatctccctgtctgtngttggggcaanctggaacgctcnctattaccggctcctccatcattggtggaggagtgaaggcccccaggatcaagaccaagaacctggtcagcatcatcttctgtgaggctgtggcaatctacggcatcatcatggcaattgtcattaagcaacatgggctgagcctttcagttgccacagaccccaagggccatcgccatccggaactaaccatgcaaggctactccatgtttttgggggctggcctcaacc

SEQ ID NO: 591660 - DNA, 678 bp, Homo sapiens
gcgcttaaagcgaagggggaagctccagccccgggggaagctcaccccaaagcgaaggcaccaaaggccaagaaggccgagctgaaaggcgttcacagccacaaaacgatgaagaaccgcacgtaacccacctgccggcggtcgaagacactgcgacaccggagacagcacaaagatccccggaagagcgctcccaggtgaaacaagctagaccatatgctaccatcaagttcccgctgaccactcgagctgccatgaagaagatagaagacaacaacgcactggtgtacatagaggatgccgaagccaacaaggactagactaaacaggctctgaagaagctgcatgacaatgaagaggccaaggtcaacaccctgatccggcccgacggagagacgaaggcataagcccgactggctcatgatgaccatgctcagcatgaggccaacatgagtagagatcatccagaactgataccaagttgcctaagtcgcgaaaacagacacatatatactacgcgctcaccacgagatcgagacccgcactcgcaatcattcatgggcgccctgggttcgataagaactttcgacccagagccacacgtaatgcagtgaggcccgcaactacagagtcacacgtggtcactagcacagccttaatagtacacatcagactcct

SEQ ID NO: 591661 - DNA, 85 bp, Homo sapiens
acggccgtgtattactgtgcgagacgttatagtgggagctcacacactgactactggggccagggaaccctggtcaccgtctcct

SEQ ID NO: 591662 - DNA, 590 bp, Homo sapiens
  misc_feature (162)..(165): n is a, c, g, or t
  misc_feature (170)..(170): n is a, c, g, or t
  misc_feature (172)..(174): n is a, c, g, or t
  misc_feature (176)..(176): n is a, c, g, or t
  misc_feature (179)..(179): n is a, c, g, or t
  misc_feature (182)..(183): n is a, c, g, or t
  misc_feature (187)..(187): n is a, c, g, or t
  misc_feature (198)..(198): n is a, c, g, or t
  misc_feature (202)..(202): n is a, c, g, or t
  misc_feature (393)..(393): n is a, c, g, or t
  misc_feature (463)..(463): n is a, c, g, or t
  misc_feature (500)..(500): n is a, c, g, or t
  misc_feature (574)..(574): n is a, c, g, or t
  misc_feature (590)..(590): n is a, c, g, or t
gcacttgctggagctggggcagcagtcattgctatggttcactaccttatggttctgtctgccaactgggcctatgtgaaagacgcctgccggatgcagaagtatgaagacatcaagtcgaaggaagagcaagagcttcatgacatccactctactcgctcnnnngagcngnnnantgnatnncatnaagctcttctnttcnttctaccatttgaatgcattggtgtttaactaagggccatccaaccatccaacctttaaaaaacaaaacgaaagtgcttctcatcaatgatatgtaaggtggactatgaatcacctgagtacaattctttggtgcttagcacttacatttcccaatttataacatgatgtaaatcagatcttttctacaangctctatccagccctttttttgaaattctcaaactcattactacgtctgtaaaaatcaagatactaacantggtcaatgcaaagatttgtttgattttaaccacttnccatgtgtatacataacacctttgcattacttctatgctttgaccttcaaaggaccatggacattatgaccatngatgagatgcatctgn

SEQ ID NO: 591663 - DNA, 261 bp, Homo sapiens
gcacttgctggagctggggcagcagtcattgctatggttcactaccttatggttctgtctgccaactgggcctatgtgaaagacgcctgccggatgcagaagtatgaagacatcaagtcccgcaggggttttccaattcagaacatccactataatcgcccgtaagagcggctcaaggcagccagatgaatgtatgcttgattgttctttatacgtattgagtatagcattggtgttaaactaagtctatctgatcgccat

SEQ ID NO: 591664 - DNA, 509 bp, Homo sapiens
  misc_feature (1)..(1): n is a, c, g, or t
  misc_feature (9)..(9): n is a, c, g, or t
  misc_feature (13)..(13): n is a, c, g, or t
  misc_feature (35)..(35): n is a, c, g, or t
  misc_feature (42)..(42): n is a, c, g, or t
  misc_feature (70)..(71): n is a, c, g, or t
  misc_feature (114)..(114): n is a, c, g, or t
  misc_feature (160)..(160): n is a, c, g, or t
  misc_feature (175)..(175): n is a, c, g, or t
  misc_feature (216)..(216): n is a, c, g, or t
  misc_feature (287)..(287): n is a, c, g, or t
  misc_feature (378)..(378): n is a, c, g, or t
ngtgctttnaaanaaaagcttggaaagaatttttncaaaaanaattgggaggagaggggattttgccttnnaggggctttctttcttccccaaaggaggaattcagtcatgcantgggcaaaggcaagcagatgggaatttttgtttttcacggattttntcagggaaagacccnttccctttgccagcagaggaacctgtagttttttccatttnttttttcagaaccaaagtatgtatcactcctcatgctcacagggattgacaggagagaattcaccaggatnttagctcaaaagacacagcctcagaatggccagatggattgcacgaaacctgacttggattcaccattttcctcctgccataaggctgtgntcccacataacctcccagaagctccagggaagctttccaagagcaaaggcttggaaattgaatgttaagaaaattatgacataaattacatgtaaatagtgtatatgattaaatattgtccagttacattt

SEQ ID NO: 591665 - DNA, 627 bp, Homo sapiens
  misc_feature (208)..(208): n is a, c, g, or t
taaacctttccttatgagcatgcctgtgtggggttgacagtgagggtaataatgacttgtgggttgatggtaaatatggggctgtaaatggtcagtccagtgtttaaatctgacgcaggcttatgcggaggaaaatgtttccatgttacttatactaacattagttcttctatagggtgatagatgggtccaatggggtgtgaggagntcagtaatatgttggggatattaaggtagtgggtgttgagcttgaacgctttcttaattggtggctgctttaaggcctactatgggtgtcaaatttttaactctctctacaagggttttgtccctagtgtccaaagagctgtccctcttgggactaacagttaaatctcacagggggattaaaaggggtccggggggcaatttcaaccgttcgacctaagatcctatctgggacaaccgagttaatcaccaggctcggaaggttggcgcctctacctataaagtctgcccacatatttggctacataaacggggtgtgcccttaaagctggtcctaagggtagctcgtcgggtaacgggggtctaagcttgggctctccttgcaaaggtattcctagtaatgcattatgcacaaggtcc

SEQ ID NO: 591666 - DNA, 253 bp, Homo sapiens
ctatccacaaaatttcgcctactgtattattctagaatatgtaccggttgacaagtcttagcgttacgttgtttacatccatcttgggtctagtgtgaatgtgctgcagagatatggatctagtcttgtccttccacctttgttctattctttgtccccaaaaccaagtattgaatagggtgtcctttccccagttgatatttttgtccgctaagttgaaaattacttggttgtaagtattcggccttatcga

SEQ ID NO: 591667 - DNA, 968 bp, Homo sapiens
ttgcatgggtaaagccaaacatcttgtcggaggatgacagctgcactcgcatcaagccatcgcctttgagcgcattggtcagcgtgtaatctcctgcactgttcgttgatgcgagaatgtcgagcgtaccggggtttgcaatggttacttcactcgaccccatgcccgttaccccatctgccgtatgagacgcaatggtcaggaggccgtcattgaccagacgttttaccgctataagtattccctgcattgaacaccgtatggcctgcatcatggatcacttttccgtctttatcgtcacctgtaatcagcatatcgacctggtagccggcatcactgttattggtatgattaaagacaaaaacgccgttcgccaagaccaaactccactttcgtcgcattggtgataaatccggcatctgacgccgctcaccgtgaggcagaccaatgtttagcgttcctacagcgggctccataaacacctaagtaaacttctccaccttacgaacattccagcgtaccgttattcgtcagggttaacgtacccgtaccagatgtccctacgtacatattgaatgttcacagaaagagagttctgcccatccacccttcacggtggccttactttgtcattgagacgcatctgtgtatcaccgcccttaactatacctccggtgtattatcagtcacccggtgcttaatacaccgacctgtagcaatgtgcgtaagtagatgatgtcttaacgtccagagatgtccttgaatattaatatccccgtacggagggattctccgagaatctaagcgtgaatagggtgcgtaagaattgcgaacggtacaataacaatagtccccgttacgatagctacagtaggacacgtcttccaaaatattgcacaccccgattagcaaccaaaggaaatatgacacccggaagcacgtcaggtgcacttatgcgaaaatatcac

SEQ ID NO: 591668 - DNA, 1052 bp, Homo sapiens
cctgcgtggtagcacgcccacgctgcggtgtcgcctatcagaagaccccggcgtgcttctctccttcccgcgctttttttctctaccccgcggcgggtgtgtatatatttttatccaacccgagcgcctgcttgtctccccttccgggctcgccttgtttgtggggccgtcgatcgttagatccaatcgttggttcgcactcaacaacaacagcttgggttgtctgcgtcgtccgtctagtttctcgccggatgtgttgtttttgctccccacccccttcctcctgtgggcgtcgctctctcctcaccaatgtgtgggtggggtcgacacaccacaacaaactgtttgtgggtggggtgtgttgtctcctcccctccccccccccctcctctcttgttgttagagagtgaaaaacgtcttatttttcatttacctcctaccccccctccctccaccatagaagagaaataatcaacacacacatacagaaaaattatatctattagaagaaaaagacattccccccctccctaactcactcctcccccccccgcttcgttgttttctaaaaaaaaggattcgtatagtgagtgacttttatatatgtagtattattgagttatgttttttatgagtgagaacccacgcatttctctcctctctctctctctctctctcgcaatataaaataataatcgtcgggttgttatagtatgtttttttgtctccccatacttgttttgttagttcgggtgtttatataataggctctcctcttctcctctataaaatatgtttattattttttttggtgtgtgtgaccccagccccctcttctctccaccgcacttggttgcatctatgagcgagtgtgtctacccaacaataatttttttttctccccccagcgagacctgcgcccgcttgctttttgtttacttggtctctccaccgacgcccccccttttttttctcccccccatattttttccccccttttttttcccttttttcccccccccccccccttttttaaaaaaaaattttgtgta

SEQ ID NO: 591669 - DNA, 1127 bp, Homo sapiens
  misc_feature (415)..(415): n is a, c, g, or t
gctgcccgtattagccatgggggccatgaatttgtcgcggcgggtttcggtaactgcggtggaaattctgtctggccggtccccttgaggcactcgcctcggattccgagggggctatacctacgagctcaggtgggctgtatccagacaggcttggctgcgtcactggtatacagaacacaagtggatgacgccatggagaaaagacgacgtatgtctgtacagtacatgaccgtgtctagaattctatcgacacggcgttcttggtggataagttattgatgattcctagctattagcattggcactggggattccacgtagcgaatgttgctcataacgtcgtggtgacatgtattcgaatttggtcaaagcttgaactagtcagacaattccaagaatggcatatgtcccnatgaaactagatgtgggaatattgactacagtcatgctcaccatttagtgctaagcatcgtgatattgctcacgttcaactatgtgctaatcgatatgatctctagtaatagatgatgattacttgtaacagcaagcaaatggtggccggttccgtatcaggatttgaacagctgataataggggtgaatttactgggtaaagagagactggacaagtagcagaaacaattggatggcatggtggaagaaggacgattgcgaccctgggttattcactatcgacgacaatctgagcattgtgattccttgattttgagtcattcctccaggaagagcaaccttgcctcgagaaattcaagccatgtgttgctcttctcccaaatatacaaccgtgattattcgttctataagttcgggacaatactagaagtgtaactcaaaatttattatttctttgtcattgtattcgtgcctacctccggtttgatcacaaacaagaaaatgaagccgttccttgaaccatttaactggttctactcaagatcgtatcgggtgtcaggacattggaggggcctttactggttgttgaaggaaggtttggggctttccacggtcccccacaagaacatggtttcgaacaacttgctgctaattacaaaaccctcgacgaaaataacagacaacttccgtatggaaccttccgtaaaattg

SEQ ID NO: 591670 - DNA, 138 bp, Homo sapiens
tagtgcagtggcgtggtcattgcttattgcagctccgactcctggactcaggagatccttccgcgtttggcctctggagtacctttgtacttgttggcttgttgccaccatgaccttgcttattttctgtagtatttt

SEQ ID NO: 591671 - DNA, 160 bp, Homo sapiens
  misc_feature (90)..(90): n is a, c, g, or t
  misc_feature (129)..(129): n is a, c, g, or t
  misc_feature (134)..(134): n is a, c, g, or t
ggagggattttcagtttgtccacatgttctctaacaacacttgcccatttctgtaaataatccaaagcagtccaaggctttgacatgtcnacaaccagcataactatgattatccttcaaaaatacagnttccngtgaaaatttaaggaggcctttgtga

SEQ ID NO: 591672 - DNA, 797 bp, Homo sapiens
catcggcgaagttctccacagtgagaaagccatgttcagttctgatgcgcccaagatcgtgacagcccaatggcgagcaagcctggcacgagttcagagtccaggcatctccacagtgctctctctaggcagcctggagaatgcaacctccggcaccgtctgaaggcctccagcatccagcggcagcatgacatcattcacgcgccagcttcaaggccacattggcacacgcttgcgtaggctaggtcaggcaacagcctcatccatcacatcctctctgcgttccccaggtatcccttccacacctggcacacatcgtttctccacgagggaaacacattcccgcaagttccccggggcctcaggtcaacgtgccgcaacatcttgcgcacagcacacacacagtttcccaagatcggcggcaaaggcgcataggtaccggttcctactctcaatccgggatacgaagcaggcgcagcaacatccccataggccactcaaaaggcccaacagcgatccggcacaacgaacaggccccggtcaaccaaccaaccacacaatgtaccacgccccaacgaaccacgcccggcattcgcaccaaagagggaaacgggaccccgggacacaccgttccccggggaacccagggacacacatggggcgggcccacaccaggggccaagccagcgcgcacccacaaacatacccccgcgcattccctcgcacaaaacgacggtcccacacccatcgcatgggggacggaccacacccgtatggttaacacaccaacggagaaa

SEQ ID NO: 591673 - DNA, 352 bp, Homo sapiens
gttcttggtgagaatagtgtgtcctgctctaatctatatcctgtgtgggaagtcgggtgtggaccgccgttctggtcggtgtggggtgggccaagcgagacagccgacatgggctaaagcacaacggtctcctaacgaagtggctggctttctcaaagcataggacagaagctgtctgctctcctcaatgtgctggtcgtgtaccgtagagtgagccaggatttcgggcagcagttttcatatattctactttcgcgtcgaggttgcctggcttcagcataggggagatgctttaacaggagggccatcgctttatccttggagttcctgtctgacaaagaggtgcctgggg

SEQ ID NO: 591674 - DNA, 332 bp, Homo sapiens
tgccgaggcagaaggatgtttgactccggataaggagcgctgtgtgcattcattccgggtgcatcggtgcgacagcagaggtcgggcggcgactctccggcagcggcggcggtaggaggcaccagcggcagtgcagggaccgaatccgagcagcgctgcgttacctctctctctcgctccttccccctctaactcacgacatgcaagtcgctccctgcgtggctcgctttcactcctccggcccggcgggtgtgatgtgccgcgccgctgcccacgccggcgctgacgtgactggcgccgcgcgcccgggaccgacccctcctgtccggacc

SEQ ID NO: 591675 - DNA, 490 bp, Homo sapiens
  misc_feature (236)..(236): n is a, c, g, or t
  misc_feature (300)..(300): n is a, c, g, or t
tcattccacagacttctccagtgtactcctactccagtgcacccaggttatttgcatagtttttaagttggatttggttttgagaaagcaaatgggtgtcttgtttacatgatcctgttatttcacatcccagatgtgtgtgtgtttgccagcagagcgtgttgcgcttccagcaagctcctccgcaggacatcacggacaggctctcttcccagtcaccctagaacctctacagngtcccgctcgcgcccttactgctcgttgtgtgcccttgggttcaagcagcttccttctaagccnttggtctgctcctttctttgtcacgtccccctgttttcctgagagttaggtacatacgcttacgaacaggatcttgcgggcttgtatttcttctagtgcgccaaactcccagagatagcccaggactgcatgggttttctaggtctgcgatgtcttgtcacatggcggcagagcattaacagattgacag

SEQ ID NO: 591676 - DNA, 170 bp, Homo sapiens
  misc_feature (49)..(49): n is a, c, g, or t
taccaggtcttttccctcaacgctgggctcatacaaacaatctccatcntggctcccaaagaaagtgctagaattacaggcatgagccactgctcccagccagtttttttttttttttttttttttttttttttttttttttttttggggttgggggggaaaaaacccgg

SEQ ID NO: 591677 - DNA, 313 bp, Homo sapiens
cttaaccctgacatcagtataatgaaagaaatgtctcttgggcaggtacagtgactcatgcctgtaatcccatgcattttgggaggcgagggcaggagggttgcttgagtctaggagttcgaggttgcagtgatggtaggactgcacctgttgcacatccatgcctgggtgacaaacgactctgactcacaaaaaagagaaagtctctttgattggggaggccctgtgagactggcagcaatgactaatgggctattcctactcagacagcagataagattcccccttaatcttcaaatcattgaagtcatga

SEQ ID NO: 591678 - DNA, 548 bp, Homo sapiens
ggctcggtacctattttcacagggtgagatatgctagaatagctatcttctttcaaaaaactactacagagaaaaaaaaaagaatatgttagccagttatctgtcaaaaaaatagtgaagggggcaaatctggcagctggctgatggaattatatatttaaagaatccatatcaacacgaagataaatctctattaggtcacatggtatatatagaaaaagacttagttaagagttttagtcatggcaagctcaaggaaccaaagaatgacatgacttaaaaaaaaccaaccaaccaatctctcaggctaggacattagaagtaaggtttacaaagggaagccctataaatgagagcaattgggccctatcaagcgcattactaaatataaacaagtgggatagtaaagaaatctattcgggataccatgtcacacaagaaatggttaaagctaaatagaagtatttttatctaccttagaagaaaaaagatttacaggaccatagtagtttatttcaaactaccagaaagtttagaagatgaaataa

SEQ ID NO: 591679 - DNA, 1048 bp, Homo sapiens
acaaaaaaaaaatctacgggtctctggtacgaaggctggggtttgtgaaattcagagccacggaggggacgacgacgacgacgacgacgacgacgacgacgacgacgacgacgacgacgacgacgacgacgacgacgacgacgacgacgacgacgacgacgaccactgaggtagtcgacgtacgcactcactcagtagtactatattactactaattaattctcctccttattattttctttccttccttccttatctacctactacctaacagaacttttctctctacctctactcttcctacttcgccagtcgacgaacgactgaccgcatgccttattcctttctttatttatttcttactttcttctcttcttcatattcttcttatttactatgattcgatcagttcctaattttttttttttcctatacactgactgccggccgattcggctccccattccttccctcacattaaaccacagatccactccttaccccccacatccgttgcgctccgtgtttgacgagggaagcgtagacaagtgagtcgcgcgagcgcgccgcgcggccctgaaatccatccattaacatacatgacgaggaagaaatgccagccccgtcctcccgatccgttgcagatcaccccatcgtttcgggatcggttgcattggaatcgatctgtacgcttcctgcgatgcctttccttgccgtttcgtctcgtagctcttccttcgagacgtgccgttcacctcccgatgcacattgcttcgttaccttctcctactctcgttctttcttctttcgctctgcctcgccttcgccatccgcttccgcctcccttcccctccacctccctccagattcacctcagcccccgcgccccctacccacacactccctcgcccactcccgcccccgtctcgcctccctccccagcaccacccttcccatatagactcacaccgacctaccccttgctagcccacacccacactaacactccacaccacaccacaccaataaagcgcgaccaacccactcc

SEQ ID NO: 591680 - DNA, 583 bp, Homo sapiens
  misc_feature (92)..(94): n is a, c, g, or t
  misc_feature (97)..(97): n is a, c, g, or t
  misc_feature (156)..(156): n is a, c, g, or t
  misc_feature (184)..(184): n is a, c, g, or t
  misc_feature (191)..(191): n is a, c, g, or t
tcacactgcacatgaaacaattaatctgaatcacagaggaaaaaaagatggagggaatggcgatcctcagtgggacaatatctagcatctannntanatgtaatagagctctggaagattgaggaggaacaaggggagagataggaaaactggaanaataatggcagtacattttccaaaattntggtganaagtataatcctacagatccaagaatgtcaacaaaccataagcaggctaatcacaaagaaaactacaccaaggtacattgtaatcaaactgctaaattccaatgacaaaaacatctttaaagtagctggaggagaaaaagaatattacatactagagaacaaaagtaagaccaacagcagacttcaggaacaagacaagcctgagacaacagaacatccttaaagtgctaggagcataaaggtgaaataaggacaacctcagacaaacaaaagctgagaaaacatgtgaccaaaataccagtactataagcaaagttaaagttcttcagactgaaggaaaatataccagattcaagctcagagctataaaggaatgaagcctagaaacagaa

SEQ ID NO: 591681 - DNA, 347 bp, Homo sapiens
  misc_feature (125)..(125): n is a, c, g, or t
tgtggaccccgctccacccgacgggggcactggaatgtctgttttacacacacacacattaatatcatctgaggagcaattctaccagcttttatttcttaagtggccaatttgattgagaaagnacaaagcagaggaacctctaaaccaattaataaaagtcctctacttacaatccaaaccagaacctcatcattgtccttatccagcaagcacagggtagacagcagacagagaaaacagagaacacagtcagaaggcatcaacaggacaggcagacagcagtgcagaaattttgcaaatctgattccagttgtagacggactgctctccccaccccgcggagc

SEQ ID NO: 591682 - DNA, 266 bp, Homo sapiens
  misc_feature (34)..(34): n is a, c, g, or t
cccccccccaggggaattttttttttgggggggngggttttttttcccccttgcccccggggggtttttttttaaaaaaaaaaattggggcccccggggggggggggggggggggttttttttttttgccgctcccggttttttttttgggccccggggtttttttttttgttttttttggttccccccaaaaggggttttgggggggaaaggcccccctttttttttttttttgccccaaaccccaactttgtttccccccccca

SEQ ID NO: 591683 - DNA, 603 bp, Homo sapiens
gcgcgggcgcggcgagcgcaggccgcccgcgcgtccaatggccggcgcgttcaccggcggagcgccaggcctgcagcccctattggccgcggaggtccccacctcagcgcggcccgcccccggggtaggagccgtggcggactctgtgacgctcagacgccgcgcggtgcgggggattggtctgtggtcctctctcggctcctcgcggtcgggggcgaggtccgtggggacacctggtcttgctttggccgtccgtgcggctctaggacttctctgcgtgcgctcccggtttcgctggacgggaagaagggctgggcgcgtcccgtctccgtccccatcggaaccccaagtcgagccgctgacccgtcgcagggcgagatgagcgcggacgcagcgggcgggtgcgctccctgacccgcggatctgctgcctggagaagggtccgaacgggttacggtattccagctgtcgacgggggagaagggcaagtggggccgatgtacatccggctggtggagccccggctcgccggccgagaaggcggggctgcctggcgggggaccggtggttggaggtgaaccgggaaaacgtggagaaggagac

SEQ ID NO: 591684 - DNA, 1155 bp, Homo sapiens
ggcaccagatgtcccatgagtagaggtgaaagggagatggagcagaagcaaggacgttgtctgtcttatcctggtaaaacccataggtgctgctgctttatctgtgaagcactcattctcctaggaacgcctgttccttagcatttcctacatttcagcccttctgtgtgtacacctgcggtttccatatgacccacacctaaaggttctgaattctactgctgaaactatctaaaagtggaagaaacctacttgcacattctcagtacacttggatccaaaatgtctacacttgatgctccggcccaagcctctgccctgtgatggcatactgtcatggagatagtgtggcctctgcacatgggcctccaaaagtaattcagtcctttgtcctatgattcccttgacagtctttttctttttctttttttgatcaagcaattatgttaaaattttcagttctaagctttgaaatatggttctttccatgtaaaaaagtcaactgaaggactgccatgtgatagaacattggtatgaaggtgtcctcttcaatgccagtcaggcctaaaagattggtattttattgtgtctgtctgaatgctgttcagtggaatgatgcttttgtaagtgtgagtcttaccaatgacgtaacagtttaatatcgttgaatgttttcaataggccaagattgctgactggaacttggtactaaatctcgggggatcccaaaattaggctcttacactgttccacaacgtggtttctgggcctggatgttacagattacataagggtcgacattaacccaggtatcaacggggcccactttgggcggaaagtaggccacaggggcgggcacacaaggaggaacaaccaggaaggcaagggggagatcaccccgcgtacacacctaaacacaagataaataatgaggaggagatcccacagatgatgacaacagacgaccataacagatagaaaaacatcatctatgaaaacaacaaaaggggtgaatacgaaaagcacgacaacacccagaaggaaataaagccgaagaaatcgcataaacaagagacaacgacagcggcacagacaacaaatgagacaaaaaatcagacaccggaatgctacccctctcctcatttccctcaagtg

SEQ ID NO: 591685 - DNA, 106 bp, Homo sapiens
gggaatgtaggtctttcctctctaaccccagacccagtcagacaaggtcagtggctccccactgtattctggcacagagtcatttctacacagccaaatgggggtg

SEQ ID NO: 591686 - DNA, 202 bp, Homo sapiens
atgctgtacgtttccctggtgagcaccctcctctcggcctctgggcaacacagtcccaaccatctgtggggtaacaaaggggtgtggggtgtttttttcaaccctgcttaactgtctgaatcaagggttcccaactcaagcctgcaggccaaattcagcccccagcctgtgtttgtgaataaagctttgttggaacaaagcc

SEQ ID NO: 591687 - DNA, 597 bp, Homo sapiens
acgggtgtgctctgccacctggggcaccccttcttccctccaggatccagcaaggagttgtttctcgcagtagccgcccaacgggggggctctttttgctacttgtgcctgccgacgctgggaggagagttttctgtaaaaaacgataattggtggaacaacacacgtgcgtgagagcaatttgccgtgcgtgcttgcgtccgattgtggctaacccactcgagtattgtcgggcgggccccctgtttttgaacacggcgtgcgggggagaggagttctgctgcctccgctcagcgtggtggaaacaaaaaggggcgcccgcgcgatgttgtatttactccagaaattcggggctggtggtcaggcccacaaccccccgttttaggatttttttaataaagggcgattacgccccccctctagttcgtgggcattgttcacaatcagtattagttgggcaattcgtgttaatacaggcaacaacattgttagggtacggaggcgcaagacagacaggagagttgggggaccccgataacagacgcatgccgggcagacgcaagcccggtttctacaacaagagaacaacaacaatcg

SEQ ID NO: 591688 - DNA, 225 bp, Homo sapiens
tatgcggcagttagtgaagcggagttctcactgtttgaacacaacccaaaatggctggtttaagggctctgatcaggtgagcaggcagtgcccccaatccaccctctcccatactttgaaaacgtaaatcattcttacaatatatatcttcaaaataggagttcccgacgtggctcagtggttaacgaatccgactaggaaccgttcacttaatgccgctagcgc

SEQ ID NO: 591689 - DNA, 611 bp, Homo sapiens
  misc_feature (519)..(519): n is a, c, g, or t
ggtgagtgtgcaggacgcgggtcgtgtgggaacgccagacctgggtcagagctcgagccagtcggcgcacgtatagattctggagatgcatggcggctcgtgatggtcgcgagctatggggcggcagctgtgtgaggctcgaggtgcggaagctcggcgggtcacggcgctcctggtgcagcgcccggccccggtaccctgctcggtcggtcctatgccggtgggtgcctgcgtcgagcgtggctctgggacaagtctagattcctcacgcagcattttggaccgctcgtgtagctaggaaacaagaccggtgccaaaggtcgagaactcttaatgatccgttcgtcgtgcgtggaaatgtaaccacaaggtccatgctcagacaacatgcatcaggtgtggttccgcatagggccggtgcgcgttgtcgtgcaaacgagaggaggcaagagcacagtttgtctttaaagaaggctgggtgggagcctggtgctgcccgattgtcttacggagggaagntgaacgtatacccgccaagaactgacgtctctggaggatggtgggagcgagaagccacttggtagggtcctccagagggattctggggggcc

SEQ ID NO: 591690 - DNA, 441 bp, Homo sapiens
  misc_feature (220)..(220): n is a, c, g, or t
  misc_feature (432)..(432): n is a, c, g, or t
atactttctgcctgagaattacatgggaaaatcttaaagggaacttatcagataaatggaattatagtgtcccttggtaatgagtgatactgaatatgtactttcctgggaaaattgttcaactgaaggaaaaaaatacacacacacacctagtcctgggagagtgccagagtgctgttgacagtcccttaatgtaattcagacaaagtgaaaggattcnggcttctggcttctgaactttaacttaactgcccataagtgttgactcattttaatgcttttcatgatttctgcattgacagaattttcatactttgtgtgtgtggttttttttaaaatgactttttttgttaacttcagacatatttgattacttttagaaggtagaaattgccaccaactttgtggtattgaataagtaagaaattgcanccggatttt

SEQ ID NO: 591691 - DNA, 279 bp, Homo sapiens
aaagccacctcatctaaaatgaaggttcccaattttttttgtgagacagtctcgctctgtcacccaggctggagtgcagtgagacaatctcagctcactgcaacctccgtctccttggttcaactgattctcctgcctcagcctcctgagtagctgggactgcaggcgtgtgccaccatgcctggctaattttttttatctttagtagaaatggggttttgccatgtcgcccaggttggtcttgaactcctggttcaagcgatctgtccgctttggcct

SEQ ID NO: 591692 - DNA, 338 bp, Homo sapiens
cggtagcccttaactctacggcagggtctatattgtcggcatcagaggagctggaggcactgatgcaggaaacacacaggagttatgaggacacactaacaatcccaaaagtagcctaatgcaagggcaacacctgttgaccttgtacatgatcaaccactgaaaacagagcagctgaccatctgagagagaccaaggccaagggccaggcagaactctgatatcttagccacaaagctcatgcaccgtacagctggctccacaaagcctctgggaagggctgtacacacggatccagaaagctggctcagacattccctagggctaagggctcccgg

SEQ ID NO: 591693 - DNA, 361 bp, Homo sapiens
tcccaaagtgctgggattacaggcgtgagccaccacgcctagtggagtgatttcctttcatagtaaagttttaaatgtggtatatttgaatgacttttaaagaaggaggctgggtgcgatggctcacacctataattccagcactttggaaggccaagatggaaggatcacttgaacccaagagttccagaccagcgtgggcaacgtagtgagacccccatctgcacaaaaaaataaaaaaaattagctgggcacagtgcacccgcctgtaatctcttaggaggctgaggtgggaggattgcttgagcctgggagggtgagactatggtgagctgtgactctgccactgcactccaggctg

SEQ ID NO: 591694 - DNA, 286 bp, Homo sapiens
agtcggtacccctagtttagaagtttcaatagcaaaagtacataataggcacagaaagaagcaacatatgaaagagatttaagagcctctgtttcacgagaatttatgctttacaggttcacagtaacactttatatttaccactctacataaaaggttcaggccgtgagcacagtggctcatgcctgtaatcccagcactttgggagggcgaggtgggcagatcacttgaggctagaagttcaagaccagcctggccaacatggtgaaagcccgtctctacaaaa

SEQ ID NO: 591695 - DNA, 1322 bp, Homo sapiens
gcacgagcggaagacaagcggtctggtacctccggtaatgctaagtcgtcgtgcaacttccggtgaggtgcttgtgtgcctgtgtgtcgcggagactacaggggcccacgtggattgtgttctaagaggctacgctgcgttcatagcgcaaacactgtccgcgtgggttcccagcgccgagttgttgactcgcacagcagtttacgcagttctctgcgacccgagggttcggcgtcgtaccagagttagaactatgtctctggaagggctattgaagcgcacgggtgggccttacatcacggtaagcttgtcaggaccgggacataggacctgtgtgtcaaggtaagtgtcgtacacacagcacgagagaaaagggtagcctgatgcacaattactttgagactttcccactggcaccagggttgatctcaacctttaggtatcaagagactagacgctatgaaacaaacaattggaggttgagttgtagactggacgcggggaaattgacatgcttgacacggcaagatcctcatgggataacagacgggggcaccgcctagttgacggccaaggcttaaacatgggaaaattactaaagtatagggctactggaggaatatcccgtagtggggatccatggcctgttgctaacaaacagaacattgggtgctgaataattgtcctacaaggggttcgttaacaatgaagcatgaaaaatggtggctgataggacttgggggggctcgtatttgtggagtatgagttagggtatttggactttgttcacagtgttgtgtgtattaagaatgggaacggagggcccaaagtgcgcgcccttaaaggtgttttagtattaaacggagtgggtggaattcacctttggattaaggggggtattacacttaacccatgggtttgccaggctttttgaaaattagagaggcccacacctatgatcaattacagagcgagcaagaattctcagaacccacacaactgggtcggaaacaatcaccaacatggccacatgggacatcttccccgtttcgtttccaaaaaacgggaatgaggagagtttggctagaacaacacatgtcaacaacactttgtatggcacatagtgggggacaaccccacttatggttgatcagacaaagatgaaacacgtgcgtatggtcaaacggcgagaccgtgtggaccacaagtgtacccaatgtgcccctgtgggtccctgtaactgtggggtggcgtattgtgacaccacgttgtggacatagtggcaacaaagctcgttttccccggcaaacagttcgggtaca

SEQ ID NO: 591696 - DNA, 310 bp, Homo sapiens
gctcgacagaaagagacatcagacaccacagaatttaacgtgccatcctcccaacccgggcacgatctagttaacccagtgggccttccttaacccacccagtccatcttcccaaggccagacactgtgagtgaccacagattaggaccgttaaaatgtctgtggatgtttaaacggctagatttgttatcgagactggttggtggtccttatatccaccacacgcacataaaacaatacctgtcgagaacccgtgctgcccaacagtgctggcagattctcaccagcactgcttttcccttgtatgtcg

SEQ ID NO: 591697 - DNA, 136 bp, Homo sapiens
  misc_feature (87)..(87): n is a, c, g, or t
attaagatcgtatcataaagaacatcgtatcaatcaatttctttcaccagcatggggttttccattgatcgtagtttggcaacaacnaagggtactggtatttatacatttaaagctcatggccgggtaccgagct

SEQ ID NO: 591698 - DNA, 848 bp, Homo sapiens
taagttaacccccttttattaagtgatcccagctgtggtggaacctgcgtgcggttgctcagcctgtgtctttaaaacattaaaagtgctcttctccaattctccctctttgtccaggacaagagggatctttccaggatagcacgccaacagaacaagagatctccgatgaccgccagctttcaatgtgatggtgccactccagagagggagaagggctcagtggcacatttcaaccggggcttctccagaaggttttggaaaagaggacgccttgtgggggccgcagccgtgccgtggcattttgtgagtgctgctcgggtgtgagatttggtatctccataagtgggtgtgaggagaggttaggttaagcactcgcccgaagtgtgttgtcccggaatctcgggactgtggttgcgtgggacacgggcagtcttatcccatatgtgaacataagtgtcttccgtgaaagccggacagaaccaccaagaggcccccacagaatcttccttcccaaaccgagtgaactgtgttcccccagatgtgtgccaaagagtgagatttctcccagacaacggagaaggcccaagccctttccgcgagccgaaataactccatttgccaccattataatgggacatcatcctccccacatggggtaaaattccttcttttgacagactatggcaacttccctgtgtggcctgctcaaggtcccccaggacgtaccaatgtgcgcaaaaaaaacctccaaaaatggccccacaaaggcaaaaggggccactcgagaaggaacacacggcaaagctccgggagcccgggaacggcgggagaaccccgaagaccat

SEQ ID NO: 591699 - DNA, 1235 bp, Homo sapiens
ctacaagccacagaagactgttggaacacctatggcgctattgagttcggggcgacagtgagacgtggtagtccgtagagcgacaggtcgtaaggcctccgtgtagttcgaggccgaggcgtggagccgagaccaggtcaaagccgtttcatagcgtaacgatccacattctacaccacgtttattcgtcacgggatccatggcatctgtaattaatcttcttcattagtaagtacccatcataatcggaggctgcggcaactgagctatgttcgcccttaataatacggtgacccccgatatggctgtttgccccgcgataagacaaggatgacagctatacgtgactctatatcccaccatctctccatactccgtgctcgacatctgcatagtacgtggaggcgcggagccagtgaatcaggcttgaaccacgtgcatacctctccgcttagcagggaaacgtagtcccaccctgtggagcctccgttaggacctaaacgcagtcgttctcgctgtgagcacctagcagggtatctcctctgatctgtaggggtccagtcgactgtgtgcagtcacaacaaggttatcaagtatacaagacccccatgtacataaccgcaagtaccaaatgcccctgcttcgtctgatccgtcctagatcacagcagtgccgtagcttctgcctatctctcgcgcagtcctagctgctggcaatcactatactactaagcagacgaatctcagaatcaacttcgttcgaccccggcgggaggaaggaggacctcgagtctattacaaagcgtaatctgatgtacgggtgacgctggaagtttatattcttgtcgtaccaggggctcggaatactctcccatttggtactgactaacgccgcggaaaaagaacccttggtttaacaaagacatgggctggaagaacgaaaattagcggggggcccgagagcggaaccggggggaagaacgcgcctaaattttacaggacgagcaaaaagaataaccacagggaatataccacggtcacaaaatatcggggccccagggggaacgagataatgtacatccacacccccgaggaaataggtcgtccgcgcagcgacgaggacgtaccccaacgaagtgaggtcgcacagcaacctccgagagcagaagagaaccatacaagagatgagagacgacctcatacaaatatacaattccatatctgcccgcccacctc

SEQ ID NO: 591700 - DNA, 129 bp, Homo sapiens
tctgctggtcgtatctagagtatcccccacgatgcgccccagtgttaaattcattaagaatttttgcggctgatcatcggtggctaatgcctgtaatttccagctctttgggaggccagaggcatgaag

SEQ ID NO: 591701 - DNA, 242 bp, Homo sapiens
  misc_feature (45)..(45): n is a, c, g, or t
  misc_feature (104)..(104): n is a, c, g, or t
  misc_feature (107)..(107): n is a, c, g, or t
  misc_feature (123)..(123): n is a, c, g, or t
  misc_feature (187)..(187): n is a, c, g, or t
cgggcacatcatactttatttcaactagaaggtacaatctctcangggtttcatagtttaaaaagctacaatcacagcatggggtaactacataaaaaacaaanctntaaatggaactgcttngctttaaccatacacatttctgcccagcccttacaaaatctgcacaaaaaaatatctccctttnctccagttaattgttcttatatgtaagttgctttctaggcagtatatccaaaatg

SEQ ID NO: 591702 - DNA, 968 bp, Homo sapiens
gttttcatgctatttcactctattaaatcttgcaactgcactcttctggtccatgtttcttacggctcgagctgagctttgctcaccgtccaccactgctgttgccaccaccgcagacctgccgctgactcccatccctctggatcctgcagggtgtccgctgtgctcctgatccagcgaggcgcccatgccgctcccaatgggctaaaggcttgccattgttcctgcacggctaagtgcctgggttgttctaattgagctgaacactagtcactgggttccatggttctcttctgtgacccacggcttctaatagaactataacacttaccacatggcccaagattccattccttggaatccgtgaggccaagaactccaggtcagagaatacgaggcttgccaccatctggaagcggctgctaccatcttggaagtggttcaccaccatcttgggagctctgtgagcaaggaccccccggtaacatttggcaacacgaacggacatccaaagtgatacatcctgggaaggaccctacccagtcattttatctaccccaatgcggttaaagtggtggagtggagtcttggatacatcacacttgagtcaaatcctggatactgcaaaggaacctgaaaatccaggagacaacgctagctattcctgtgaacctctagaggatttgcgcctgtcttcaaacaacaagcaggagaatcgaagctgtaaaactacaaatggggccaagatgcagtcaagataagatctacggagacctggacggcggtagccagatctgtgttatggctcaggccctcggggaatttagggaacttatagcccaattagcgaacagtaagcgggggcacccccaagctggcggggggggcggacgcgacgggcgggaaccaccgggggcgcccagcggcccggcacacacggggggcactctgggggaccgccccaaggc

SEQ ID NO: 591703 - DNA, 318 bp, Homo sapiens
tgaatgaattttcacaaattaaatgcactcatttatctgcacccagatggggaaataaaacatggctgggcacggtggctcatgcctgtaataccagcactttgcaaggccaagatgggagtatcacttgagcccaggagttcaagactagcctgggcaacacagtgagaccccatctctacaaaagattttaaaactagccatcgtggtggtgtgtacctgtagtttcagctacttaggaggctgaggtggcaggatcacttgagcccaggaggttgaggctgcaggagctttggtcatgccactgagaactaccta

SEQ ID NO: 591704 - DNA, 476 bp, Homo sapiens
acccaagaatggcctttgtgaggaggcactgtgccgttccagtggctttctgttacagctggccacaccatacaagcaagtacatcatctgcatgcactgctcctcacaggagcttgcacttcattcatatttattctgccctcatttaaggtataagcttagtgtcctaatatatttatttttggaaagggccaagttacaaaacatcttttttttgaggctgcactgttgatatgtcatgcagtggccaccaagaaagtatatactcgtgttagatactgattacatcatttacatcacgctcagtatttggaattaaagatgtgaatgttctgtgaccagagtagggatgacacaaatggaatcagctcctggtggactaagaatcttgaaaaaatctggccacctcatccactacatctggattgagtgtactgcaacaaagaaaaacattaaacaattttatattaaaaga

SEQ ID NO: 591705 - DNA, 159 bp, Homo sapiens
ggtacctgactggaggttaatatggtggctggattaatgcctgattgctacctcggatagagcactggtgagtacacccgctcgctgtaccaggtggtgaccatctgctgctggtggtgtcatggatcgcggcggtgctgttcatcccgtacctgggcg

SEQ ID NO: 591706 - DNA, 379 bp, Homo sapiens
atttaccttctttttctctatagctcgacttataccaggggtgtgtgttgtcgagaggcacacaagagagaggatgttcatcggtttaaagatttgtgagaagataatttcaaagccttgttgttgagatgcctttgcttagtatcttcatcagtgaccatttggagatcatgttacattagtggatgaagttactgcatttgcacatgtgttgcttatgagtcagctgcaactcttagcgagacctatggtgaaatggctgactgctgtgcataacaagaacctgagagaaatgaatgctatttgcaacacatagatgagccccctttaccgattggtgagaccagatgttgatgagatgtgcactgctcttcatgag

SEQ ID NO: 591707 - DNA, 140 bp, Homo sapiens
ggctggtccccccagtctctgagtacgctcagctccgttggagcaccccttccgctgggatgtgtttttcccatgcagcctttttccctcgggaaggagaagtccagtctcccctcctgttgattgttttcttcttggtt

SEQ ID NO: 591708 - DNA, 212 bp, Homo sapiens
aacaggttgaacagtctaccctcccttagcagggaaactactcccaccctggagcctccgtagacctaaccatcttctgcttacacctagcaggtatctgcttctgatgcttaaggggccatgcaatttgcatgcacaacaattgatgcaatgatgaaaacccctggccatgaacccaatgaccaaacgcacctgtggcgtctggatgactg

SEQ ID NO: 591709 - DNA, 220 bp, Homo sapiens
gaaaacgtggagacgactttaaaaggaggggaaaatttatagattaaggactcaagatgatgtagatgaaaacaacactttggaattggaaatttccactcaaccagattgtaggtgtgacaaagtataatatgtgcaataatcattgtttctcttatgatttaattcaactaaaattctacttggaggaagtgggacttgctttatattttccaactgg

SEQ ID NO: 591710 - DNA, 407 bp, Homo sapiens
tttgtctgcgcacaggggctcttgcctgtaattccagcacttcggcaggctgtggcgagcagatcactttaggaccggagtttgagaccaacgagtacaacatggtcaaaccgtgtctctgatacaactacaaagtattagtctggtgacgtacgcaggcgcctgaactaccagctactgaggggagactgtggcaggtgaatcaattgtacactgcaggcagaggttgcagcgtgccgtaatcacgccaccgaactacagactggtcaacaaaagtgaaactctggtcacaaaaactaatatgaatggcgataacagatatacatgtcagccgccttgagccatacgactgttgactcgatcatgcttatgcatgcggccgttcgagctcctgggccttcgccctt

SEQ ID NO: 591711 - DNA, 171 bp, Homo sapiens
gcaggatccccttgcacaccatctgcatgcttctggtccgcctctaggaagcttgcaatcatgcatggcaacatgaaggtaagagctggcatatcacatggccagacaggaagcaaggcggggtgggaagtgtcacacattttttttttttttggaggagtctctccctgt

SEQ ID NO: 591712 - DNA, 508 bp, Homo sapiens
ctcggctctacctgtccgtctatcaaaaagacagacaaggatgtggagaaatcggagccctcatacttgctggtgagaatgtaaaatggtacagctgctgtaagaaaacagcctggcagttccccaaaatattcaacatatagttaccatatgactcagcaaatatactcctaggtatatatacccatgagacatgaaaacacacttctaacacagaaacttgtacacagattatcattcataatgtctagaaagtagaatcaactcaaatgtctatcagctaatgaatggattaacaaatatgcctatacattagaatgttaattattcagcagtaaaaagcaatgaagtacagatacgtgctaccacataggtgaaccttgacgacatgctcagagaaagaagccagtcacaaagtactgcacattatatgatttcatttatgtgaaatgcccagaataggcaaatccatagggacaggaagtagacaaggtagagccgaggggta

SEQ ID NO: 591713 - DNA, 110 bp, Homo sapiens
gaagcgcacgattgccgtccacagtgaccaagaatggtgagattgaccaccaccgtgaacagtatgaaaatctaagaatggacactggagagaaaacttgaggagctcga

SEQ ID NO: 591714 - DNA, 427 bp, Homo sapiens
atccccgagccccgatcatacagggggacggttcgattttcatggtgtactgagaaaacagtcaaagtatctacggagcaaccatttcactattatatatgggtctgagtataagattaacaagcaagagagcctgggaggagagcctgattgagccaggtggaagtgtagcccaggatggaagtgaaatgcaggattaagtgtcttcttaagcaataattactactaatatgatcaagtctgtcagtcctgatcggggctcggcattttgaatcttagagcgacagcctataatcactgcgcccgcacataaggggatggctatggctaggtttatagatagttgggtggttggtgtaaatgagtaaggtaggagtccgaggaggttcgttgtggcaatcaaaatgattaaggatactagtataag

SEQ ID NO: 591715 - DNA, 161 bp, Homo sapiens
  misc_feature (87)..(87): n is a, c, g, or t
tcaatcctccctctagctatttgaaactatatattattactattattattttgtgtgtgtgtgtagacggaggtcttgcctctgttnccacaggagtgcagtgagctgagatcgcaccactgcactccagcctgggcaacagaataaaactccttctcaaa

SEQ ID NO: 591716 - DNA, 666 bp, Homo sapiens
  misc_feature (264)..(264): n is a, c, g, or t
  misc_feature (289)..(289): n is a, c, g, or t
ttaggccccccccaaaaccaaaagggggtgggtcgtgtgagagtgggagggggactggttccccacttggcacaccctcttagatgggggaaaagggattcttgtttgttttggtgtaaagggtcttccccccccacaaacaatggggtggaaaggtcagttccttcaggaaatattattcgggagagataagttcccttggcttctggattctgggttaccccaaggtaatgtggggccccctttttaaactgtcaggggtgnatagcacccctatcccccccccccnccctgtggggaaaagagaggggtttttttcccccaaggccccggccctttagttttttaatattttccccccggcccaaaagtttttttttaggaaagaaaggaaaggggggccaatatccctttttttttggattgggcctttttttttccaaggccaaaggggggttatattccctttttccttttcctcttgggcccactggttggggggccccccccctgggttggaatttttcggccaaagggacaaagttttttcccaatggggaaggggtcccacccgtcccaaaaaaaagtttttgtgggttttcccccccccccccccccggttcccccctgggcttttttaataaaaggggggggttttttttttta

SEQ ID NO: 591717 - DNA, 1207 bp, Homo sapiens
gggtctcgtcatgtcggccacgccgctcccgtctggggtgtcgttcgctctttcctttttactcctccgccgtctccgccgtttgtgtccttgttctcttccgttcggttcgctgctctttgcttctgttgcccgggggtgagcggagttctatgagtttctcgtgttcgttccctgtgcgtgtgtcggctggtggtggtcgtctccgctcgcccctactttcttgcgtctgcgtcctggtgcgttttcgcgcctgtcgttgctcgggtcgttctggttggtcgtcctcttccgctctttttgtgtgctcgtccctctttctgttctcgccttctcttctccgggtctcgcgcggcatccctgctgctgttgctcgcgcgcgtccctctgcgtctcttgtcttccttgtgcgtcccggctctcttgtcgtccgatcggttctccgctcgttcgctgcctcctcgtgcgtcgactgaccgctcgccttcgtctgccccccgcggcgcgggggtgtttatataacccagcgcctctgtttttgtgtcgcccctcgctgtgtgctcccttgtggcaccccgcctccccccgcgtgtgtgtggccccgcctctttgtgcccctcctcggccttgtgctacgccgctccgcggttttttgtctcttgtccccgcggggcgcgtgtatccactgttgttcccccgtcgttcctctgcttttgtcccctcgtggcgcccttttttgggggcccccttgtgaccacctcgtgttggccccaaagtccacgcgcggtgttccctcccgcgaatttcccgcggcaattttctgcgcccccccccccccctctttttttttttttttttttttttttttttttttttttttttttttttttttttttgttttgtttgtggtgggtgaatgagcccccctgtgttttggtaaatatatttagagggagtatccacctttgatagaggattgtccaaccattgctcgacagaatagcggccccgatcctttagcccgagactcttcttggaacccatttaagagatcctggggactgccccagatcagtgggctgtaatgttgatggcccgcccatcctccatgacaatcatcgatgaccatcccaccagtggtgctgtggaaagccccagcccagttaagcaccatagggaaacatttccatccaggatcatttgacca

SEQ ID NO: 591718 - DNA, 912 bp, Homo sapiens
  misc_feature (1)..(1): n is a, c, g, or t
  misc_feature (3)..(3): n is a, c, g, or t
nangcgaagaagaggaaagcagagaagaaacaaaacgaaaaagaccaacaggagtctcccagtctcggttgcaaggagtgtgttgcacgcctcggtgcacacgctgcgtccgccaaatgtcgggccgtctaaacagcggggccaaaatgtcgtcggtctggtgcccctgccgagggtgcccgtgccctttaaaatgtagctgggccaaggccgaaacgtgccaccagggggcgcccatctcaaactcagggactggctggtatctaagtttaaaacacgcgttaagcgaaaaaattttaaatcgggcgagacaatcctcccctgtctttggtagcccagggaagaaattcacccggtgtcgcggagcaaaggggctacaatgcgcctttcaaggccagggtttgtataatgacaaatggtccgccaagcggtctcattgggtgggcccgtccgagcccccctgagtgtgatgttgatgccccccgcgttctttgcaaagggggattgtcggacatagctgcaaagcgcgtttcagggagggatattctgtcgaaatatttaccagtatatctccacacaggccgtcccctcttccacagatcgatagaagtggcacacacactgcttgtgacagaactgtgttacaagacgtattacagcacaccctgtgaggtgttctttcccgacacttaagcgccccctgaagatgtggaccttcaggacgatggtgcttgaacacccccctccgccagatccgtggactctggggactgcggtcatttattgatggggaatgcgtgcctttggccaacagtcaagaagagagttaaaggtctcggggagaaataccccgcgccatcttcgaaacatgggggccccccccgaaaaaaaattaaaaaacacccacaagaa

SEQ ID NO: 591719 - DNA, 102 bp, Homo sapiens
atatacacatgtctatttttctctgtaacgtgtctgacttcgtcactgggctggcctgagcgctgttcattgagaaaccatgtcaggaactgaagcagcacc

SEQ ID NO: 591720 - DNA, 989 bp, Homo sapiens
  misc_feature (79)..(79): n is a, c, g, or t
  misc_feature (83)..(83): n is a, c, g, or t
gttggttgtttgtgtgtgtttggtgtggtttgtgtttaaggtttggaatggttttatgatgtgctagggttgcagcacnctgnaggtctgttgatcagagtaccagagcttagtgcgactccattaaaactactacaaacactaggacctcttgtccaagagagtatcacatccaccggtcccgtccattggaagatggcagggatagccgctgtaacaaaaacaaaatacgagaaaagacaataagtaaaatatttaatatatgatgtagagataaagttacaaaagaaaaaagtttgaattaatctggaccatctcgttctcgcgttgcgttaatagtatatcgcaattatccacgaggaccaagccccgccccatgaggacgagataagtagcgacccggtgtatgcgagcggggaacgcctcacacgagacagccagagagccgttgtcgttgtatcttgagcgcagacttgtgacatgttgtattcgttagcgatggacataaaaagtaagtttaatcaaaatttctctacatacccatacagcccccacgcccacctgcgcgtcccctcgagcacgacccaggctccggacgtcgagcggacgccaacgaactacgccgagcaccccccccccccccttgatagaatactcagatgcagagttgatcataaagttcagttagatgataagtgagcttcgagtgatgttttctctcgccatccagaccgactacatcggagacatcgcgagctcctccagcgacagcgctcgccctccgcgtttgtgtagcgtgtcagtttcctatgtcatgggtgatagagtgaattcaatataaacgtcgctcgtctttcatacatataaatatgattgctagtcaatcatgccacagagatgctacatcatataactctataccactattcatcgcagtttagttaggtgccaccggttgcgccgccgcagaacagagctgcaggtagatg

SEQ ID NO: 591721 - DNA, 902 bp, Homo sapiens
  misc_feature (452)..(452): n is a, c, g, or t
  misc_feature (684)..(684): n is a, c, g, or t
gcagataagttttttgctcttagaaagatagagattaatacaactacttaaagaaagtatagtcaactaggttactaagatattgcttagcgttaagttatttaacgtaattgttaagtagctttaaggattttaagagaaaatatgaagacgtagaagagtagcatgaggacaggaaagagataagaaggtttctaaagacatgacaggaggttgagatgaagcttcttcgatggagtaaaaaatgtatttggagaagaaaattggagagaatggacatactagagccccgaattaatacgctaatagaagggcaatgcgttttagattaaaatgaaggtgacttaaacaagcttcaaagttggagtttcaacacacgttgtaaggtcgatctcaaaataattccgcaacggctgatcttttcacacaacagacgattaaaccgaatggtngattcacatagaccttgaaatccgatgacgcagggagaattgcgtcatttataagcctagttaaacgcatttgactaaacgcagacgacgatggaaatgattaattgggagtggtaggatgaaacaattcggcagaagatagaagtttgaacgtggaaatatggaagacagaagtacccggagggcgaatgcaaaagaatagatgcagatcgggaaattagaagatcctccncatacttttcagcagagcactggattcttttgtacctgataagtaggaagcgaagacatctgacaagctaggacacaatcagctaagggccaaatgttcgaacttagaccgcaatcggacgattgaaacatgattcgaactgaccttttggccaggagttccgagtgcagtggaaacaagttagcacaagtttggacccaaacaaatcccaggaaaag

SEQ ID NO: 591722 - DNA, 125 bp, Homo sapiens
ttctatttactactttaatatagcttaaaagcacaaatagcttgtgcttgcagtaacttacctgaaaagcagaagtaatagtacccttattactaccttaataacagcatataggccctttgata

SEQ ID NO: 591723 - DNA, 174 bp, Homo sapiens
ggctaggtagagcctgggtgaatcggccgagggagtgcggacgccgtggggtctccgggacaggaaccctcagttgctgcgtctagattctgcaggtgaggttgctgggaccttggctccacccagccagcgaaatggcagccacactcgatttgaaatcaaaggaggagaagg

SEQ ID NO: 591724 - DNA, 1363 bp, Homo sapiens
gaagctatctactatgtatactcatggttggcggttcttacgaggcattacatctaaatatttatgacttttcatccgaccgaggtaggtagcgagttcaaatatacaagcaccagccattcatttctctcttcaaatcatctatttcggagagcaacactttgaggccgtatcaccagctcttatcatcatgcaacctaactactctagtatcttcgccagatcgcacgtacaccacatcattgcctaaggccagaaacgagacgcagcttcactcttggcccctcttatgcttcccagtatggtactggccctctatttcccacctcctttcccagctctttacttgccacttgcactacacgaactaacaagcactctggcccacctcatgactggccatgcagcaaggttctccaatttatattcccactaagatcaatttctgcaaggtctgccaaggttcaacaccccctggagtcccacacacgcggacaaccacttctcacaccgactactccgccccccagcatcacagctggcttgcacacccacgcgaaccggccgcccttggcggcacacaaccacccgcacgccagcctccccctctacctgcggccagaccatgtcgaacccctcgtgccccaaccccgcctggcaacccctgggatccattacaccaaggaccacaaccttcacccagctgtaaatacctaaagcgaataggcgcgaccaaacgatcggagcccattgggcgacaccccatccatcgcacaccggcgccatgcccaggtcgcctctagcgcacacaattgcgactccacccccaagagggccacacccaactgcgccaacatcccctggctcgtccacacacccgcacacctaaccacctccggccgccgccaaaggacagccaaaaccaacacgcgacgtggacacgggcaccctctcccaaacctgaccggcccacggactaggacatctgcccccgcaccctgcccgcacacccacaacgccccaccccccccggcggaccccacttaccgcacacacacacgaggcaaaccttcaacgcacgcaaactcgcaacatcaccgacacagaacaccgtcggaccacccgttacacaacacccaacaatatgtcgaggcatcgatggaacacataccaaggacccacacggcagtcgcgcgcatgacaaagcaatggacgtagaacaccacactatcacccaccccgctctccgcacacacctggcgccagcgcctacacctccacgcgcgccacgcccgcaacacgatcagaccccacacacgccccaatccccgccggctgaccaccacacacgaccacgacactt

SEQ ID NO: 591725 - DNA, 123 bp, Homo sapiens
cagtaccacaggggatgtgatcgtcaccctctcctgtcattctgctacctcaggtggacacatggcttatgtttaccaaagagagctagcctctcaagcatatgatacttggtgcctgaaaca

SEQ ID NO: 591726 - DNA, 299 bp, Homo sapiens
  misc_feature (85)..(85): n is a, c, g, or t
aaaaactctgtctcaaaaaaaagttgaaggttgacaagtttaacattttttggattattgtagacaaattggcattaatattttnctctttagaattttatttattggccaggtgcagtggctcacgctgtaatcccagcactttggaggctgaggtggaggatcatgaggtcaggagatcaaggccatcctgctaacatggtgaaccccatctctactaaaatacaaaattagctggactacagggcatgcgcaccacgccagctaattttgtatttggtgaacgggttcgcatttgg

SEQ ID NO: 591727 - DNA, 553 bp, Homo sapiens
  misc_feature (1)..(1): n is a, c, g, or t
nggggttgtgatccgacgaattatggggtggatgggattatggttaggctattaaatgaggtggtggctgagagttgtgggggtgactgtgcagatttctgtgggctaacagttggtctggattttgctcggtagatgtgcatatctcgtaggagtcggcgtctaggcacgcaaggggtgcattgggatcatttctcagttggttagtagaggtgtatggagttgtagcgcatgaatggtttcaaagtgtatcaatagggatttagtatatgcagattttggacagtgctgcgcgaggccatgtagtattagttaagtcttccttgagagtgttgtggcgctcttgtaggggtcagttcttgtttacttctggatgctttttttgaagtctggctggatgtccagtgctggtgtagtgcagtgtgatgtcagttaggtcagcctgcagcatggtgggttcaggagaatggcttggctgtgggatgcagagattgcagtgagccaagttcgtggtgctgtagtccagcctgggcaacgagcaaaactccatctc

SEQ ID NO: 591728 - DNA, 110 bp, Homo sapiens
tgtcggtacctggtgcctcgtgtgccaagcaggtacgttgttcacgacgcttctggtctatgcctggcttgactggacaagaagctgttgcctgcagtgcatgccgaatt

SEQ ID NO: 591729 - DNA, 271 bp, Homo sapiens
  misc_feature (131)..(131): n is a, c, g, or t
gtgcagtggagagatatagagaagggctgtggacgtgttctggcacggctggtgcttgtgcgctgggtagacctgtgagggtgtgcatggggtagcaggactggagtcatcctcccagaactgagagaggncctcggggcatggaggcatcacaagtgctaggcttggcacaggtacagtggagaggttacggaggtggtgtgtgcagtgcctggtggggatggggagacccgtggacagagcttgttagagtgtcctagagccaggggga

SEQ ID NO: 591730 - DNA, 472 bp, Homo sapiens
tttgatattagaaaatctatgatttccacttaacactttaacaaagaaggaaaactgttatcatcctactaataaagaaaacatatttgaaaattttaacatctactcacgataaaaactcttagcaaactaggaatagacttgatctttcctaaccatgtgaagttagaatctagaaggagaaaaagacgtggactatttacacttcatctcaaatatttcaaattttgccagtgaataaaaagtaaaggaagaaacaaactgataactgttctatacagaccccctaattgacacagaaatcattaaaattattaagaagttagccgggcatggtggcacacacctgtagtctcagctacttgggaggctaaggtgggagaattgcttgagtacaggaaggttgatgttgcagtgagccgtaatcgcaccactgctctccagcgtgagcgacagagtgagaccctgcctc

SEQ ID NO: 591731 - DNA, 235 bp, Homo sapiens
caggatgatcatagactgtgtcttggagctggcgagatcaggaagacttacagccctggtcctcggtgtccatggttgtgatgcgaatgctcattctcgctggccttgtagatctgcatctgggcccacagacttggtgttgagggatcagtcgcaggctcccctggttccgcatcactagtcgggactgtagtgtgccgtcatcggtggacgccatgtcattgagtctgagcag

SEQ ID NO: 591732 - DNA, 350 bp, Homo sapiens
  misc_feature (199)..(199): n is a, c, g, or t
  misc_feature (266)..(266): n is a, c, g, or t
  misc_feature (346)..(346): n is a, c, g, or t
tttgatattagaaaatctatgatttccacttaacactttaacaaagaaggaaaactgttatcatcctactaataaagaaaacatatttgaaaattttaacatctactcacgataaaaactcttagcaaactaggaatagacttgatctttccggaattccccctgaggaatcgccacactgacttccacaatggttganctagtttacagtcccaccaacagtgtaaaagtgttcctatttctccacatcctctctagcacctgtngttgcctgactttttaatgatcaccattctaactggtgtgcgatggtatctcattgtggttttgctttgcatttctgtgnatgg

SEQ ID NO: 591733 - DNA, 92 bp, Homo sapiens
tgcttggcgtgttggtagcatgcctgtcctggttgattattgtgaccccccacgttgttcagcgaagggtctctgcacctgccgcgctgtga

SEQ ID NO: 591734 - DNA, 612 bp, Homo sapiens
gctttccccgatggtccactgtgtgaccttggaccgtctgtgcattccctgtgaccatctcattgacatggtacatgggctcctagctcttgacccactcgtgcgtcgcgtttcacacggatcgttgcgtggatggcgcgtgccatggtgcggcttgacgacttgtggaccgtgtacctggagactgggatagccgtggaaactggcgtcgaagaccacatgagattactacgcagagtaactcatagctagactttgagctcatcgcgttgtctgcatcaacagtcgcagaaggctatcgtctggggaatctatgacatagaacaacaatgatgccagagctgagggatgatgatcttcctagaggggtgctagagatgtttcctcataggagcagacttgtagtcgcacgtccagagtactgactcatcgcgccttgatgctgaatgcctgtggaaaacctggtgggtcgggggaccatcgacggtctcgagcgtcaggaattaaaggacaatcgtgtagtaaccatggaggtagaggccagaaacctagataagaaggacttcctgggaaaatcagatccatttctggagttcttccgccagggtgatg

SEQ ID NO: 591735 - DNA, 143 bp, Homo sapiens
aggaaagatgccagagaggaaaaatcctccccatgactctagacgggattgccatggtataagcaagacacatcccctttcccacagtgtcaatgcaaaggtgattagaaacttccaaggatgagccaacctttgcctttgcg

SEQ ID NO: 591736 - DNA, 512 bp, Homo sapiens
  misc_feature (498)..(498): n is a, c, g, or t
tgtatcggaaacgagaaggtttgcagccagcttgtcttgatgagtcagagaactttctctgacttgattagacttatattttagagcaataactttggtagattgaagtggaataagagattggtattagggagaccaactgtgaggctattgcaaatggtttaggtaagaaatattgaaggcccgcacaaaacaatggcatattttctttttttttgtgatggagtttcgctgttgttgcccaggctggagtgcaatggcacgatcttggctcaccgcaacctccgcctcccaggttcaagcaattctcctgcctcagcttcccgagtagctgggattacaggcgtgtaccaccatgcccggctaattttgtatttttagtagagacagggtttctccatgttggtcaggccggtcttgaattcccaaccacaggtgatccacgtgcctcggcctcccaaagtgctgggattacaggcgtgagccaccgcgcccagnctaacaatggcata

SEQ ID NO: 591737 - DNA, 156 bp, Homo sapiens
ctcaggatcttaaccactgattgaggcaggatcaaacccacatcctcaggtgtactacctcaggtcttaacccactgagccacaataggaactccctggtataatgtttttacttttactttgtcttcatcttaaacatggtaaaattttgactgg

SEQ ID NO: 591738 - DNA, 509 bp, Homo sapiens
ctggcatgttggaacaatgtaggtaaagtagccaggcatggtggtgcgcacctgtactctcagctactcaggaggctgaggcgggaggattgcttgaacccaggaggtcaaggctgcagtgagctgtgattgcgctactgtgctccagtttgggcaacagagtgagactgtctcatcaaaaaaaaaaaaattttttttaaagggttaacaggtgcctgggcattggtggctgaagcttgtaatcccagcactttgggaggctgaggcagatgcatcacttgaagtcaggggttcgagaccagtctggccaacatggtgaaaacccgtctctacttttaaaaatacaaaaatttagccgggcatggtggcatgcgcctgtagttccagctgctcaggaggctaaggcaggagaatcgcttgatcgcttgaactcagcaggcggaggttgcagtgagtcaatatcacgccactgcactccagcctgggcgaaagagcgagagtccgtctcc

SEQ ID NO: 591739 - DNA, 638 bp, Homo sapiens
ctccgggctccgcgagggatgagggtctaagacgtcaacaacagcaccatgcaggtgagcttctctgtgccatcgctgctagcctgtccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggatgatgtccacagaaagtgccaacagctttactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaacgcaagatag

SEQ ID NO: 591740 - DNA, 121 bp, Homo sapiens
  misc_feature (1)..(1): n is a, c, g, or t
  misc_feature (72)..(72): n is a, c, g, or t
  misc_feature (94)..(94): n is a, c, g, or t
ntaaatgtacaacttcgcaattgtaggatttaattgattgaattcctttatactgcctcttcccttctgcanagacattatgccactgtggtgnatgtcagtacctctgaggttgcttgtt

SEQ ID NO: 591741 - DNA, 141 bp, Homo sapiens
cacaaatgcaaagcattttgtataactcttactgcatttctacaataagtagcttaggacaggtcacactccactatcaaggtgcatagcgtgcaattaaccaaaatgtatgggccacctattacttgcctaggtactagg

SEQ ID NO: 591742 - DNA, 250 bp, Homo sapiens
agaaggatcccattaggcgcgctctgcgtgccagttcatactttatcccctggccccaggcatggcagatcgcgtatcacagactcatagttaatgactcggggttcgcatcttccacttgtttctatcccattgtcggataggtgggatgggagatcagaaactgcttgtctggatttggtggagcccggtagggtcccgagctcaaccttcgtaagtcctagtcataggcctttccctgtgtcacaac

SEQ ID NO: 591743 - DNA, 219 bp, Homo sapiens
tgtcaacgcagattgttatccaggctggaatggaggctctgaaggctgctgagtgtgcaaggaagctctttctattccatacatgcctgcccattgctgaggccccaggaaactgaagagcagagatgacaggaagctgatcgatacagacaaggagaagactctgttccagcctcagacaggtgcctatcatgaccctggttggcgaggtgggggggc

SEQ ID NO: 591744 - DNA, 698 bp, Homo sapiens
gagaaaaattagtccttcaaatactgctgtattttcaggaaaaaaaaaaaaaaggggtgtttctattgaaactgtactaaattttggcctacaatttaccttgtaaatatggtagataaatggctaatactaatagccaaatagataacactaatgcttggtttaaaaaaacgaaaaaaacaaaacaaaacaaaaaaacatgagccaggggttgttctaattgaagtttatgacatctgtcctaattagtttcttaaatacatttactacttaagggtttggaaggcaacgtgtttaatttttaacaattttgtgaaaactggctaataaccctttggtccagaaattttagtagatggtttaatgccaggacatcaaactacattaaatgaaagatgcttgaaatgctttggttattccagggcaaatcaaaattaaattcagactatcaaactacaagagaaccttagtctttttggttttggtctaaccattgtcagttcagtgatgtctggtgacctgtgagtgacctggtatggattttctaatcttagagaccttcacacagcatgagggctgttggcatttggaaaaggttactaagtagaagcatacaatgtttcccttgtgtctttgaaaccttgtttgtaaaccataaataaaatattgctgcttttattaaattataacataaaaag

SEQ ID NO: 591745 - DNA, 101 bp, Homo sapiens
ctcccaggatgagaaattgaggcaggcaactgtacaaacagacctgttaaccaacccttatcctgttaatcacctcttcacccaattaactacaccagttc

SEQ ID NO: 591746 - DNA, 235 bp, Homo sapiens
  misc_feature (15)..(15): n is a, c, g, or t
  misc_feature (92)..(92): n is a, c, g, or t
  misc_feature (154)..(154): n is a, c, g, or t
atcgatcgcagtgtngtagcccgcgaacgggtccagcgaccgccacgttcacgttctttcggaacggttcgccccgctcgctgagccaggangcgtatgccttccccgatctgcccggcacgaggtcgagcagcctggcccgagtcttcccggngctgtcgcggctgaggtcgaccatgccggtcagttccttcgggccccgcttgcggtggtcgacgtgatgccagatgtgctg

SEQ ID NO: 591747 - DNA, 280 bp, Homo sapiens
tcctatagagcataccctatcactatggacacgtgcgggcagtgtgagagactggagggcacgaactctggagtcagactatgtgggttcaaattctggttacagattataaatcatgaccctggatatatattttcaatatatttgactaacgcttatttaaacattttgtacttcagttttctgagcttaaaatggagataaagaatacctcttatacagctgttatgacgatcaagtaaactcacacatataaagctcttagcatgatatctggtac

SEQ ID NO: 591748 - DNA, 296 bp, Homo sapiens
  misc_feature (281)..(281): n is a, c, g, or t
ctgctgtctagatatcgctgggaaggggcagtgcacatagcgtggtatatccatcaggagcttgggcacccagcgaacactctacggtgtaatgggaatgggaaagcccccaacagcttccaccagtgactccatgggacaggatcaacgggtgggagagtcctagtgtcaccgggcagaacctaccgtacaggctggtggtgaacaacatgaactcctggggcaaagcggcattttctggaactacagcaagtgaaggaagtagtgatggttctggcacncacaatgaaggaagc

SEQ ID NO: 591749 - DNA, 396 bp, Homo sapiens
  misc_feature (16)..(16): n is a, c, g, or t
  misc_feature (23)..(23): n is a, c, g, or t
  misc_feature (48)..(48): n is a, c, g, or t
  misc_feature (85)..(85): n is a, c, g, or t
  misc_feature (125)..(125): n is a, c, g, or t
  misc_feature (144)..(144): n is a, c, g, or t
  misc_feature (184)..(184): n is a, c, g, or t
ctctctaacccccagnatttgtncgttcaccccacccaagacttcagnaagtgtcatagcactcgtggactaggtttcatggganaaaggcattctgcaagaagtagaagcttgtggccgggtgnagtggctcatgcctgtaanccaagcattttgagaggccaaggaggtggatcaattgagnccaggagtttgagaccagcctggccaacatggcgagaccccatctctactaaaaatacaaaaattagctgagcatgttgacacacgcccgtaatcccagctactcaggaggctgaggtgggagaatcgcttgaacccaggaggtgcaggttgcagtgagccgagattgcgccactgcactctagcctaagcaatggagcaagaccctatctc

SEQ ID NO: 591750 - DNA, 204 bp, Homo sapiens
cctgagcgacaggtggatactgcagaagggctttctgaaggaggaggacctcaacggagaaagaagccctggttggtggcacctcctgtgttcatggagctgggcctgtcatgcccctggtaggcctgtgctccctgaccgatcacgctgtgggcacacccaatcggagatccttcctgggagcaaggggctttcggaccaagg

SEQ ID NO: 591751 - DNA, 325 bp, Homo sapiens
acgtctatggctggtgacagagtgaaccccgactgtaaaaattaaattaaattaaattcaaaaagcactatgggctactgaaataactctgctataagaatgtgaagtgtcggccgggcgcggtggctcacgcctgtaatcccagcactttgggaggccgaggcgggtggatcacgaggtcaggagatcgagaccagcctggccaacatagtgaaacccccatctctactaaaaataccataattagcggggtatggtggtgggtgcctgtagtcccagctactcaggaggctgagacaggagaatcgcttgaacccaggaggcg

SEQ ID NO: 591752 - DNA, 344 bp, Homo sapiens
tcgtcttttgataggatttaaaaaaaaaaaaaaaaaaaaagggttttttcccgaccttatccattggtttagggcccaaccctatcctttattttttaaacccaaaaaacttttttataacttgggccttaaacactccacctcaaaccgggggcccttttctttttttcggccgctctcccggggggggatccctccctgggggccccccccaacagttttcgccaggtggggaaaagccgccccaggggcgggaaagtgggggtaaacggcaacttgggttcaaatttaaaggggaggggggcttttccctacacggggcccgggctggaattcgaaaccag

SEQ ID NO: 591753 - DNA, 418 bp, Homo sapiens
ggaatgagctccagagattctcccaacaccttccccacccagagcaagaataagaaaaacaagttcttgttatcagtttccccctttgaaattcttttcctataccattatcctttgatctcttctcacaactacttttgtaactatttctgcaagtttgcaaggattttgtaagttcctgttttccagctgtgcagtatggcaatggtcacaagacatgcctgagttgtaaaacctgtcactgttcgataaactgcctttgttctgcttctgtaagcttgcttacccaccttacaggttttgcacccttttcagatgtatatataaaagtcaagccctgtctttgtttggtgctcagcctttggatatgaatccgctgagttggtggccacctaataaaatcctcctgttccaaaaa

SEQ ID NO: 591754 - DNA, 619 bp, Homo sapiens
gtttaccaggggtgtttataacgaaggatgtaatggggtaaaaacagatacagaaatgtttaggtaaaagctctgaccggattttaagttataagttgtttgagaagatgttggtggtcaaattaaagtgaaataattgtgctgagcttggtgtagttcaaaagccaataataagttaagcaaggtatgtgtgtatatatgtgagaatcagtactataatggaagccaggatagaagagttagtatcggagttgtgaaagtatgagtaagacatgatggcagggtgtgatgtcgatttatggaaaggttgacgaataattcgtaggccagtatgagagcacagattatggtctgtataaagaagaattgctaaggtatgatcatattgtggtgcagatttgtagagcacaagtgatatggaatgtcagaatgaagtttcagatggtctccaggaattatatcggaggagtctagatgctgatgtggtttttttaagagtaaaaagcaaaaggtgtgaacgtctaacgtggttttagtattaataataccagtttgtattgtagaattgtattgatatagctcacgcttggttaaggctggctgtgtatatatatctctg

SEQ ID NO: 591755 - DNA, 318 bp, Homo sapiens
gtagtagagagtagataagtaagttgccaggggttaaggaggatgagggaaaaggagggaagcgagtgtggctataaaagagcgacatgagaaacccttgcagagatggaaatattcagtatcttgagtatattgatgtcaatatcctaattttgttactattgtgttttcaagatgttaccattgagggaaattggtaaagggtataggggatctctgtattatttcctataactgcaagtgaatctacaattatctcaaaataaaaattttaattaattttaagaaatattttccccaaatggtggaagttaagtg

SEQ ID NO: 591756 - DNA, 236 bp, Homo sapiens
gcgggcgcggtggtgtggctccgaacggtgcaggcggtcaagaccagcctggccaagatggtgaaacccggtctctagtaaaactacaaaaattagccagtgccatggttggcacatgcttgtactccccagctcactcgggcacagctgaggccaggagcacatggcgtgcaacccggcgcaggttggccagcttgccagttgcagcccaagcatcgtgcccactgccactctca

SEQ ID NO: 591757 - DNA, 370 bp, Homo sapiens
aagacagatcagcaggcaggaagctgaggaggagggttgttgtgaccacaaggtctggagacgggagggcaggggtgtgtgtgtgtgtgtgtgactatgtgtgagtgtgtgtatgtatgtgtgtgcgtgtgtgtgtgtgtgtgtgtgtatgattttctaattcctagtcatttttctattgattgttgtgcaaaagccatttacatcttaaggatatagataatcttgtgttatatgtgatgcaaatatttttttccagtttataggtggccttttaattgtgtgtcacaggtagataaaagttacacgattttcttaggtgagtatatcagtgtggtttctgaacttgttatgtgtagatcttttccac

SEQ ID NO: 591758 - DNA, 954 bp, Homo sapiens
tgggcttgactcaggatttaaaaactgggaacggtgaaggtgacagcagtcggttggagcgagcttcccccaaagttcacaatggtggccgaggacttggattggcacattggtgggttttttaaatagtctattccaaattatgagatgcgttggttacaggaagtcccttgccatcctaaaagccaccccatttctctctaaggagaatgggcccagtcctctcccaagtccacacaggggaggtgatagcatggcttccgtgtaacattatgtaatgcaaaattttttaaatcttcgccttaatacttttaatttggttaatttggaatgatgagccttcgggcccccctttcccccttttttggtcccccaatttgagaatgtcatgaaggcttggggtctcccgtggggagttggcgtggaggcagccagggcttacctgtacacgtgactgtgagaaccagttgtgaataaaaggtgcacaccttaaaaaaaaaaaaaaaaaaccccgagggcaaacacataggccggggggcggacaacaacgggtgtatacggaacggggccatagggccaaaggtggtacctctagaccaacagttctggcacccacgggggcaaaatccggcagagtacccctaataaggaagagccgaataaaatccgaaaacccgggtcaccccgtggcttaaaatgaaccgcgcggaacaaatgagacgcaagacaaggaaaagacaccacgaagaagcgacgacaacaaagggacgacaggagatagccacacaactgagtcatcaacaacaaaacatagagtcacagaagcaacgcccacagcacgagtgggccaaacgcgcaacatcagtgagtccagaaaaaaaaatatacaacacaaataaaaacaaaaaaacagaagcagaaaggaggacacagcgaaagaagaacaacacaaac

SEQ ID NO: 591759 - DNA, 1697 bp, Homo sapiens
  misc_feature (1515)..(1515): n is a, c, g, or t
ttgtgggcgtcttttttagtccaccgcccggggggggtgttataatagatatagtgtcttgcccctaccactgagagggtgtgcctcgattaatatgacaacgagtggtgagggcaccacacgccggtcgtcgtgttcgttgtacaaagaaactaacttgctttctctcgtggggtggggttgtgtggccacccacacctcggggggaagtgtaaatgttgttcctccgttgcgcacaacaactaatcggtacctcgtttgttttgttactcccccggaaaagattaaatacaagaaaaaagtactttctccgggggggatattataatatagtgaatgtgctccccccggggggtgtatttattaagatagcgccgccccccccacatattgggtatgtttctcacccccccccggtttggtttgtgtgtttgaggaagaatttggcggaacaaagaataatttttttgtcgcccttctgcgtggcgaagacaatatcagcaatatagatgttgcgccacctcctggggggaaccacccttggctgtctataataacggccccccccgcgtttatctcgttgcgggccacaacatacacgaaggagcgacgtcgaacaaacataggtgttcctcttgctggggacgatgttgggaagattattgttggcggcgcccccccccgcgacattgatgttcttgctgtcgcccccttaaatggtagaaagagctctttaattgtgtgggtactctttgtgttgcgcaacccagcatttagaagttttgtggtccgccacacccacacagcagatttgttggtgttgtgtgttgttgtggtccccactatatcagaccactacaacatgttgtctacaacacagaatggtgacgacacactactcccgctacagaagttctgctcggccccgacaccacaagagacgacccacggactccccaggagggacaacacttggtgcttataatacccccgcgactcccccagagaagagagagttgtgagaccacccagaagagactcctctgagagacgcgtcgcctctccgagaagaccaatagtagtcaccactatagtgtcctcctctctcccggcgacggcgcacaactcctcagagcaacaagtggtgtcacacacacagagtctctctcactgtgctcacacaggggtagagagagagactatcacgggccacaatagagtggtgtcacactatcttttctaccctcctcacagggagaccacacaagtgtggtctctgctggcgcggagtgttgtgggcgctatatggagacacatcttctttataccccgagaatcgccccctatatcgcctaaggagaagactccacttaagaggcgccggtgagcagccacgccatgagacagagtctctccacaatgagaagtacaccacacaacactatttccacaccattcactgagaagatctgtaagcccccccacgctggagaattggccaacccacctgcacgnccccctcgaagaaggagaggtcgaaatgggtaaaaggagccacttctttttaattcacccacgactttctcctgggataatgagtgtgaatgatccagtcctttgctgaaaaattttcaactatgtaggtaaattcgttcaaagggtcacctaggtgaaataaattctgattcttctaaaca

SEQ ID NO: 591760 - DNA, 1205 bp, Homo sapiens
tactagagtccccacgtgtcccctgacgtccctgccccttcgcgtccctgggaaccgagatggcttccgagccgcactcgccgatcctccaggcatgccccgatacgagctggctttaatcctgaaagccatgcacgcggacagagactgctgctactttgaaacgtacgatatgaggccctgatggacacgagcgagcaatagctgagggacttggaaaagcctgtggtgaacgagcgcttccttctaggatctctgtcccacagtcagacagtcatcaacagaggcggcgtatttcttggtggattggtatgcaccccaccgcagcctgttgcaacagcatggtggcagccacttgtctcgcagatcatcagatgtgattaggagggcacatattgtcaaacaccctctgaacccagcgcaactcaaaagaatgtgacagggattgtcccagtcaccactcgcagagacaattatattccgaaaagaagaggcacgaagtgagaagattcgacagatttagccgttatatgtacattccttcacatactgggcagcatggacgagaaggacagaacttgcaagattgggacctacatataagcatgtgtccgcagcgttgctgccgactcttctaacggtatacacagcccttgatcccctttgcttgcccagaggatgcgcgaactgctcactgaccagtttctctgataatcctgacaccacccagctggactcactcatgcaccctggcattccatagctgccatatctttcggtcatctgacggaatttcgccttaacaacagctaacacacttgacggacgaggaagacataatcaaacctccgcgcatggcaacaagcactccacccgggtacccagtgccaccaccacgcgcaccacggctaacgcacaccacacgccaccacacacaccccgatcaaaacacacaccagggggcacgaacaaacacccgaggacacgaacacacaccagactacaagcaccaaacgcacaaaacgccgccccacaaaacacgacaacaacgaccaccgcgaccacgtagcacaaccaacaagacactaacacccacgaccacaatgaacaacaagaacacaccacccgaccccatccgaccgccaccccacccacgcacccaacacaccacacgacgaccgcaccgcaccacacgagcccagaga

SEQ ID NO: 591761 - DNA, 1292 bp, Homo sapiens
ggcactcaggaaccgagagacagacctcaactcactacttcagacttccctgctgtgttgcagcccagccgcatccatcatgtcctatacagatgctgaccagattgctagaattcaaggcaggcatttctcctgttttgacagaacaggtgattccaagaatcacctataagccagagtcggtgatgtccttcgagctctgggcaccacaatcccaccaatgcagagcgtcacggaaagttctgggacaccccagcaatgaagagcctgcatactgccaagaaaatagagtccgaacaatctctctgcctatgactgcacagaccatacaccaccacacaaggaccaggccacctatgaacgcacttcgtcaagagggtctgcgtagtctccgcacaccctcctcgcgcacactgacccaccactaccactagacacctagcctgacacatacagacctaatccttccttatcccaaccccatgctacctgtcaaacagactcaacacctcatcaaacacccatgccaactccacatgatctagccccacactccacaccaaacaacctcccccacagccctgccactcacactctatccaaatccaccacagatcaacaacaccactccacacgacctatactatcccctgtcataccacccatacaacgcaaccaaccctctcaggctctcagccacacctccctctcctcctcacctactcactcacataactcacacctctcttcatacttaaccccccaaacaccatgacacaactacaaccaattcaccgacaatccacacaaccccaatccactctatctgtccatacacaaacacacaacacatcccacctaaccaacctacctcactacaattcactccaccactctaatcactcaccctgacatccaaacctaccacactaccaatacatcttcagcactgacactacaccttctacactcccacctctcacaaccactccccacaccccacctcccattctcaccactactccccacctacacactcacacaaccctctataccaactaacatcctcaacaccactagatcaaccataaaaaataataacatcatcacaattctttactacactcacaaccaacaacacactcaacaccttcaccactcacacacatcacatactcctcactccaccctccaaccacacacatcactcaccacttcgacctcctcatcacacccatatccaccacgaccaccccccacacatcacactcaacataccatcacccgatcac

SEQ ID NO: 591762 - DNA, 472 bp, Homo sapiens
  misc_feature (96)..(96): n is a, c, g, or t
  misc_feature (142)..(142): n is a, c, g, or t
catcttctctgcccggagttcttgacggtcaagaagccaaaagctgtgggcttgatccagcccatgtgttagaaccagaaccaggaaggggatgcnagcctacaggaaggccgctgggacctggcgagagagtttcttaccntcaggggcctgttgcaatgagagtggccaaactagcaattaaccaagggatggaggtcgacttagtaacagggttagccatagaagaagcctgctatgctcagaccatctcaagccactgtgcgccatgtcatatttattcagatttataaagctagcaatgtccgtggtcaaaacacgtaaaaattaggtatatgtttttaatatttcccgcatatcaggctttgtcgttaattttttaatgtgaataatttatattgcacactctaggaaataattgattgtatgtctaccatgctgcattaagaaaataaaactatttctgtatccc

SEQ ID NO: 591763 - DNA, 366 bp, Homo sapiens
  misc_feature (17)..(18): n is a, c, g, or t
  misc_feature (47)..(47): n is a, c, g, or t
  misc_feature (59)..(59): n is a, c, g, or t
  misc_feature (72)..(72): n is a, c, g, or t
  misc_feature (94)..(94): n is a, c, g, or t
  misc_feature (99)..(99): n is a, c, g, or t
  misc_feature (124)..(124): n is a, c, g, or t
  misc_feature (196)..(196): n is a, c, g, or t
  misc_feature (221)..(221): n is a, c, g, or t
  misc_feature (228)..(228): n is a, c, g, or t
  misc_feature (298)..(298): n is a, c, g, or t
gtcccatcacagctttnnaaacagcaggataagttcaagccaagggngactttttcccnggtttgcggaggnattccaccagccccagtgttgntgggnttccccgtggccatgtgggtgtttntaaagcaactccccaccaaccttttgggctgtggtgaccaagggctaaaaattaagtggggaccctggtatntgacttttgctccacttctgacacnttctttntctcccgtttcactaggactggaaaatacaggctttttttcccaatccttgtttctctcaaaccaagacntcatttacataaaacatctagggtcaggcccatccactctagctcttattacagagaaagagctccag

SEQ ID NO: 591764 - DNA, 470 bp, Homo sapiens
agtagaaaataagaccagagtctgaggcccccattccaggacctagcttatggatgacattatctagacacaccttgtgaacaaaatgcaagcagcacatatgaagggaaggatccagtcctggcaggagtcatcacctgctgaccaaagagcccttgggctctgtataatcaacagtggtagccaggcagtactcactgtgggcattgggtgagactcagagccatgctggcctcaggaggccgaggtgagcaaatcatgaggtcaggagatcgagaccgtcctggccaacacggtgaaaccctgtctctactaaaaatacaaaaacttagccaggcgtgatggcacgcgcctgtagtcccagctacttgggaggctgaggcagaagaatctcttgaaccctgcaggacagaggttgcagtgagctgcgatcgtgcacctgtactccagcctgggccacagagcaccac

SEQ ID NO: 591765 - DNA, 1177 bp, Homo sapiens
gagctctcgggcgaagttcaagaacaagattgcttccacagtatgatcatcaggcagaaggaagatcttcgcacatgggactagaagaggtgacaaggcagtgatgcatttggtgcccaacttaccagctgcgcttagcaggatggcatcatcctctgcgaacgttataaacaagctacagccaggctcagttgaagaacggtcaagcagagtccatcactgaatctggccgtcagatggacgaaatatgggcaactttactaacagctatacaggcttatggtatgaagccacatgacatatacgaagcaaaatgatacttataaggagaatgcgaaaccattgacccaggttcaggactaactactggtgactctagcagggtcatggactaaaaacaaaaaggattccaatacaaccattgacacttggaggtaaacgtatgcagaaaaaagaaaaaagacgtattggatgaaggacaatttaaagagctggcaaaaggtgtaatatggtctgcaagattgggaaccaaacaattgtgccagcacaaggcaggtatgacagcttacggggactaaaaggcatcttatgatcccaaaaatgcaaactggacaaacactatttggacagaccaaaaattagtctgcagcatgcggcactacataaaggagaccagccaaggacaggacatgctaagccaccagggtacgcagaaagagagactctatgattcagaacgcttatacattacagccggtggaacacaattggagcaaatttcctaacgaatggggtaacaaaaaggtgtattccaaaacagtgatggatgtgaataggacatgggaggaagaaatattaccacagaataggtggggcacagagaacggttttatacaaggaggacaggacaagcacaacagtggtgagaaagaggaagaggaaatagaccgacaagacgaagataaacgagatacgagggaacagcagataaaatgatagcgagtgtaaaaacacagaggaatattattgatcatgataaaggcagtaatgattgaacacgaactgagaaagcatactgctccactctctcccccctcctccctctcattcttcttcttctctctctactgcacctgagacaaaaagagacagagacggacatagagagaagagaata

SEQ ID NO: 591766 - DNA, 376 bp, Homo sapiens
gttccatttgatcacctttcttcactgggatcttactatcttgtggggaaacattggcatctcagagggagtccgtttcattgttagaaagttctggccgggagcggtcgtcacgccagtaatcccagcactcggggaggccgaggcgggtggatcatgaggtcaggagatcgagaacatcctcgctaacacggtgaaaccccatctctactaaaaaatacaaaaaattagccgggcgtggtggcaggcgcctgtagtcccagctacccaggaggctgaggcaggagaatagcgtgaacctaggaggcggagcttgcagtaagccaagatcacgccactgcactccagcctgggcgacagagacggatccgtctca

SEQ ID NO: 591767 - DNA, 332 bp, Homo sapiens
cggcacgagggcagatagtttttttggacaatgaaaatactgcccatctgtatgatactataatggtagatgtatgtcattatacatttgtccaaagccataggatgtacaacactagtgctgtgatgtaaaccatggacttcaggtgataatgatgtgtcatgtaggctcatcaatcatagcaaatgcaccactctggtggcgggatgttgataacgggggcagctgtacatgtgtgggcacaggacataaatgagaaatctctgtaccatccactcagttttgctgtgaacctaaaagtgctccagaaaaaaaataaagttttttttaga

SEQ ID NO: 591768 - DNA, 411 bp, Homo sapiens
attgaagtcgagaactcgcgtggtgagaacatcaacaatcgatgctcgataagtactccccacttatccctcacctgtagttgtcgtaagggcacacgtacatttcaatctcgtgatacatcgcacattaggaataggcgaggctcgagagtcactgagtggtcatcttcctaatgacctgcttctaatagtttttccggcaaggaacagtctgggagtctctaatccagagagactttcagattccctctcttcacatgaacctccattagttagattttgggaaagtgagcatgaagaagggactcagagctgccaggtacccgagtctcgggtctgacatccttgggccccttctgccacaacttgccacttcacggacttgaattatgttgcttcttcctggaagtc

SEQ ID NO: 591769 - DNA, 385 bp, Homo sapiens
cctggaggtaaacatggacaaacatctttcacttgtcctaaccctcatagcacgtcagccttacgacacagtatatatcttcaaatggcggggagcagatgacatagacggactaatctaacactgaggggtgcttgacaagtgtttacttggtatacatctatacaaagctgggctaaacattgattttattgatctgctggaaatggatgaatatatgcattatttatagaatctgttatgagacgtggctgctcttaaccctataaacccaatgcgctctcatgatgcactctaacttaagagtttttactttatgtatcgatacctaacacaattctgaaaatacactaaagaaaaaacataatggcctcgttgtgcctaa

SEQ ID NO: 591770 - DNA, 888 bp, Homo sapiens
ctcttgagtgtactcttgctgtctatcatcaccgtctccctgctccgtattaaaatatatatgtgtccgctttatatatcgcgtcgcccgctgcaacattacgtgcgcccgcttaattaacactaattttaggccgcttttatttcgcccatttaacccaacctgggtgttttgcagaaaccaccgttgcgctcgtgttgatgtcgagaaaaaaataaacgctgtttactacttttgtggggccgccattattaaaatatcttcccgccctcttgcctacataatcgttcgtccccctcgccttgtattacttttcggaccaaaaaagtttgctccccgtgttggctcgcccaggcgcgaatgagtttggctcgtgctgtggtccgccggtacaatatagccgtttaaatttcttgggacgccaatatataagggggtaaaaaaaaataattctgttgtggtaaacgtccacggatagatgggttttaggcgccgacgcacgcttctgtttaaagtggtggcgcccaaaatgtgtgaaaaagtgatttttccaaaacccactgtattaaactgttgtgtcgacaaccccactttaaagaattgtgggtaataatttcagaggaaaattttgtgtcacgaagtatagggttttttttcctgtggtttgggggggagactatctacacaactatggtaaaggtagtttggcgccagaagtttcactgccaaatttgtagagggtccaccccacgggggtaaatttaaacaacaattgtgacgcgaaccccgacaaaatggaaggcgcgaaactggttaaaccccgtttttgggcccggttttttttcgggtttaaacccaacccaaaaaataaaaattggcccaaaaaaa

SEQ ID NO: 591771 - DNA, 706 bp, Homo sapiens
  misc_feature (143)..(143): n is a, c, g, or t
  misc_feature (236)..(236): n is a, c, g, or t
  misc_feature (287)..(287): n is a, c, g, or t
  misc_feature (289)..(289): n is a, c, g, or t
  misc_feature (318)..(318): n is a, c, g, or t
  misc_feature (341)..(341): n is a, c, g, or t
  misc_feature (369)..(369): n is a, c, g, or t
  misc_feature (405)..(405): n is a, c, g, or t
  misc_feature (442)..(442): n is a, c, g, or t
  misc_feature (444)..(445): n is a, c, g, or t
  misc_feature (485)..(485): n is a, c, g, or t
  misc_feature (505)..(505): n is a, c, g, or t
  misc_feature (591)..(591): n is a, c, g, or t
  misc_feature (594)..(594): n is a, c, g, or t
  misc_feature (636)..(636): n is a, c, g, or t
  misc_feature (641)..(642): n is a, c, g, or t
  misc_feature (679)..(679): n is a, c, g, or t
gggggcgaaggactctccaattccaagaaaccatgggccaatttggccggaaccttggtggagaaagaacccgggcggctgggtgaaacgcgtggtggtgaacttaactccgaaagcctcgcaattgggccccaatttttggntaactaacggcccaagggttgaaggctgggttcctttcccaacccctgtgctgaagaatctcctaagaagctaattcacgaaggcctgtaganaaacaactaaggtcaaataaggtggctcacgaactgtggtaggctctcaanancaaggctcaacacaggttaaaggagaagncgtggtgtgctggaaatggggtntcatgggtgggccaaactggagaggtgngattgaatggtgtggttttaatggttcgcgaagagnaattactatgcggccaaggcggcggggcactttaatntnngggctaatgtacatgtgtttgagaagaaccacaattcttntataacacattctggaattntactatatttgagactttacattaattatggaaggttggttgggttgggggaaccacatggtggtgtgaatctacggaactgggcntanatcgtcggagattatacacacctatacggacatctctgcgtncacannacacacacacacaaacatacagatacataaacacaancttcgcgacgggtgtgtgcgtgtgccc

SEQ ID NO: 591772 - DNA, 116 bp, Homo sapiens
gagcctcagttacggagtgatcatcactttgtttcatacataagagaagctgttttggctattcagctcccgaaggcattttcttcggtataaagcaatcacggagattttttgac

SEQ ID NO: 591773 - DNA, 369 bp, Homo sapiens
tgacagggtcttactctgttgcccaggctggagtgcagtggtgctgtctctgcttcaagtgattctcctggctcagcctcccaagtagctgggactacaggtgcctgtcaccacacccagctaatttttgtatctttaatagagacagggtttcaccatgttgggcaggctggtcttgaactcctgaccacaagtgatctgcccgcctcgaccccctaaagtgctgggattacaggtgtgagacaccgctcctggcctagccattatgtatttttgacagtcttgctctgtcacacaggctggagtgcagtgtcataatcatcacttggtggcacaatcatcactcgccagcctgtcacctcagtgctt

SEQ ID NO: 591774 - DNA, 544 bp, Homo sapiens
cggaatacagagtctgggaataagcaggaaaaactcagtacctcccattgggatttctttatttttcacttggaattatgagcaaacatccggagcgatctatctgggatcacccctcttctagagctgaaggtgcaaactaagaattattcccagaagccagcaggggtgggggaaattcattttacccccttaagggaaaaataagggcgggtcattccccggcatgttggtcgtagtatgctagggccccacaacactcaaggtccggtgggctctgatacttccaagtagcgcatcttcatcaagtggaggaaaatccatttcctctttcacttcccaatcactacgaactccaagggaagagtctcggggtttctggagtggaaaaccattagaggaaaaaaaaggttatagtccatacaaaacttaaataaaggacagggtaaaaatatgaagagctggcctggtgcagtgggttcatgctggtagtcccagcactttgggaagcgggggcaggatgagtgcttgagcccaggagttt

SEQ ID NO: 591775 - DNA, 680 bp, Homo sapiens
  misc_feature (333)..(333): n is a, c, g, or t
cgcgccgggatatcttggagggttggttgggcgagggttctggtagagacccttggtcccttagggtggatagcctgggaggggtgcaggcatctcccttcccccatagccctaggtcccaggtatggagtagagaggtggggaagtctggctgatggaagggagactgtgcagtcaggatcccgctgtgaaacagggcagtcttgtatctgcactgaagtaaagggtgggagaggcctcttccccatttcctcatctccccagccgggctgactctttcctagttctctccggggcctgagtcactcccgaggtagggggtgattgcctctnacttcttccttccccctctctggatcctgcgcgttgttcctgtgcacctttgacctgctgggccagtcagccgtacagcatctcctgggcccccaggtgtcaggccccaggtgctaaggataaaatagtcctttcaaggagccagtcatctggagagagagaaaagtacttaaacagttggtttcaatagaagacgtcgggtttagcctagagatctccagagggtttcctggagcacctacagcagggagtcagctgaacctgctctgaatcgtggagagtaagtaggattgatttagtcttggctatgtgtgcagggatcgggggaagcctgtgggagagttttc

SEQ ID NO: 591776 - DNA, 449 bp, Homo sapiens
agagcagatggatacccacgcgtcacagataacctagtgtcatgcacgagacccatgtttctcaggtgtagatactggcagtcttagttttagtatctctaaggcgcagacatcatggcagaacaaaggatactcagctctgttccacagggggagactagctgatatcctcagactgtggccacagagtcttagaggtaccaaaagagagtctagagactactttgatctatagggaacaggcggtcgggttaaagagaactggtcatatcagccagatggattcagagaacgtactttcctgactctaactgtctgcctgtctaaatccagtcatcattcatcacgcactaactgagtgcctacctgggaacgcgggggatatgcagagagcaagagagagctaggctttgccctcatggtgcttaacattttagtagaaacagaca

SEQ ID NO: 591777 - DNA, 598 bp, Homo sapiens
  misc_feature (101)..(101): n is a, c, g, or t
  misc_feature (221)..(221): n is a, c, g, or t
  misc_feature (228)..(228): n is a, c, g, or t
  misc_feature (402)..(402): n is a, c, g, or t
  misc_feature (498)..(498): n is a, c, g, or t
  misc_feature (566)..(566): n is a, c, g, or t
  misc_feature (568)..(569): n is a, c, g, or t
gagccccaaatgggcatccgaaatgtaaccatttaggcagtgagggcagcatgttagcagagaggtgaaggatgaagagagagcaccaaatgggcatcganatgaaccatctaggcagtgagggcagcatgttagcagagagatgaaggatgaagacagagcaccacatgggcatccgagatgaaaccatctaggcagtgagggcagcatgttagcagagnggtgaangatgaagagagagcaccacatgagcatccgagatgaaaccatctaggcagtgagggcagcatgttagcagagaggtgaaggatgaagagagagcaccacatggacatccgagatgtaaaccatctaggcagtgagggcagcatgttagcagagaggtgaaggatgaagacagancaccacatgcgcatccgagatgaaaccatctaggcagtgagggcagcatgttagcagagaggtgaaggatgaagagagagcaccacatgcacatcngagatgaaaccatctaggcagtgagggcagcatgttagcagagaggtgaaggatgaagaaagagcacnanngacatccgagatgaaccatcctgaagaca

SEQ ID NO: 591778 - DNA, 974 bp, Homo sapiens
aacgggtccacagcactgggaggcacaaatgaagccatcgaggagcaggtggctcgggaatcctacctgcaggggtagcgggctcaggagaaacaggctcgccaggtccgaggccccagaacagcccgtgcaaagccagacgccgacatgcagtatcggccacagcgagcgagcctccagatggccgtgggaggaggtggaagtagacacgggtccaccgtcgggcgagacggtagattcaagccttcgtgagcatgaggccacccctgagtctgcgagtgcgtgaaattgggcgatgaaagcctctccattcacgcaggcacatgttattagcctcttggcacaaaccctcctttcggcctgtgcgccaggtacaaagcagaacagcttctcggcaggggccgaccgggaaagtgccccccttgtgttccctctaccctgctttggagtgcctgggtcctcattcaagcagatgtccaccgctctgcctttggtctgaatgactgggatgatgatgagatcctagcttcggtgctggcaagtgtcccaacaggaatacctagacagtatgaagaaaaacaaagtgcacagagaccgccccagacaaagagttgatggagacccaggtattggaaacatctcccaacgcagtactcctgtctcggtggccaccatcaccttcttgggttcttccctctgctcttctgtcttctgtactcccctcttttcctcctccttaatactctggtagccaaccctggatcattcattgcggtgcatatactgttctctgccagttgttgccggtgcccaccaatcgaagacatccgattcaaggacggcagtgcgaatgcaaggccagagcaagcatgggcggaccaggaagaaaaagaagccggcatcaagaaagcgccatacggggaagagatcccagtggaggttataacaccgagacatgtcctgctcaagcagaa

SEQ ID NO: 591779 - DNA, 220 bp, Homo sapiens
tatgcgttcaaactggtgtaatgatatatgataggatacacaaaccagttggcaaatagtaaagccagtcatcttgcacatgtcagaaataggtacaaagattataagacaccttacacacacacacacacacacacacgcgtgtgcacgccagtgacaaaaaacaatggggcctctcctaaaataagaacatgcagagtgggagcgagaggggggggat

SEQ ID NO: 591780 - DNA, 219 bp, Homo sapiens
caaagaaaagactttagtaaaaataagcaggaggtaggtgagagtgaccaacaaatggcaagtgcacagaaccccgtaggagggcgagaggatcagcccaggtccatggcttcttctgcgaccttcgtggccttagcgtcgacgtctgtaagccagggtccagtgctggtgagaacagcacaagtagtcgcgcacacgtcgcccttctgtcgtcttctc

SEQ ID NO: 591781 - DNA, 398 bp, Homo sapiens
atgcgcgagctatcccatctagtccttcccagtaaccagtagcaaagcaagcgccatgcttcattctacggttgttgtctcaatgtttccctgtgtttcctttgggtcggctgtgttcttaatttgcttttcccttgatgagtcctgcatcatttgaaaatgtccgtgcaaagtggtatcctgaggtgcggaaccactgtcccaacactcccatcatcctagtgggacactcaacacttgatcttcagggcatgcatcaagcaacgcatcgagcaaattgcaaggcagcaagccagctggctcccatccactcatccgcagggtctcaccatggctcaggcagctgggtgctgtaaccatccctgtgcagtgtcggcgctcacccagcgcaggcctca

SEQ ID NO: 591782 - DNA, 487 bp, Homo sapiens
tcagtacttcatttcaaaacttatttccaatcacgaggaaagatttatttaaaatatactcgtacattttctgctgtggatatctactaattccttacttctgtttgttcccaatatctgtgttgactttgtattcgccaaacattatactagtgggtttttctactaattattttttgaagcattattttcccaacacaaaagagcttttttctcggtataatgaaaattgaaatcctatgtgtattcaatagtaaatagacaaattttattttttatttccacttgaagagttacatttcgtataaaagtttacaaataacggtttttattttgattttttcagtataaaaaaagttgccttgatggcatattatgatgtaatgctaattgcttgtaggatagtaaatggtcagtattgaaacctaatctctagctgccgtcttgtagatttgaacgaatgttcaccaagcatgtattttgtatt

SEQ ID NO: 591783 - DNA, 912 bp, Homo sapiens
ctggatacagagccggaggttctgggcatggacgagaacagcatgctgatccccatcgcatgtgggtggtgccctgagcggggctggtcctcatcgtcctcatcgcctacctcgtctgtgcaggaagacggagtcacgcaggctaccagactatctagcctggtgcacgcaggcacagcacgcctgcacggggcctcgtgttccatttctcatggagcttagggatcctgtcagaagcgggaggcacagcttgtctggcaaaccgtttctcaaactctgcttcagtccaactgtgaagttcatcttgcaggcactgtactaatgcacaagcagagtaacctatcgaccctgacggtgttaacgtgtttgctaaaacttggggttaacactatatttggctaagctgggtttaaaacaattacatactttagccaaacgtagggaatatatggaagggtgagggagtgcatcacgtcatgaaggaggagtagggagagtggccggcatgatatcgtgaagaggagtgagaaggatggccagacatggacaccatctgaagagagcgaagggggagaatggccaggagaccatccactggacacgaggagaatgcggaaggatagcccagacaataaaacttccaatggaaggggaggggatgggaaagagctggccacggaatcccatcgcatccttgaatgagaggtgggatgacagaggagatggccgaggcaatagtaccagatacaacgagaacaggagaccatgatagggggaccaaagttggtccccggacacactggaatgacattcgcatggaacacggggggacgactggcggaagaggaagaaatcgcgcagcgtgcaatctaccgataacaagaaacgttcacgggaacagtctccacacag

SEQ ID NO: 591784 - DNA, 658 bp, Homo sapiens
atcaacaactgatgtcatgtcgattgtaatcttaaaatcgatgctcatgtacctcatttcataggaaccgcgtcatcacgtgctcattaatatactgtactctcctacgtccctcattctcactgttgcattttttcagcttgcacaacattcacttcaatctggctttccgtctattattaagtacacatatcataccacctaacacactatcttgaaactgaataatacctaatattgattcgtgcgactacttttaactacgaagatatacattattccacaagaacaaacgatttacacaagcatgtacacacataggacgtttagactacttgctctaactctataattctctagacacatcataggaggaaaccctctgagctaggtccatgtcagaatcttactaacaacgtctgtctgggtacgattttcttttccttgcaagcagtcttctgcaacaactgtactgatatagtcagcttgcttccgaggctagtacacaaagcatatttttctaacagcagtattggcagttggcagtatagtacaaatacgttttctcactaatgacagtccatgattcggaaattctaagcccatgaatcatggcgcggtcttaccacggtgatgcctgtgtgccgagtagatggga

SEQ ID NO: 591785 - DNA, 226 bp, Homo sapiens
  misc_feature (36)..(36): n is a, c, g, or t
  misc_feature (38)..(38): n is a, c, g, or t
  misc_feature (51)..(51): n is a, c, g, or t
  misc_feature (55)..(55): n is a, c, g, or t
  misc_feature (94)..(94): n is a, c, g, or t
  misc_feature (196)..(196): n is a, c, g, or t
tataaggggaccacctggaggaaagtttcaagtttnancctttcaaataantgtnagctatcaaaagcaatacttcagcatatttccctctttnagtcctgtttttaaaatcagtctgggctggacagtgactcacgcctgttatctcagcaccttggaaggccaaggcgggcagatcacgaggtcaggagatagnaaaccatcctgggctcttgattggtaaagg

SEQ ID NO: 591786 - DNA, 109 bp, Homo sapiens
tacaacaggattctgaccatgaagtctcttttaggtaacagatccattaactttttttgaagatgcttcagatccagagcaccaacaagggggcaaacgccgccgcgcc

SEQ ID NO: 591787 - DNA, 790 bp, Homo sapiens
  misc_feature (330)..(330): n is a, c, g, or t
  misc_feature (399)..(399): n is a, c, g, or t
ggtcagccatcaggtacgccaagagtgggtgcctcagaagtacatgcaggaggctatgtgagaaagaagcaggctgatgtcacctgcgctttctttctgagggtcctgctgctgggagatagcggcattgatctctggtctcgacagggatccccggcccgagcccggcctgacatagacaggcgcgccggactgcggctaaccaagggtgcaaatgcaatcggttacggtcagtatatatgagaattcgatgttctgctccgggtggtttgggcagaagaggggacccagcttgacctaagagtggttgcaagcttaaccaggacaagngcacttgtccagtcattcggttgttacactcgagctagaaagttgtgctgcgggaaggcgcgtgcaagnatcgctagatggtcgacgaggcgatgcctgaagctggagagcgcgacgtgatggaggcgtctgatgaagtctcatgatacttctttagctttggggattagggtgaagaatatcctatgagtagcaaaaattgtgttttgacggggttagtccgtcgacgtgggactgccacctttcactaaaaggtatcccagacgaaagttctcgtggtacgactcctaggtggatcaccatatacacaggtcctagcaaagcacagggggagcatgcggtggcggcgtagacaatcatggctagggcacggaaaaagacgcctgtggatctttgcgcaataggtggcaccgaatgttaccgaaacgacagttattaaggtgggcatcttcggcctggg

SEQ ID NO: 591788 - DNA, 446 bp, Homo sapiens
  misc_feature (19)..(19): n is a, c, g, or t
  misc_feature (39)..(39): n is a, c, g, or t
  misc_feature (201)..(201): n is a, c, g, or t
tttaaccaacaagccttancctcaccccctcccaaaaantagtaagactgttattaattagaataccttgaatgtttgtacccatgttatgcctgctttccatgtaaatagagcccagcaatttcttgaacatcagataagaaagatggtgtcccaaaaaaatcttggaactgcctattttcttttttcccagaagtttantcttagggccgggtgtggtggctcatgcctgtaatcccagcgctttgggaggctgaggcgggtggatccctcgagatcaggagttcgagaccagcctgaccaacatggcgaaaccccatatctactaaaatacaaaaattagccagtgtggtggtgcatgcctgtagtcccagctactcagggggctgaggcacaaagattgcgtgaaccttggaggcagaggttgcggtgggtggcagcgcgac

SEQ ID NO: 591789 - DNA, 211 bp, Homo sapiens
gctcggttagtgaatggctcccacgggcatgacgctagagagcaggttgagtccaaagtaccctccttctactaccggcccacgccctccgactgccagctccttcgagagcagtggatccgaggcattcaacggctggggattctctaaaatcgaactggagggcatgtgcaaggcttgtggcactgggccggtcggttttacaaacggt

SEQ ID NO: 591790 - DNA, 737 bp, Homo sapiens
tgttgattgattttgttttttgggtttgcttgatttttgttgtgtctcttaaggttttatgatttgttcttttatcttggttgttgttatgttttgtatttttctcagattgtcttgaagatcatgggatggttgtattaatagggaagatagtattattgtctaaatgtgtttaaattcagtttattgaaacgtttttggtggaagagttgcagttgttatattgggttagtgtattgtcgagcaaagtctgcatagaatcgtcgtgtaagcgtgcaaggaggtgacgtggagaggatcgcgtaccgtgaagcacagtgcctagcaggcgctgtaaaggcaggctaggagtggagagcaggagattcacaggagagaagcaacgagtaggaagcgaatggctgcacttcccagccagaaggccacgcacgcacccagcatctgcggtgctgaagggagaaaggaaggtcaacgtgtagaagttcagcatagcattgaaagtattcgtttaggctgctcagcaggggctcacagcctgtaagtcccagcacttgtgggaggctgagtgcaggtggagtcacctgagagtgcaggagtgtgagaccagcgctggccaacatggagaaaccccatctctatctaaaagtacaaaaattagccaggcgtgctggcgcatgcctgtaatcccagctagcttgggaggctgagacaagagacgttagcgtgaaccgtgggag

SEQ ID NO: 591791 - DNA, 312 bp, Homo sapiens
gtgatgcccgtttttagcttcctgtggcctcaaggacggtgtcattgcctccgcccagccacgttccctttcctcctctctctcgtgtgggttctcccatcagccatctggttctcctcttaagtgccgttgacgctggtcgcttcaccgcttcccatgttcggttagtgatgtagaaatgctcctgtccctggcgctacctccttcccagatccccatcccctgaataaagcagttgttggtaattcttcaacaatacaaaacacaaatagtgtttttgttcaaccctcctaccccaaatacaactgaaca

SEQ ID NO: 591792 - DNA, 193 bp, Homo sapiens
catccccgaccagccccaaggtcttcccgatgagcctctgaagcacccagccagatgggaccgtggtcatcgccgtgcgggtccagggcttcttcccccaggagccactcagggtgaccgggagcgaaagcggacggggcgtgaccgaaaagaaattcccacccagccaggatgcctcgggggacctgtacac

SEQ ID NO: 591793 - DNA, 218 bp, Homo sapiens
aagaaggtaagaaaggtcatcagagaaatggtgagttaattatatcttgtatggatacaggtgtagataagctctcgcaatgtcccaggatggagagaaactaggagaaaagcacaggatgtagaggtctatacggcataatcttctccctcattttcatcttcaccatcaacagagagagcagcatacttgcttgcagaactgaacttagaagctgg

SEQ ID NO: 591794 - DNA, 151 bp, Homo sapiens
cttgttccttcaggactcagatatgaggacttccttagtgccattcagtctgaggcagacatggtcctccacccttcctgccatctgctgggtcctcaggtagttggaatcctgacttaggacttggggttgggtcaaggtgcttacatcc

SEQ ID NO: 591795 - DNA, 536 bp, Homo sapiens
  misc_feature (96)..(96): n is a, c, g, or t
ggcacgaggttgactgtgactgataccttacgcaggagagactgatccagatctgtcactacaagggcatcaccgttacggcctacagctccttgngctctacggattgaccttgggccaagccagactacccttccatgctggaggatcctaggattaaggagatagctgcagagcacagaagaaccgcagaccaggatctgatacgatgcatatccagaggaaggatgcatcgaagctggaaccagccgcatgtgaacatgaggcttgacttatgaggtacgaatcgactctagttacaagctgagcctgtacggtgatcttattgggattctcatcataatgagagaattcgtagaatcggaactctttctaagatctatatcatagcgtataaccgactgctgtacaataggtgttatctatgtaatgatgattccaactgtgaagagcatgtccttcgcgcattatactgacttcaatggtgagcactaatgattacatcacaatacgtattttactcttaactgtgtatg

SEQ ID NO: 591796 - DNA, 153 bp, Homo sapiens
ggaccacactggctctttgtgtctgtgacttctgagtattctgcccaggcttggactggtgattccctctgtctgtaatgtgcttcctgaaaacatctgcagtgtgctccctcacatcctttacaactttaatcaaggtcagctgtcagtgag

SEQ ID NO: 591797 - DNA, 181 bp, Homo sapiens
agtcatgtgacctgcggcaactataatatacgctattgcagctggagattcccgcgccgctgtcatcacaccttcccctcccatgtatcctacgttccagcatttccgtgaactcgttcctccttccagagtctcccagcaggtcctgcattcttatccctcgtcattacctccccacgtc

SEQ ID NO: 591798 - DNA, 844 bp, Homo sapiens
  misc_feature (175)..(175): n is a, c, g, or t
ctgtcccctaatttggcgccccttttgatgggctgccccccaggggttgagccgttgtctttgacgttgctgcgccaccgggcaaggtgtgctcctccctccttttataaagccgggcgtcttcctcctttcctcattcgctggggctccccttttgcgagacggttatagtatnttattatatccgcgccaccacggtcctctgtgtacatcagataccgccccacgggggctctcttgaatctgctcgcccacactcctctccccgctttttcaacatatttctttgcttgtgtgggggggcgcacgctctttcggggggctcaggagaccactcccatccatctctggggcgctggtgtcttacagtgtctagtggatttcttccccccgcttctaaatcgcggcgatggttgttgatagctcgctctggggttcccccataagacagtgtgtgctcccccgggcaccacgtttgtctcctaagcgggggatcacggtcggcattcggttttttgtgggccccatgatatgacaccactataggagggttctggccgcccagtagggtggtgtccgaagggcacttccccgatggggtcctcccgctgtattataggatttgttgtgtttccgaccagcatctgtaagatctctcgtgtgattgtgagtttcacccccgggtataccccggcggggtttttctattttagcattctacaatttctcccctttccaaagccacaaaaaaaaaagcctctttttccaagggcctttcccccctgatgaatttttttcccctttgttttataccccccccccccccaaaacaggggttttttta

SEQ ID NO: 591799 - DNA, 297 bp, Homo sapiens
aacttacagcaggtctcttcttacactcctgcacccgacgtcctgcaccagctccccttaggcctgtgggaggatgtggccccaccctgcctgacggtcactttgatgggatcctgtacgacaccatacccacatctcgtgaggagacctgtgcacacacaccaagttcacacttgcagtcaagaaccacgccttttcgcctgctgaagccgcgggggcgtcctcacctactgcaacctcacctcctggggggagctgatgaagtccaagtactcagacatcaccatcatgtttgag

SEQ ID NO: 591800 - DNA, 152 bp, Homo sapiens
aaaagagcgtagatgccggcgagatgaatagaggcctaggaggcgctggctctttggcggataagaggacggctgctgctgctgctgctgctgctggtggcccctttgcagatgtattgctgtccttgaatattagcccatttgaaaaggct

SEQ ID NO: 591801 - DNA, 362 bp, Homo sapiens
tacaatcgagccggacctgcagctctctctgatggaggaacatctcttctgtgactcatggttgtcttgccattgaacagcagccccaggctgtgtgtgtgctcagtgtgtaatgctgtgagcttggtgcaaatggcaggagctctaggaaatggattgtgatttatgacttcaaaagatggaagtgaagggtatgggtttttctaaagatttaaagctgtggatatacatagtaatctagaatactagtaacagcaataatgacttcaagcataaagggtgcatttgtatactacctctttctctgagggttccaggggtgctcatgtttttatcccccgaatatctcattgcaataatga

SEQ ID NO: 591802 - DNA, 206 bp, Homo sapiens
tgtgtcatctccggagcgttttcagcggcccctgggtctgcgtgcgtctcttcggggctgtgggcatgcagggaagtggctctgatggcagtctgggcgtgtgtgcccgtgcctctgcccagctgagaggccgtgggctcgtggacagagccgtccttcagtgctggggtagcaggtcagtccaggcaggaagcagcaccacgaat

SEQ ID NO: 591803 - DNA, 145 bp, Homo sapiens
cctttgggctttggccctttttccccagggggcccccccccattgggggcccccgggtttttttttccccccccccccccccccccccggggttttattttggtaaggggggggggggatgaataaataaaggggttttttgcca

SEQ ID NO: 591804 - DNA, 176 bp, Homo sapiens
  misc_feature (47)..(47): n is a, c, g, or t
tgccctttttttttttttaaatcatggcagatttcaggggaaggggntttaaaagaaaaatcgggaaaccagttgttataaagtaatttaaaaatgaaggaaaaaaaggaaaaaaacttatgtacaaaccaaggggtgtttttaggaacattgtgagggaaatgaaattgcatgtg

SEQ ID NO: 591805 - DNA, 321 bp, Homo sapiens
ggctaaagaaatgggctccacacacccgccttttagagcaaggttgaaggaaaaaagaaagagaaattcctttactgttactcctttccctggcttcctaagcataactgtgtttacaaatgtctggatttagccagtccttgtttttcttttgacacagctacaagccacaagttatgcactatatgattaactgcttttgttttacttttgtgaagtctgcttataaaaaccccattctgtctttattcaatgctaagctttttaaatgcaaatccactgagctagtgcatacctaaaataaacagtccttcccttctc

SEQ ID NO: 591806 - DNA, 196 bp, Homo sapiens
tcatttgtgctgtgaagagaacattcacaagcctctcttccggctataattatagtagtcgataccttactgtaaaccataaccaccctaccgtgcaatagaacaccacaacttattcctcctatcccaccgtaactttgtacccattgacgaacctcttcccgtcttccttttcttccttcctttcccagtctct

SEQ ID NO: 591807 - DNA, 958 bp, Homo sapiens
ctatgtaggaaagacaccgaaggagaaagaagatccttctcacagtacaagcgaaatgctacacagaaatgcatcaccacagattgcttgcaagaggtaacttaaggaatgctgaatatggacatgacacgaccattactggacaccacgaaagacacacttaaggccaggcgactatggctcatgcgtgtaattcccagcgacagctgggagtagcgagacaagcagatcacaagttcagaacgtccaagaccagcctggccaacatggtgaaaccctgtctctactaaagattaagaccagttgagctgggtgtggtggtgggcacctgttattgcagctacttgcggaggcttggaacctgggaggcaggaggttgcagtgagccaagatcatgccacgtgtacgtccagcctggcgtgacagaagcgaacgactagcatctaagaacatactaacatagaaaacgctccgttccccagggtatacagaacatggccgagggttaagagccaaggggaccactggtggtccgcggaataaaccgaccggaaacacggtgtacgcaggggtcacattcctgcccgtgtcagggtgaacccttgcggttgccacgtgggttgaaggacccagagtgacggcaggcccggcgcgcgtggcaaggaaacaaggaccgacgtggaggggccttcaagagaaccactcccacggcaggaccacgatggtcaaggcaggactgggacaacgtccccggcacggacagccgaaccagccggggggtcttccactagggcagcattaacacatataacaagaccgaggctgccaagtgcgcccagaccgtccagatgtcccgggagcacgcctaggtagaggagagagtaacaagtgcaacgcgaaacagcaaacagcgacaaacgaaaacagaccgcaccaaacgcgggcacgaaacacgggt

SEQ ID NO: 591808 - DNA, 220 bp, Homo sapiens
cttactaagtaggtgatgagtttgacagtttttgacatttatattaaataacatgtttctctataaagtatggtaatagctttagtgaattaaatttagttgagcatagagaacaaagtaaaagtagtgttgtccaggagtcagactttgacctgtcctgataggtcccaatcatcgtataagaccatatacctgcctatacaacagggtggaccaccca

SEQ ID NO: 591809 - DNA, 212 bp, Homo sapiens
taacatactctctcatcgtagatattatttaaaatattcagtgtgccatcagtatcaaagaaattattgccaacacaggagccacagcaattataggctactttactgatctgcccatctgtcaccttacaaggttatccctatgtacaggaaggaagcagctgtctccttgcaaacaggtcccttcctctccatctcccaccaaactaggg

SEQ ID NO: 591810 - DNA, 362 bp, Homo sapiens
  misc_feature (319)..(319): n is a, c, g, or t
tcaggaggagctgaggagatggatcactgaggttgggagtttgagacagcctgactaacatggtgaaacccctctctactaaaattacaaaattagccgggcgtgttggtgcatgcctgtaatcccagctactcaagaggctgaggcaggaaaatcacttgaacccaggaggcagaggctgcagtgagtggagattgcagcatcgcactacagcctgggcaacaacagcaaaactccgtctcaaaaaaataaagttcttcccttagaactagtccttgttgggctagtctttctgggattttggtttactctcctccanccattggaagggcttaaaaccgaatagtcagctcctcctagct

SEQ ID NO: 591811 - DNA, 770 bp, Homo sapiens
gccactgtctgatcctggccgtttgttagacctggcttgccaatgcatgctgatactactgagcctgcatcgaactaaagccggaacaggagttctgcaagctgcagaaggtctctcagtgcacctttaagttacttgtcttttgtaccagagcaaggaggagagcggcgtgctgagattactaggtaagctggtgataacccgggtatgaggaaagcggcgtctaattcgcaaggaatatagaaacgtggctgtgttgcagctgtgcgtactcagcgatgttctgtcataaagcaggcaagtaggtacgtcggagaggcaagtgctgaaggggacgtaatgaggctggagcagaatctctctaatcagagaatacaagtcatgaagcgcctagtgactgtaccattggtgagtgatggggcctgggaagaacccgctcttctctgcttcttcttatcgaagagcccccagagcacatcatgggaccattccttctagtgtcccaggagtggagggcacggttggctggaagcgtatccggacgtcatttggacagtatgacccgggttgggttgggccactcgtaagttaatttacgccgaagggaagcgacaacgaaaggttcttaaaacgcacaattgtgtcatgcgaaacatccccgtttgttgactgcagcacccatgaggagtaggcgcctatgggctcgacaaggaacatggtggtggctcgcgtaacgacactcccgtaagcggaaagagttactttcccct

SEQ ID NO: 591812 - DNA, 712 bp, Homo sapiens
  misc_feature (63)..(63): n is a, c, g, or t
agcttccgggctgcgctcttcgttgcccagtttccgctcagtggtcgcgtctccgccccccanccaccagtcccgctgcattctcggccgggctctaggcgccatggctccccgcgggaggaaagcgtaaggctgaggccgcaggtggtcgccgtagccgagaagcgagagaagctggcgaacggcggggagggaatggaggaggcgaccgttgttatcgagcattgcactagctgacgcgtctatgggcgcaacgcgcgggccctgagccaggcgctgcgcctggagggccccagagcttccagtaaaggtgaacccgacgaagccccggaggggcatctcgatggtgacgctgctgcgcccggacggcagcagtgcggagctcttggacttgggattaagaaggggcccccacgcaaactcaaattccctgagcctcaagaggtggtggaagagttgaagaagtacctgtcgtaggggagatttgggtagaagccctcatgctgagctttgtgtccctggtgatgttggaacattaatgatggaacatgggccaaactttcagtcatgatcctgaagccatggtttgctaccctgccagaactgccaggttcagttcatgaggcaaccctctagtcaaggcattgtaagaagcttactgcgattgggttcaataaagttggacattacagtacaaaaaccaaaacggggg

SEQ ID NO: 591813 - DNA, 118 bp, Homo sapiens
cacgaggcaggccattgtggctaaacacgcatggcaggatctgaaagtggtggtcttcacctgtgcatgaattattaattctggaaatttcaatataaacagcttgaaatacctgaat

SEQ ID NO: 591814 - DNA, 366 bp, Homo sapiens
  misc_feature (11)..(11): n is a, c, g, or t
  misc_feature (339)..(339): n is a, c, g, or t
  misc_feature (344)..(344): n is a, c, g, or t
cctgggtgaangctgggcaaatcccctttagaggtgcctgcgctgtggcttcttgctaacccatggctctgaaccagttttctgggttttgcccagggaggacagcttgtttcaccgtggatgagcaaaatggagaccattcatgaggattacttatcagaacaaccgtttaatcagaacttcaagcacaggcatggtgctgagtcaaagcagcaggggcctgtcaagaggccggagaaggagatacttatggagccggccagccgcgtggaccactgcgcatctcttaatagaccctctgtgagagatgagaaaaatggggataaaaaaggggaagtnacctncccaccatcacaaggctgagta

SEQ ID NO: 591815 - DNA, 101 bp, Homo sapiens
ttattatgtgatagatgacctcgaggaccaccagacccatttatctacacttcactccatgtcctatattacctggaactaggaaggtagttgatgttcac

SEQ ID NO: 591816 - DNA, 233 bp, Homo sapiens
ttttccgggatttttttcccccccgggtccccgggggggtgggaaggaaattttttttcccgggccccttttaaagggggggccggtggtgttttctccccgccccccccccccccggggtttttttttttttggcccctgttttttcagggccctcccccccccccccccctgggcttgggggggccgtgggggcggggtttgtttttcccctttaaaggttttttgtttca

SEQ ID NO: 591817 - DNA, 187 bp, Homo sapiens
gagctcgagtccggtgtgcacaaaggaccctggccaaaattctacagcgtagaaatgaaggtctgcctagagttcatggttttaagaacttctccagtcatgagctaagtctcctggtgcctgcttcaatgcactttcctccgtgaccaggctgcttcctccataactcccatttgccatactttgt

SEQ ID NO: 591818 - DNA, 1013 bp, Homo sapiens
gcctgtaatcccagcacttgggaggccgaggcgggcggatcacgaggtcaggagatcgagaccatcccggctaaaacggtgaaaccccgtctctactaaaaaaaaaatacaaaaaattagccgggcgtagtggcgggcgccggtagtcccagctactggggaggctgaggcaggagaatggcgtgaacccgggaggcggagcttgcagtgagccgagatcccgccacgtgcactccagccggggcgacagagcgagactccgtctcaaaaacaaaacaaaaacaaaaaaacaaaaaaaaaaaaaacccggaacatcagttccttcccccaggggggtgtccggggggggcctccacaacctcgcggggggcaccgaggggtagggaagaattctccgcaaatcaagcggcaaaaaatcggggacccgagaccgccgaaagagtggcggggcacccctgtgacgggcttgaggccccggggggggcgcccacaacaaggcggtgcagcgcacccgggggcagggaaacgggcgcccaaaccaggagaaagaggcacggacgagaattacaccgtgcgggccgactccgggcacaccgcatcacaaccaagagtcgagatacacaggcgcacataacacgaaaccgggggggacccacgcctaggaggggcccacaaaaggctggagcaacgacatcggggccgagccgcgaggcgcagacagacaccggcgcgagacgacccgaaccaacggcgccccacacccgcacccacgcgggacgcgacaaccggcagcccacagagccccgaaccggcgcacccaccacacgggtccccactgcgatgacccgcacgcgaccatcccgcggaaacgtcagaacacactcggcaccgaggaggagacgaccagtgagtgcaggccaaccacgcagagccgagccacagccagccccacccgacagcacaagccgccccacggagcagccacccaaacgagcacgcaacgacaggcgccc

SEQ ID NO: 591819 - DNA, 246 bp, Homo sapiens
accctaataggggtaaaacaggccaaaatatcttaagccttttataacacaattattttggcttagttataaaaggcaaaacaatacacataagaaaacctgagtactgaaaaggtggcattataaagtgtgtaaagagcctaggttcaatggggagggggtacaatactaaaataaaaggagatcgccagcaataggagaatagaatataatccagctatttagaatgttcccatcattcgggtg

SEQ ID NO: 591820 - DNA, 308 bp, Homo sapiens
tgcggggggggagtttcatttttaagtgaagtccaaaagccctttaaaaataatagttgtttatcattttatagaaatcagcattttctctatggcgaaacaccccattcgtttcgcgtatgattggcctttggagttacacgctccaacgagctatgttttaactgttaactgttaataattatttggcccagaagaagggatgcagtggttttgccgttcacaggaatattgaacttcttctgtaaaagagagaaagaaacctctctctctcatgcaccacatggaaacagagtgtggccatgaaa

SEQ ID NO: 591821 - DNA, 933 bp, Homo sapiens
  misc_feature (1)..(1): n is a, c, g, or t
nccagaccgtgtgccctgcgctttttggcccatggaccgatgtgcgaagaacggggtggccgtcgtcggatccccgtattttggtccccggttcgctctctgaggagagttctccacgatgtccggcgccggctcccttttttgtccttcggggggcagcagatggggaccctcttgcggtgtgtccccgcgtacacgcttttttgcacagccttttgggtgtcccgcggtcccggggggagtgggctcccccgtgttttgcgcgccccacactgtccccggattatatggggggccccctgttcccccctccctcccttttgtggtgggcccccccttgggcgtgccccgcctttcaaccggcgggggttcataccgcgcaaatttaacagacggggttcttccggggattcccgccccctgtcgggacccccttgggccgtgtcccctcggatggtccgcccctttgccccgcgcggcgggtgttgcgcgtgttccaggacccccagatgtgtcctgtgtggtggatatcccccgcccggcccgcaggtggcgcggccgcgagcggagcactgggtgacatttctccggtgttttacccgggatacacgctgtcccccgggggtgggcccccccccagagttctctgctcccgggttccctgagggcgacccttgccgtggtggcgccccctgttcccagctgtggcaccccgtcccacgaggtcttcccctctcccggcgaccctttgagtttcggggcccgcttgggggcccgacgaagctcgcccaaattccgtgggtccccccaattaaaccttttcccgggaccacaccctgcccccctgggtgtgcctccccccccccccgtgggttttttttggaaaaaattattttttttttttttccaaaaaagtttcaagccaccccccca

SEQ ID NO: 591822 - DNA, 254 bp, Homo sapiens
cgaattacaggcatgagccaccgtgcccggcccagcctaattctattctttcttctctttgagttttttttttttcaacggtttaacaaccagggggtggggggatcccatttaaaacctctgcatctaagttgaggggacaaaaagactgccttgggttcactggaactctgggccactatgagaggctgttctaaacccccagcagggaataagccgcctccacaattggctatccctctataaggtcccct

SEQ ID NO: 591823 - DNA, 151 bp, Homo sapiens
taatcgagctcggccctggtttatttctgttttgggcagaacacgagtttagcggttggttactggctagctgacagaaatgtttgcaaaaactcatattctgcccaaaacagaaattgtgccagtcaaggagaaggaggcacacagtgct

SEQ ID NO: 591824 - DNA, 165 bp, Homo sapiens
cctagctacaaaaaggctgcaaggatttgtggtgtgatctatagattcaatctgtaagaaaagagagcccataaatacaggtcctacgcattatatggacaatctgatttttgatagaagcgaaaggcaattcaggggggatccgtctagaaatcgaccttgcag

SEQ ID NO: 591825 - DNA, 162 bp, Homo sapiens
  misc_feature (26)..(26): n is a, c, g, or t
ggggccggccttgagggcttgcaagntataggggaacccttgccgtaacaacaaccccgcctcgttaagtgcccttcaggggcgccttttggcggttttctcccaccccactgggcgggttttaacccccaagggggaccctttttgggacctttaaccaga

SEQ ID NO: 591826 - DNA, 145 bp, Homo sapiens
cccgggccccccccccggttggggggattttttttttgggggcttgggccgcggggtttttccccgggggggggggggggggggggggggggaatccccccccaggggtttttggtttggccgaattttttttttgggggcttta

SEQ ID NO: 591827 - DNA, 338 bp, Homo sapiens
ggctcgccgattcaatccgtgaatgctgcccggacattgcctcttctggaggctgaaacaacatgtggctgaggtttagcacatacagtacagcgccggggctgtaggcgccagataggacgttgcctcctaaatctggcagctcactttgcgcccacagagtcgttgctgggaacaccctgttcacgggcccctgggtcctggctgaaggcctcttctcgggtgctggatacacagtatccaagggcggtgcccctgcgtgcggaagcatgtgcacagcttccgtggtggagttaagaggcaggggacagacctggggtgcacagagggtctccatg

SEQ ID NO: 591828 - DNA, 878 bp, Homo sapiens
tggaaacaaagtcttgctctgtaacccaggcttgagtgcaagggtgtgatcttggctccgtgcaacctccactcccggttttcaagcgatcctcctgtgcctcagcctcccaagttagctgggattacacggttgcacaccaccatgcccagctaattgtgtatatttttctagtagagacggggtttacaccacgtttggccaggctggccttgaacttccgtgaccctcaagtgtgatccaccctccttcggccatcccaggtgatgggattacaggcgttgagccactgtgcttccgtggccccccatttcctttggattctctcaaatcagtctttcacccattcgtgaagccagtggcctttcgtgtgtgcacccaggttcagtgggttcattaaaccccttaaacactaagtgtgaagtcatcctttccccaaaaggacccctgtgggaaagtgtacgtggccccctcgtgtggtggacttacttccccaggaaattcaggcacctttaaggaacatatttgtgaaaagttgtttggtgccatctctctatattgtggtcaccttttgaaaacctccggtatcaccccctgtgtggtgcccacacctctttcttcatatcgtgccccgtggtgctaataccgtgggctggtgcactcccccctttaaaagcgggttttttacacccgtgtgtgcctatcacaaaagccacttataagccccccataagaggcccccttatctataacttgcaaattaaccccttgaagagctcctcaaaaacacaccacgtgagaacaccgttcatctggaaaacaccagggccacgtgttgttttcccaaagagtttgtcatatgatgcaccacctttaca

SEQ ID NO: 591829 - DNA, 344 bp, Homo sapiens
gactgtgatccgattctttccagcggcttctgcaaccaagcgggtcttacccccggtcctcccgcgtctccagtcctcgcaccctggaaccgcccaacgtcccccgagagtcccccgaatcccccgctccccaggcctaccctaagaggatgaagccggtgctcccgaccggcccggggcagcccctgatgctctgccgcccgccacccgcccgtgcctactgagccgctccagggcggaccccgtgcagtccaagtccgcccgccgctttgcgtcctgggacgagatgaatgtccctggccgccacggactcctgcagctcggccaggggctgcgcgaacacg

SEQ ID NO: 591830 - DNA, 1398 bp, Homo sapiens
gagacagaggctcactctgtcaactagagcatggagtgcagaggctcgatctcagctcactgcagcctccaccatcccggattcaagcaatttcctgcctcagactcttgagtagactgggattacaggagcacctccacgaggaccagttaatttttgtatctttagatggcgacgaggtttccccctattggtcaggctggatctcaaacttctgacctcaagtgatccacatcgacctcagcctctcaaaagtgcatgggattacaggcatgaggcgccgcaacttgagacctagtgtttacttaactgtgcacacattccccattccatttccttgcacatgcaggctcccatcattcatggcaccagcagccaacagtacattgtcctcaccagcattcttcacaaactcatcaattcatggctcatctgcatgcaacatttcaacatcagcattgatcattcatgtctgccgcaatcatcatgggacgttattcattatgtgtctggcacaacatcatcaggcagacttataatccaacaaccatcaatcaggttcattatatagataattcacatgataaatcaaaaaccaaaatcaatcaagccaatctgcttagacatctggcagatcgcacatccattctcacaacaggttcccaaagcaagccaacgggcacaatccacttcccaggcagcatcaaagcaagtcccactttgctcaacatcaggcaacaaccatagagatcaaacacactcagagtacatgatcatcggctcaacttaaacaaccatttttccaacctggctaccaccttaataactgatggcactgcttggcccacaggacatccttcaaggttacacttgtgcatatcacacatggatccacgggactgacgcctctatgagcaagtacacaagacactaacacacataagcaactgttcagctgtcacaacgaccactggcaatgcgaggcactaccgggcaaacagcaaacaaaacagcaaacaaaaacataacaaggcaagaaataaaccacgaacccaaaaaaccacaggggaacagcaacaaacggcaccaccgacaatctgccaccaatgatcagcaacaaataaaaagccagagggcaaaacaggcggggaccaatacagtaagctacaaagagggatcaaaggcaccaagaactacaagcaagccataagagagaaagcaagcacgaacacaaaagaaggaaacgggaagacacaaggaggagacagcgaagcgcacgaatgagcgtgcacgaggggaccatagtaaaagccgcaaacaaggaagaagcagacaaacgcacacagaacaaagaaagaaacccaacaccggagacagtgtcagaagagcaacaacggc

SEQ ID NO: 591831 - DNA, 1269 bp, Homo sapiens
cccacgctgtccgcccacgcgtctgccctgacttgactggagcccaaggagtgagcagcctgccagtgccctcgtcgcccacagaggaggaggaggaggaggaggaggaggaggaagaagaggctgaagaagaggaggaggaggaggattcctgaggctgcatggtgggatgcatgtccaaggaggccccacctgccactgtcaccccctgcaggctcgtgccagccctgctgaggaacgacaaaatgcctgccctacgacgagcatgacgcaaggccttcatcgatgctgcccaggatggccccgcaacaacggttcccgaacggcacggccgagagcggggctcgcagtgaacgagcacatgcgaggccatccaatcaacgacaccgtggcccccaacgaacattcacttcctcgcacatctttggcccccagaccgcgggagacagtctgctttaccatgttacaccagcccatgtgcctaccgcacgctccaccagccaaccgacacctaccgtctaccccgccttctgcgccctttcagagctttgtccttcgccaggacccccccacacactcggcgcgggcctcttccccaaccaggcgcttggcacccttgcggcgcctcccctgggatctcgcgccgcccggacccatcactgaaacccacacgccttccccaacgctggcgcccaattgcaaacggctaacttgcaacgccccaacgtgccaacccggccccattggccctggcgcgcaacatcgacaccaacgcccaggtgcgcaggcgtcccaacacgagacgcgaatagccccgccacttccccttgatatcccccgtgacgcacatcccgacagcatccacactgagccatgaacgcccaactccaagccccaacacatcaaaccgaccccaatgacctccgactatagatagaactcttcctccaaattggaaacgacccagacctaaacccccacaccacgccccagccaccagccccccctcacatccaccaaactcatcccatcgcaaacacaacacaaacacaaccagaaccaactccccgtaaacgaaatgcgtccaaccccctctgaaaacaaagaacaaaaaatcgtaatccgcatatataataaattgaacaatacacacgactacaagcccaacataactcaaagtaacacagaaagcaaacaccagaacatacacccagacaccctcacctcccccaactcacataacatcacaaaacacccccatactatacc

SEQ ID NO: 591832 - DNA, 845 bp, Homo sapiens
gagtcggagttgtaacgctccactgactgatagatcgagcggctcgacatggctcccgagattggccctggtggccagaacgccgatagctggaggttgcagcctcgagtggcgccgtctgtcctgctgctcatccgcggtggccgccggcaaggaacctggggagctgtttgttctcagactagagacatatctgtgaacagtgcctgaagaacgtctcctgtcttgtggtgcaacactaacagggcttgtctggacttacccagttacaagcgtcttgccaccggtttccctttgtaaattgagctctgcacgctggagagttgtcgggtgaactttgaggcgctgatcatcaccatgtcggtagtcgggggacccctcctcctgggcattgccaatctgctgctgtgttgctgcaggaggaagaggagccggaagccggacaggagtgaggagaaggcatgcgtgcagggggaggagaggccggaatacggaagggaggaacggagagcagagatgaagaccaagacatgatgaattcagaaaaaaatatggcccgttaagagaagaaaaccgttatgctagatttgaaacgcagactagaggcgctccaaggacattcagtcccgacgcttcctgtgaggttgcacactaccgcaggccaagcccaggcgggagacccacgtgggcctcgcgggtttcatgaccttggccattgacctgcagcttcaggacagggccggaaatgccctaagacccgccctagcttccacggggactctatccggtacacctcttcacaatatgcccctacacaacacctggggagcgcacaactccctgga

SEQ ID NO: 591833 - DNA, 467 bp, Homo sapiens
gaccgcgagtagtgtacagagatgacaggaggtcagcgatcccttgcagctgcgtgtgggcatttgatgaagtgagggacaagagacacaggcagaaggaatgtgatggttacaacatagtttataaggaagctgcttgtcctccatcctctttctaatttcttgcaggctggaggtgaccatataggacaagtacgcttccttacacctaatgataagagctataaagatgacagacaggaatgataacggggtctcctctaaataggacttagggaagccttccaaggaagtgaccagctacaactgaggtacctacggatgacgaatgacgtcacccaaataccgaccctggggagaacaatgacctcaaaccagagggtagacgaatgcgtgacagtccctaccaagctgaagacgaactggttccgaggaagacaatgcaaagacactcgatgtgaagggga

SEQ ID NO: 591834 - DNA, 173 bp, Homo sapiens
gatccttataggtacgtgcagagggcagcgtagaggtatatggcaggagggcaagagggcaggtgaagggacatggaggagggcaggtggattggacgtggcaggagggcaggtggagggacatggcaggagggcaggtggagggacatgggaggagggcaagtggacagaca

SEQ ID NO: 591835 - DNA, 1606 bp, Homo sapiens
  misc_feature (1606)..(1606): n is a, c, g, or t
agggagaggcgggttgcgggcggcggcggcggcggcggtggcggatggtggttgtggcgaggctgtgcggcagggcgcacggagacctgtcctgcagcggctctctcaggccgagggtcgtcgctgcagctgccgggaccgaaggaaacgacgactccgggggcgaacttggcacacagggaggaacgggaaaggatgcatggtcatggaggctatgattctgatttagtgatgatgaccgctgtggagaatccagcaaaaggaaaaacaggacagttgaagatgacttactgctccaaaaaccatttcagaaagaaaaacatggcacaaggtggcccatacacacgttgcagccagaaattgctggatagggaacgaagcaacgaaatagaacggttacatctcatagctctggctgcttactcaaagacatacaacgtccgtacaactgactatatttatactatggtggcacacaagaagacttcaagcgttgggggacaatgacaggacagattgggatgtaatacgaggaaaatcatatgatcctaaggaaatgaggagacgagatggacctgacttggagaagggacttgattagaaatataggacacatattaagggatatggattgagatctagaaatatgagaaatagttggactaagcggccgatcaacacaacataccttccggccacggccatttcccgcggaactaaactgcatcaaccagctacacgcagccatggtactagcactcagaacaagccctaacatgatcccatgtcctattaccccgcagcaatggaacacggcactctcgtgtcgctctacgctctgtgtatcctactttcaagcaaaagaacaaagaagtccagcaacactacagcactagctaagatacaacccgacacaacggaggaagaccgaaggagcacgggacgagagcaggccgagagagtgaggagccgagcacagaccgaaaggaaaacagcacaatgagaggaagcgatcggaagagcagcagacgaacgagagagggaggagaggacaacacgacggcaggaagacccggaagcagcgagaggcgagagggacacgaagcagaggaggccagacacgcgcagcgaaccggatgaccgagcacagagcgcgaagagacacaaccacgacaggaggggcgacgacacagccgggggaggtaacagaagcggacactacgacgcggaacggaacagaacagagcaagcaggcagcagccgaaggagtgaggaacgacgaagcagacagaaggcagtggtgcactgccagcaccagacgcagcgagtccacgtatgcacgcaagagagacaagagcaggagaagaaacaacgaaagcgtagagagaggacagcgagaacagaaaaaggcacagaagcaaggaagcgaaggaagcaagaagagcacggagggcgcgagaggccaacgggagagagcaacggacaggagcgaacgggagaggggaagagaggacagacagacgacaagggcaccagaaggacgagaaagagagaggagaccgagaagcagagctaagaaagacgacagcggagaggaaccgccagn

SEQ ID NO: 591836 - DNA, 443 bp, Homo sapiens
gatgtatgctaggtcgaatctatgtcttggtattgtgaatagtagcatggtaaatcatacaagtgcaggtatcatttagtagaactatttattttcctttgcgtatatacccagtaatgagattgctgcattgaatgatagttctgctttaagttctttgagaaatctccaaactgctttccccaggggctgagctaatttgcattcccactgacagtgtataagtattcccttttatctccagcctcaccaacgtctgttaatgtcattgtaaaagtagtagttgttttactctttagtaatagccattctgacaattttgagaaggtgtctcattgtgattttgatttgcatttctctgacgattagtgatgctgagcatattttcacatgtttgtcggccactggtacgtcttcttttgagaaggatctgttcatgtcct

SEQ ID NO: 591837 - DNA, 165 bp, Homo sapiens
aggtactttgaggatccgacagcacagaggaggtggacaggacaggcacagaggagtgtggatagtaacagaggaggattatgatgagactgtaatgtgcgttcgtagtttagagtttgctaggcagaatagtaatgaggatgttcgtccgtgggcgacttatga

SEQ ID NO: 591838 - DNA, 624 bp, Homo sapiens
tgcgtaactttaatagtgtaggaagctgaataattatgaaggcagaggggtcaggttgatcgggaggatcctatggtgcggggctatgtatgattatgggcgttgatatagtagtagttactggttgaacattgatagatggaacatattctgctactagaaataatgggaacaggagcctaggaaggctagaagcaaggagccagcaagtctagacacattccagaggacgttacgcaagccctgcctcagtttccctcccaacactcagttctattcccaacaatagtactccacaggaagtggctaaaacatatcaaagaacagcacctaggtaccagttctctatgggttggtacatattatacactgcggtcataaaacaaggtatagccatagatacttcaacctgtgcacctgctaagggccacaccctgcttactgctccctgtgtaggtaaccctagggtctagattctgtctccgttgaggttactatccccaagctcaggctaaacacattctcctgtagcatgtgatggggcaggcagatagatggggggacagagaaggtagtacaccgtgcatgttaatataacatttatgctagaaaaactgtctttcg

SEQ ID NO: 591839 - DNA, 193 bp, Homo sapiens
ttgcaccattgcactccagcctgggcaacaagagtaaaattccgtcacaacaaaacaaaacaaaaaaaaacagcgtggatgcaggtggctcacacctgtaatcccacccactcaagaatctgaggcgagaggattgcttgactctaagattaaaataacaccccgcgccacatagagagaccctatctatatt

SEQ ID NO: 591840 - DNA, 592 bp, Homo sapiens
  misc_feature (8)..(8): n is a, c, g, or t
  misc_feature (62)..(65): n is a, c, g, or t
  misc_feature (68)..(68): n is a, c, g, or t
  misc_feature (84)..(85): n is a, c, g, or t
  misc_feature (92)..(92): n is a, c, g, or t
  misc_feature (147)..(147): n is a, c, g, or t
  misc_feature (160)..(160): n is a, c, g, or t
  misc_feature (167)..(167): n is a, c, g, or t
  misc_feature (174)..(174): n is a, c, g, or t
  misc_feature (178)..(178): n is a, c, g, or t
  misc_feature (184)..(184): n is a, c, g, or t
  misc_feature (195)..(195): n is a, c, g, or t
  misc_feature (204)..(205): n is a, c, g, or t
  misc_feature (213)..(213): n is a, c, g, or t
  misc_feature (217)..(217): n is a, c, g, or t
  misc_feature (220)..(220): n is a, c, g, or t
  misc_feature (222)..(222): n is a, c, g, or t
  misc_feature (230)..(231): n is a, c, g, or t
  misc_feature (233)..(233): n is a, c, g, or t
  misc_feature (238)..(238): n is a, c, g, or t
  misc_feature (240)..(240): n is a, c, g, or t
  misc_feature (245)..(245): n is a, c, g, or t
  misc_feature (250)..(254): n is a, c, g, or t
  misc_feature (256)..(256): n is a, c, g, or t
  misc_feature (262)..(264): n is a, c, g, or t
  misc_feature (277)..(277): n is a, c, g, or t
  misc_feature (280)..(280): n is a, c, g, or t
  misc_feature (285)..(285): n is a, c, g, or t
  misc_feature (295)..(295): n is a, c, g, or t
  misc_feature (299)..(299): n is a, c, g, or t
  misc_feature (307)..(309): n is a, c, g, or t
  misc_feature (312)..(312): n is a, c, g, or t
  misc_feature (314)..(314): n is a, c, g, or t
  misc_feature (332)..(333): n is a, c, g, or t
  misc_feature (347)..(347): n is a, c, g, or t
  misc_feature (353)..(353): n is a, c, g, or t
  misc_feature (373)..(373): n is a, c, g, or t
  misc_feature (391)..(391): n is a, c, g, or t
  misc_feature (396)..(396): n is a, c, g, or t
  misc_feature (404)..(404): n is a, c, g, or t
  misc_feature (408)..(408): n is a, c, g, or t
  misc_feature (413)..(413): n is a, c, g, or t
  misc_feature (421)..(421): n is a, c, g, or t
  misc_feature (431)..(431): n is a, c, g, or t
  misc_feature (436)..(438): n is a, c, g, or t
  misc_feature (451)..(451): n is a, c, g, or t
  misc_feature (461)..(461): n is a, c, g, or t
  misc_feature (468)..(468): n is a, c, g, or t
  misc_feature (478)..(478): n is a, c, g, or t
  misc_feature (482)..(483): n is a, c, g, or t
  misc_feature (490)..(490): n is a, c, g, or t
  misc_feature (494)..(494): n is a, c, g, or t
  misc_feature (527)..(527): n is a, c, g, or t
  misc_feature (529)..(529): n is a, c, g, or t
  misc_feature (539)..(539): n is a, c, g, or t
  misc_feature (583)..(583): n is a, c, g, or t
tttattanaatgttgtagtttttatatgaaaattttgataaattattgttgttttgtttttnnnnggnaatgatagtagagaannggaatantggtccaaaactcttgtctttactcttcttttaaagaaaaaaaaaggggagtganctagggtcactgnaacctcngcctccnaggntaaagnaattaaactgnttaaacatnnagaatagntggnatnanaggaatgnncnatgangncgggntaatnnnnntntttttnnnggggggggggttnggngatgngggggagggnggtntgggggtnnnggngnggggggggggtggggggnngggggggtggaggngggtgngggtgggaaggggggggggnggggggggggggggaggnggggngggggttngggnggggngggggtgnggaatatggnggggnnnggattgggggggnttgggggggntggaganatgggggggngtgnnggagagntgcngtgagcggtggaggagaggggggagggaatagngngagaaaaggnaggggggggggacctggtcgcgtctgagagcaggaaagagagantcccgactt

SEQ ID NO: 591841 - DNA, 650 bp, Homo sapiens
attggtccccgggttcaagaattcgggcccaggccaccaaaagtttagaaaaaaaaaaagccgggaaaaccaagccaggcccattgtcccttttcccaccagaaacaagggcccccaatagcccccaggccggaggggaaaggttcccagcctggatgaatatgccctttaaaagcttggccctttcctccctcggaggtggaggcggaaaaggttccccaaaaaaaaaattttttgccaacaacaaccgccccagccctggggggcacgaaaggaaattggtgcccaagctgcaaaattcaaaaaggaaaaatcgaggggcccggctctaagacaaacctggagatgaggccaggccatggtccttacccccagcaataaagacgggtcttcggagaaaggaggacccaggacaggatccaggcgggctttccacaccccccacccctaggacttattcccgctgactgagtttttgaggggctaccaggaaagcgcctccaaccctagcaaaagtgcaaaatgggaagtaaaagcctgggaatggaggggcaaacccaggaagttcccccagaaaaaaaaacttcaaaaaaaatgggggctcctccagggtggcagctcccataaatagacccgcccggcaacaatta

SEQ ID NO: 591842 - DNA, 213 bp, Homo sapiens
accatctagtcgctgactcttccaaatgtcatcttcccggcctatgtccgttgatataaagattctgggatccagagttgccgcagtccacaattatcgcttcactcaaaattactcatgtattttaatactggcttttatcacactggactgagacgcagagctgtcagaactccctgggtgagactcatcaggagggccgacagagccaga

SEQ ID NO: 591843 - DNA, 224 bp, Homo sapiens
agttatcatctgagtattgtctctaggctgtagaaccaaaaagcagctgtcaccaggagcatatggcaattcttctgcgcttgatatatctgtaattcccttcagcaggcacagtcactttaggctatcacctgcaggtcattagaagaattaagtaaatatctgatttgaggaacctgcgataagagtccttttccataaggagtatatatgactttattgtg

SEQ ID NO: 591844 - DNA, 140 bp, Homo sapiens
acagttgccttgtcagctgtgagtgacaaagctgatactgttgtgtgcagagctcggtacgatggcgcagggcgcttgcctacatgcagaagcaggtggtggccgaggtccagacccgggttcagccagtttgggtcctg

SEQ ID NO: 591845 - DNA, 347 bp, Homo sapiens
ttttttttgagacgcatcttggatctgtctcccaggctggagtgcaatggtgctatctcatctcactgcaacccccacctcctgagcaccagcgattctcatgcctcagcctcccgagtagctgggattacaggtgcccaccaccatgtccggctaattttttgtattttttgtagggatgggattttaccatgttagccaggagttcaaggttacagtaagctatgaccctgctactgcactccagcctgggagacagagtgagaccctgtctcaaaataaaaaacaacaacaagacaaccataaaatgcactaacaaatgtatatatatatacttcatacatagt

SEQ ID NO: 591846 - DNA, 387 bp, Homo sapiens
aatagcgtgtgcaccctggatatgtcctgatccaacatcgagttcgtaacctctatcgttaatatggactctagaataggattgcgctgttctccttagggtaccttgttccgttgctcaagttattgcatcaattgagtatagtagttcacttcgactggtgaagtcttagcatgtaccgctcgaaggttaggttgtgctcggaggtcgctccacccgaaatttttaacacaggtttggtagtttaggccctgtgggtttgttaggtcctgttcgctttaataaattacagctccatagggtcttctcgtctttctgtgtcaggaccgcctcttcgctgtcaggtcaatttcactggttaaaagctcgtgccatattcggcacgcg

SEQ ID NO: 591847 - DNA, 408 bp, Homo sapiens
atcccagccatcaatccaggacatggggtccgtgcccccggtgggaaggagaaggaggaagctggctttgttctgacgttgggctttttttgctccaccagtactttttgtgggggaaataggtaaagaaatggctgttcaaatgagaaaatgtgtcagtaaacttttgctacagtgatgctgcaaaacaaatcactggtgactttcagtggcacccagcaataaacatttatttagctcagggattgccaatcttttttttttttaaagggccaaatagtaaatattttaggtgtttcaggccatacagtttttgaactttgaacttgtagcccaacagtagccttagatgctatgcaaatggaggagcatgactgtgttccaataaaactttatttatggacacta

SEQ ID NO: 591848 - DNA, 325 bp, Homo sapiens
gggcgcgcgccgacgcgctcattccccgcctgcggccgactccctgcacaaagtgggctttgtctgggtcccctgtcccctcgtccccattgacagcggcggagtccccagagagggagcgggcgcggcggggaggcgaaggctgcgagccccgaggcccagcgggtccccactcgggcgcgtctccgcgggaggccggctggcccctggcgccgcgctgccccagccgcgccctcgccgggccgcgggcgcgcgcctcccccggcatggctccggcgtcgcgcggggcgcagggtcggccccctggctccccgggtgcggccgc

SEQ ID NO: 591849 - DNA, 148 bp, Homo sapiens
ttgcttatcgctgttttcgtgaatcttagtgaccacaaaaggaatcactcatctggtgactcatgataaccgcaaccatccgctaccccgatcccctcatcaaggtgaatgataccattcagattgattctccagccccaccaagagt

SEQ ID NO: 591850 - DNA, 414 bp, Homo sapiens
aaagtagccccaatccccccaattttagttcaaaattttatccaaaagcctgccatttttcctgaacgagttaagtagacaacagccctctgtattagtcccatttttatagtgctgacaaagacatctacgagactcgaagaaaattaggtttaatggacatacagtttcacatggctggggaggcctcacaatcatggtggaaggcaaggaggagcaagtcacatcttacatggatggcagctggcaaagtgagaacttgtgcagggaaacactcattttttaaaaccatctgatctcatgagatttattcactatcacgagaacagtgcaggaaagacctgcccccataattcatcacctcccactgggtttctcccatgaaaggtgggaactgtggaaattacaattcga

SEQ ID NO: 591851 - DNA, 164 bp, Homo sapiens
tgtctggatacaggcggtactaaggccaggtatggctggcgtgcattggtagtctcaactacttaggaggctgagcccaggagttccaggctgcagtgagctgtgattgcccctaagaaagccactgcactccagccagggcagcatagtaagaacctatctct

SEQ ID NO: 591852 - DNA, 414 bp, Homo sapiens
gcacctgtagtcccagctactcgggaggctgaggcacaagaattgcttgagcccggaaagcggaggtagcagtgagccgagattgccaccgtgcgctccagcctgggcaacacagcgagactcgcaaaaaaaaaaaaaaaaaaacaataacaacaaaattgctgtgccctctctctgggcctttctccgtatgtttgccatattggcttcttggggctgtcataataaatgaccacaaattgggtgaccaaaaacagtttactctcatagttctgcaggccagagattcatagtcgggcatcagcaaggccatgctccctccagcgcctctcagcaggagtccttccttgcctctgggggctgtcggcatcctcacctgtggctacaccatcccagtctcttcctctgcagcct

SEQ ID NO: 591853 - DNA, 346 bp, Homo sapiens
  misc_feature (44)..(44): n is a, c, g, or t
  misc_feature (73)..(73): n is a, c, g, or t
  misc_feature (81)..(81): n is a, c, g, or t
  misc_feature (86)..(86): n is a, c, g, or t
  misc_feature (98)..(98): n is a, c, g, or t
  misc_feature (102)..(103): n is a, c, g, or t
  misc_feature (119)..(119): n is a, c, g, or t
  misc_feature (185)..(185): n is a, c, g, or t
  misc_feature (202)..(202): n is a, c, g, or t
  misc_feature (219)..(219): n is a, c, g, or t
  misc_feature (223)..(223): n is a, c, g, or t
  misc_feature (256)..(256): n is a, c, g, or t
  misc_feature (265)..(265): n is a, c, g, or t
tgctgagccgtatgaaaaaataataaaaactcttcttaaaaaanagattacacagaaaaaacgcagaggaaanaggggaanaatgnggggaagggagncttnntggagaggcccggganggggctctgagatgactgcaggggctgagctgctggtggaaacctgcccggtccactgtgcatatnctctcactgcaggagcnggctcctccccatcgcnggcnagggcaccgaagctccacgctccctcaaggganccccttcancctgaggcttggtacctgcttctcactaaagtggctttaagaaagaaacaaaaaaaagatccaaagttagagaaggggctg

SEQ ID NO: 591854 - DNA, 413 bp, Homo sapiens
  misc_feature (149)..(149): n is a, c, g, or t
  misc_feature (189)..(189): n is a, c, g, or t
  misc_feature (206)..(207): n is a, c, g, or t
  misc_feature (225)..(226): n is a, c, g, or t
  misc_feature (264)..(264): n is a, c, g, or t
  misc_feature (383)..(383): n is a, c, g, or t
aaggtggacaagatcccggaacttgatcaagaaaccgaagcagcgttggaaaaccgaattaaaaatgaggaacccacagaaccaggtgctgcctcttctgagaacgctgaccgatcccaacaaagatacacctgaaaacgcagatggtnccagtgatgagaacaaggccgactatacaatcccagatgngtatagaattggaccanntcagcccaatgttcctgnnggtatagactatgtgatccctaaaacagggttttactngtaagctgtgttcactcttttatacaaatgaagaagttgcaaagaatactcattgcagcagcctttccttcattatcagaaatttaaagaaattttctggaataaattgggcagaagancgcagacagaagaaggaaacttaagatgtg

SEQ ID NO: 591855 - DNA, 1002 bp, Homo sapiens
gaagccgtgtggggtgcgcctgtagtcggggaagcccagcaaacaggtgtgaggtcttcaggcagaatctctcctccaggaatggctgacggtgcaattacctcatacagattctgtgacgcaacagaagaactcgtactatcttgaggtcagactcttgacaaggacggacatcgctcatatgtggctgacattgatctatcccttccgggccccactgtgacatccccattcccagacctctctcaagccaaggtatgagtgacgactggacaacctaggattacacgcagggagaatgaataggaaagctcccgtaaatgggtgagacttgctccgctgtgcgaatagacgaaacgtcggtgtccctagctctggccatggattaatgcacatgaaggtctggaactcgtccacatgatgaatatgctagttcgaggatagagtccatcatggagtccaagcatctgagtccccagaagattcgacacgattggcaacagtgatttgagcgcggataaggcaaactcgcatgggataaaaacgagtgccgaacgcccgacggggctagatagtgcccgtccaatagcttatggttgcaatgctttgtaccgagcggatgcaaatgttggctaaccctactatcatcgagcaaactgtcgggggcgcattgcgtgatgcgactcaagggcactcacagacggcaaggacattccataggttacactggggaggtattacggggtgggccctctagcttgggcattgcaaacgggatgagtggggaatggcaaggttcttcactagggctacgcccacctaggggggctgtggtgggttgggaagcactcgtagggggccactttgctaactagcatggaggcttgtttgattgccattgtctagtacacggaaacccacaaccctgggaagtagacttgaggtgcacattgccgactacggggttgggacaacaaaaagcgtttcgtaatctgcatggaa

SEQ ID NO: 591856 - DNA, 160 bp, Homo sapiens
caagcaaaagcgataggtcactgtactgagcacccactatgttcgggtgtggttctaggtactttatacttattaacactttgaattttcacaacaaatccatggtgtgggcaccatcatatatttaggttattagttattgctattgaaacttctaaaa

SEQ ID NO: 591857 - DNA, 638 bp, Homo sapiens
ctcagtcatgccagtgcctgctctgtgcctgctgagggccctgacaatggtgacccggcctgtctaaacagcccccatgggcgggccagaactggcacagcatgaggagctgaccctgctcttccatgggaccctgcagctgggccaggccctcaacggtgagtacaggaccacggagggacggctgacataggctcaggaacagcctgggtctctatggccgcacaatagaactcctggggcaggaggtcagacggggccgggatgcagcccaggaacttagggcaagcctgttggagactcagatggacgaggatatgctgcagctgcaggcagaggccacagctgacgtgctatgggatagtggccacgcacagaatgtgctacgggacaacgtgcataggctagaagatcacctgaagagcgactgtctgagcccatgctaccgagcaattgaggacttggctcacgatgacaagcagagccacatactatgggccctcacaggccacgagcagctggagaagcgcgagatcgtggaacaggaggatcggctgcgacagatccaggagagactacacacagcggcgcatccaggctgaatatgcctgcatggaactgatgacctcatgctgcgg

SEQ ID NO: 591858 - DNA, 532 bp, Homo sapiens
  misc_feature (359)..(359): n is a, c, g, or t
gcatagatgataaggatgaatttttaaaaccacttgagtttgatcaccattttcctctttctcagatatccccaaggctcctggcaaaatcatcccaagcagaaacacagacacctcagtggtagtttcgtgggaggagtccaaagatgccaaagagctggtcgggtactacatagaggcgagcgttgctggctctggcaagtgggagccctgtaacaacaaccccgtgaagggctcacgattcacttgtcatggattagtgactggtcagagttatattttccgggtcagagcagtcaatgcagctggacttagtgatattccaggattcagagctattgaagtcaaagctgctattnggggaggagtgtctcagatgtgtgtccgactgagcgatgagcctcgtggactaaccgcctccaggggggcgcgtgcatcaagcctccccgccaaccttccagacagatgcctctgcttggcagccaacctaccaaaccttccacttacccagtagcctcttaaaaccttgggc

SEQ ID NO: 591859 - DNA, 404 bp, Homo sapiens
gcatagatgataaggatgaatttttaaaaccacttgagtttgatcaccattttcctctttctcagatatccccaaggctcctggcaaaatcatcccaagcagaaacacagacacctcagtggtagtttcgtgggaggagtccaaagatgccaaagagctggtcgggtactacatagaggcgagcgttgctggctctggcaagtgggagccctgtaacaacaaccccgtgaagggctcacggtaactcagtcgggtgtgcagggcgggcaatggcctctggagctgccatagacacatacggcacacagacatccaatggaggagatttttttaaaaaattttactttttggctggatgtggtggcttacacctgtaatcctagcactttcggaggctgaggtgg

SEQ ID NO: 591860 - DNA, 101 bp, Homo sapiens
atcccgagtcttcattgctatcattcccgttgatattggaccagtatgcattgataccgagaaactagggcgatagtcttgatcaggctttgctgttagat

SEQ ID NO: 591861 - DNA, 421 bp, Homo sapiens
  misc_feature (224)..(224): n is a, c, g, or t
  misc_feature (295)..(295): n is a, c, g, or t
cccacggttagactcctagactcagatagcttcagactcctggtagaacaggacgcgcagtacacctctgctgttgctcatggtgcgattgtggccgacctgggcaccgcgcaggcccaccagcagcgtgcagctcgcattgtcgaactgaagcgtaattacgggctcaagtgaaccctcacagccacaacggaaaagcatctgctccacccatgtcggtcaanccagaaggaaaagcacaatgtcgcaactagagagatgggtcatcagaaacgctgacggggttctgattacnagtttcaagatcgatacgcaaggcacaactgtgggctgtcgtcttccgggcgcgggcgcgccaataaaaactaaatatggttggaatggtccgttaacttttcgtagcgagtctgaaggcagcctg

SEQ ID NO: 591862 - DNA, 773 bp, Homo sapiens
  misc_feature (201)..(201): n is a, c, g, or t
  misc_feature (508)..(508): n is a, c, g, or t
  misc_feature (568)..(569): n is a, c, g, or t
agcgggccaagacggagcagacagtgggtgagtccgtgagagctgaggcccccctggccggggctcagtcctgctacgcatcgaagggtctgagccagtgacagccatcctctgaggtctagctgctctgctggaatgttgacctactagtttgtgcccgcctgcccatgggccgccctcacgcgttctccagcacgtgantgaggggttgctggacgtactcttctgcgcggaattccaacaggtacatctcattgcgattcatgtctagccgtctgtcagggccatgcaacacgttgtaccctgtacagccacgtaatacctatggaatgacggaggcaatagtgggtgcacgagcgtagagccatcggagacacgaagtcgctttggattcgcaaatctccgcgagctctctaggcgcattcacgaatgactctttggcgtaccctcactctttactagaccccgatatgaatcgaaaagctcctctttcggaaccccatcaccntgaatagccctctccaatttcgctatgtccccccctgctttaaaaaggcagaaacgctgnntcttagggtctatatgtcagtctctggcgctctggggaatttaatcgcttaggtggacctagagaatccttcaggccggagaccatcttcaaaggcctagggagttaactgtgtggccctgggtgggggtgccaggtttggggtgtggcagttttcgaagtcaccagggaggtacttctacgttccgtttccgcccccagggcc

SEQ ID NO: 591863 - DNA, 165 bp, Homo sapiens
cgaaggtcatcgatgtgctttcccaggagtggactgtacagtctcagccctcaatatgaatgaactgtgatcgtgaccgttggccacattccttgtatgatgtcaggatagggtgaatcatgttgtgtcagatattgctcctgagtggctacaggatcctgcctg

SEQ ID NO: 591864 - DNA, 454 bp, Homo sapiens
tgaactagtacggctaggccctccgctgcttcgcaggcggcaagactcgactatcgactggacgcattcactcctattctaaaggtgacatgttgagttgaatattatcagttgctccccggatttctcaccaattgcactggagtaatgccacgtcagttcaaaaaggatttggattcctatcttaaaactcgatcaccagtcctttccttgtccgggctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcgtccgtcgaagttg

SEQ ID NO: 591865 - DNA, 180 bp, Homo sapiens
gccggccagaggtatgcaggcgccccaggcgctccgcaccgcacctccacctagctagcacctaaggagacagttaatgctacagtcagttggttcccctggcgattgagagtcaggagctcttctgtcgccgccaccagttggttaagtacctacggagttggtttctcggcaggcgga

SEQ ID NO: 591866 - DNA, 1063 bp, Homo sapiens
tggtaatcaagccatgtcccatccgcggtgaatccattaccctcttgggtcgtgacggaaagtctcccttgggacgctataccaggttgcacctcaagcctctcgggataaactttcttcagagtcgcctccaggcatgggctttcacccctgtcatacagactaatcgtcacaagggtctccaaaatgtcaacaaagcgtgatcgacgtgaatagttctgagcttcctcgtgcatggtgcgaactaccggctctacaactctactatactcgagcatcttttgtgtgacgacgcaagacatggaggatcactcgatgaccaggagtcctgagaacaagcctaggcaactctaccacgactcctgtctcttacagcaagtgttcaagaaatgcagccaagacactaggttgcgattggtatgcacttgtatgttcccaatgccaagctacagacagtgctcgagtgctatggatggatcagcattggagactacaaagaaggtattgaggcacttgccaggtagagcctagtgaattcgcacctcggtcacctcatagcctggcgcaaattgtagcaaggatcctgtcttctgacaagacaattctcttgttaaataatggacgccaagtagtgcgtgtgagcatgccatggtagttccagcatagctctaggacaactgacgtcaggacggcgttgctcgacgactgatgagcctggaaggctgtgactgagaccatgcatgcccgcatctgcactgccagcctgggacagacaggaacgatgaccccattctcaaaaacaaaataagttctggttgtcaattccaatttgggataaacagagagcttcgaggctcttctgccttctgtctcacggtgatgcattgcacatcttgggatatcttggaataggaaatgaggaaagaaattagggcctcctctgatctctcgctatctgcagggtcctgtccttttctcagagacattcaccatgtacctcgtgttattcctgtcttctctttagtatgatccatcaataactcactgctggaagtattgaact

SEQ ID NO: 591867 - DNA, 461 bp, Homo sapiens
gcgttgggcaatgattttacgacatcacaccgaaaagctcaggtctacaaaagcaaagagataaataaaccgggactacatcgaactatgaagcttctgcactagcaacagcgaaacaagtcgacattacaaagagtcaacctatggactgggaaacaatatttgctaaccacatatgtgacaaaggattaagtattcagaattcatggaaaactcttacaactcattattacaaaaaaataaccaagtaagaaattagcaaagggccaggtgtggtggcttacacctgtaatcccagcactttgggaggctgagacaggaggatcacttgagactagagtttgagaccagcctgggcaacatagtgagacctgtctctataaaaaattcaaaacttagctggccgtggtggcttgtggctgtagtctcagctacttgggaggctgaggcaggtggatcac

SEQ ID NO: 591868 - DNA, 506 bp, Homo sapiens
ctttcatttttaatttctaatgactacatattagtcacactatttaatgtgtgtgtgactgataaaacatgcctaattatgtttagtcattccctttctccgctggctccttttttttatttgttttttttggaggactagggcttctctgcccattttctagtgttgatgttcccaaagttttatccttactctaaatgatctccatttttgagcttatccacacagcggactgaggtttcctggtctttgcccttctgcctaggacattctttcctaggtctccacatgcctgctttcattattttcatgtcttaactcaaaggtgaactttgagttaaggctttttatcccttcatttaaaattgtgtgacctttcctgcgtacccagcttgccttatatttttctctccactgcacttttcttcctgcctctttttttgacgacaggacttaaaaaaaatgcattttttttctccctgtcccccttttcttggtctgtttct

SEQ ID NO: 591869 - DNA, 213 bp, Homo sapiens
tatcagcactaataagcatacttctcaccttctacatgtgtatcttacatgatactcagataactctaggagctcactgttatcctttttttcataatgcaagacacagtggggctgagagggattgagttatccacacaattttccttagctaataaggcggaatttaggcccaggtctacctgagcccgcattcctaatcactatgatgta

SEQ ID NO: 591870 - DNA, 612 bp, Homo sapiens
  misc_feature (214)..(214): n is a, c, g, or t
gcactctgcaagcgctttcctgagaaaggcatgtttagttagcgcgccaagattgtgaagccctaaggtgataagccgtccgagttcaagtccggcatatacgaggctgttctgtagatgcatatgaacttgagccactagggtcaactcacagagctgaatattacggttgctaatgcgactgaagttgctggcggttagtgaggtatcatgngtacgccaattgtaggaactaggtagtttgatgcatagtgaatatatcgctcagaggacaagtctgccatagtcatatccacaaaggcgtacctaagagatactgaaacggtccaagagacttactctgacagctgagcacgattgcattgttgaggacttggactgcccagcgaatttgccgggaggagacagcacgtaagactagatggaaccccgtatcatacagggtcattccgacaaagcacagacgaacgatgctggtacacacggttcaaacgattttctgatgcaactacgacgttcacggcttacgatgcctctggagttcccacttttaacctgttgatcttcatgacgcaactagaagtgtataatcaccggtgcttccacctgatg

SEQ ID NO: 591871 - DNA, 618 bp, Homo sapiens
  misc_feature (4)..(4): n is a, c, g, or t
accntaagttatctggtgttttggagatttgagaatacagcaggtgaagagaattagcttaaattccctcctcccttttgataaatccacagggatcccttcactctgtcaggaaatggtgtggtttccaagcattagcccttcatgatctgtctggtgcatttctgtgctcctgggatcgccaagtgcaggcacggcatcgcatccccaggtgtcatcctgtgacccaggaggggaagatgacacacccaatttaggtaatgctgcacttcttgttataattggttattggaaaatgtgcctttattatcagaacagtggtgtgcgcatttctgattatggagctaacttttggatatctgacttagatactaaaaacatttgggtgttgcagttttgcacttgtagatacaacttaaaagcatgaaactggtgatttaattagatgttttctataaaatgcaccttgttacatttctgtgaaagggtcttaccagcgtggaataactggctcaagggttgagagaaacaaccattttctaaacagttaattgtttaaaggactatacatgtaagtctgcaggcaataaaggctgttgtgaaaagtaaaaaaaaaaa

SEQ ID NO: 591872 - DNA, 812 bp, Homo sapiens
caatcatagctcactgtaacatcaaactcctcagctccagagatcctcttgcctcagcctcccgagtagctaggaatatgggcatgccactacacctggctcatttaaaaatttttttgtagagacggggtcttgctatgttgcccaggctggccttgaactcctggcttcaaaggatcctcctgccttggcctcccaaagtactgggattacacacgagtcactgcacttggccctaaatatagtttatttaaatgcaggtatatatgatttcatttttaataatgattatttttaacaactggctcacaaaattcttgaaaattaaaaattggctcttatgagctggtataagctggctctagcagagccctggacgtattgaaatatatcttagtaagcatgattcagtgtataattgttcatattcagtgcaagcaacaatggcatgtggcttggatgcaaacaaggaaatccaggggaattcctcaagctgacatgtctttttggatatttgttatatgattaagtcttggaattctgcctaagagcaatgctaagcaactaattaataaagttataataatacctagaccaggatgagaaattcaggctttcctctttttgtctgtactcttttctctttaccgctcccttgtttagccttgtattttattttctcccttccttttctctccatttctctcttgttctttgccttccatcctaattttctctatttgtgtttcccttgttctttctctttcttgcttttcccttttgatcctctcctcccgtgtttggtgggcgtt

SEQ ID NO: 591873 - DNA, 556 bp, Homo sapiens
caatcatagctcactgtaacatcaaactcctcagctccagagatcctcttgcctcagcctcccgagtagctaggaatatgggcatgccactacacctggctcatttaaaaatttttttgtagagacggggtcttgctatgttgcccaggctggccttgaactcctggcttcaaaggatcctcctgccttggcctcccaaagtactgggattacacacgagtcactgcacttggccctaaatatagtttatttaaatgcaggtatatatgatttcatttttaataatgattatttttaacaactggctcgtgcctgtattcccagcactttgggaggccgaggcaggtggatcacccgaggtcaggagttcaagaccaacctgggtaacatggtgaaaccccggctctactaaaaatacaaaaattagccgggcatggttgtgcgtgcctgtaatctcagctacttgggaggctgaaacatgagaatcacttgaacctggaaggcgatcacatcgttgccctccagcctgagcggcagagctagactacagctcaac

SEQ ID NO: 591874 - DNA, 945 bp, Homo sapiens
cggcccctgggacccgggcctccatggttttattgccgggtcctcccctggagtcaactttccaccaaagcttggacgacagatacgctgctgaccaagctgctgcgggcaggaccggcttctgcgcgaggctgcacggaggagcatacgaccagcaagcacggaggagaaggacgcaactagaagcacgcctcctggcagttgaccctggcaacagcctgggccaatgccaccagggcaggctggtggctcccggcgagggcctggggctcgccagctgcctcttgcagcgaccgtgctgtgtcacgctgctgagcggccacccttctgtcacttgacctcaggcagcgagagcagggctccgcggacacagtacagcgtggccctggcagcacggacctggcgcacctctaagcagcagcacgctgcgagtaccgtgctgcaccctggcttctccccaggacagagctgtctgctcagcagcagctgctggcactggctggaagacacgctggcaggtctgggtggcccccagaaaccgtccccacacactgagcctgactccccatctcccgtgctccagcgcgaggagtcctcagagagggagagcctgccagagtccttggaaactgacgctccctaggtcccccgagactgactgggcggcggcctcctggaggcgacaacagacctcgcccagacctccactcagcgccctgggaagtcaccgaaggatctaaccggaggcttccagcacctgaacggccacgcacactccccttccccacaagcgtagggaaaccacggggccccgcgtgggcccgggccccgggactgagaggcccacgaggcaacgggaaccggaaagtcgcgcgaaaacagagagcggtgaagagcctccctcgcccaaacccccacggccacacccgggagagatagggccga

SEQ ID NO: 591875 - DNA, 461 bp, Homo sapiens
gcaacctccacccaccggcttcaaccaattctcctgcctcagcctccctagtaactgggattacaggcacctgccaccacacccaatttttgtatttttagtagagacggggtttcaccatcttggccaggccaggctggtcttgatctcctgaccttgtgatccacccacctcagcttccaaactgctgggattacaggcatgagcacggcccccagccagagacagtcttgctttgtcgccaggctggagtgtagtggcgcatcttggctcactgcaacctccaactcctggttcagcagttctcctgcctaagcctccaagtagctggattacaggaacgaccaacatgccagctaattttgtattttagagagaagggttaaccatgtggcagatgtctgattccgacctgtattgcccttggcgccaagtgtgggtacgggtagacctcacgcggc

SEQ ID NO: 591876 - DNA, 305 bp, Homo sapiens
  misc_feature (21)..(21): n is a, c, g, or t
  misc_feature (216)..(216): n is a, c, g, or t
  misc_feature (233)..(233): n is a, c, g, or t
  misc_feature (254)..(254): n is a, c, g, or t
ataggtggaaaaaatattggngagactgttgaagggttagcacggtaccccattaatgtacgttatccacgagagatcagagattcccttgaagcattaagaaatttacctgttgttaccgagtcaggtcagcaaattatcttaagtagcgttgccaatatccagattacagatggccctccaatgctgaagagcgaaaattcccgccctagtggntgggtctatattgatgngcaaggaccgtgacttagctncagttgtacaagatttgaaacataccattgattcgcaagtcaaactttctc

SEQ ID NO: 591877 - DNA, 307 bp, Homo sapiens
ttgcattgtgacctatacaagacctccttctctttgtaaatacccagactcagatattccttgctagtaacacaaacagcttaagacacttcccacccagtagtctctcagacgctcattacggtgatgcttcttacagtgtgtatccactttagctgctatggtccccatgctatattcaagacacacgctggtgcaccttgcttgcctttggatagtcgttccctctgctgtgaacatgcctcctttagtgacctgcatagctcaccaattcacctcctgtaggtctatgctttggtgtcacctt

SEQ ID NO: 591878 - DNA, 142 bp, Homo sapiens
  misc_feature (56)..(56): n is a, c, g, or t
  misc_feature (97)..(97): n is a, c, g, or t
  misc_feature (103)..(103): n is a, c, g, or t
  misc_feature (122)..(122): n is a, c, g, or t
ttactcaggttcttctctcacacagaggaggaggtggaagttgtttcacacgcgtncagccacaggtggaaaagatcttggcttttctcaaggcggnagacangagcctagcaatcgtcggncaagactctcctgagcccag

SEQ ID NO: 591879 - DNA, 820 bp, Homo sapiens
  misc_feature (108)..(108): n is a, c, g, or t
  misc_feature (113)..(113): n is a, c, g, or t
  misc_feature (116)..(116): n is a, c, g, or t
  misc_feature (125)..(126): n is a, c, g, or t
  misc_feature (153)..(153): n is a, c, g, or t
  misc_feature (165)..(165): n is a, c, g, or t
  misc_feature (170)..(170): n is a, c, g, or t
  misc_feature (175)..(175): n is a, c, g, or t
  misc_feature (180)..(181): n is a, c, g, or t
  misc_feature (206)..(207): n is a, c, g, or t
  misc_feature (209)..(209): n is a, c, g, or t
  misc_feature (214)..(215): n is a, c, g, or t
  misc_feature (222)..(222): n is a, c, g, or t
  misc_feature (235)..(236): n is a, c, g, or t
  misc_feature (246)..(246): n is a, c, g, or t
  misc_feature (257)..(259): n is a, c, g, or t
  misc_feature (266)..(266): n is a, c, g, or t
  misc_feature (268)..(268): n is a, c, g, or t
  misc_feature (271)..(271): n is a, c, g, or t
  misc_feature (275)..(275): n is a, c, g, or t
  misc_feature (288)..(288): n is a, c, g, or t
  misc_feature (292)..(292): n is a, c, g, or t
  misc_feature (294)..(295): n is a, c, g, or t
  misc_feature (298)..(298): n is a, c, g, or t
  misc_feature (301)..(302): n is a, c, g, or t
  misc_feature (308)..(308): n is a, c, g, or t
  misc_feature (313)..(313): n is a, c, g, or t
  misc_feature (319)..(319): n is a, c, g, or t
  misc_feature (322)..(322): n is a, c, g, or t
  misc_feature (325)..(325): n is a, c, g, or t
  misc_feature (328)..(329): n is a, c, g, or t
  misc_feature (337)..(338): n is a, c, g, or t
  misc_feature (343)..(344): n is a, c, g, or t
  misc_feature (346)..(347): n is a, c, g, or t
  misc_feature (353)..(353): n is a, c, g, or t
  misc_feature (356)..(357): n is a, c, g, or t
  misc_feature (360)..(360): n is a, c, g, or t
  misc_feature (363)..(364): n is a, c, g, or t
  misc_feature (370)..(370): n is a, c, g, or t
  misc_feature (372)..(372): n is a, c, g, or t
  misc_feature (375)..(375): n is a, c, g, or t
  misc_feature (379)..(380): n is a, c, g, or t
  misc_feature (387)..(387): n is a, c, g, or t
  misc_feature (391)..(391): n is a, c, g, or t
  misc_feature (400)..(401): n is a, c, g, or t
  misc_feature (407)..(407): n is a, c, g, or t
  misc_feature (410)..(410): n is a, c, g, or t
  misc_feature (413)..(414): n is a, c, g, or t
  misc_feature (417)..(417): n is a, c, g, or t
  misc_feature (420)..(420): n is a, c, g, or t
  misc_feature (425)..(425): n is a, c, g, or t
  misc_feature (431)..(432): n is a, c, g, or t
  misc_feature (442)..(442): n is a, c, g, or t
  misc_feature (445)..(445): n is a, c, g, or t
  misc_feature (450)..(450): n is a, c, g, or t
  misc_feature (460)..(462): n is a, c, g, or t
  misc_feature (465)..(465): n is a, c, g, or t
  misc_feature (468)..(469): n is a, c, g, or t
  misc_feature (479)..(480): n is a, c, g, or t
  misc_feature (485)..(485): n is a, c, g, or t
  misc_feature (494)..(494): n is a, c, g, or t
  misc_feature (499)..(500): n is a, c, g, or t
  misc_feature (502)..(502): n is a, c, g, or t
  misc_feature (505)..(505): n is a, c, g, or t
  misc_feature (509)..(509): n is a, c, g, or t
  misc_feature (520)..(520): n is a, c, g, or t
  misc_feature (525)..(525): n is a, c, g, or t
  misc_feature (528)..(529): n is a, c, g, or t
  misc_feature (536)..(536): n is a, c, g, or t
  misc_feature (547)..(547): n is a, c, g, or t
  misc_feature (551)..(552): n is a, c, g, or t
  misc_feature (556)..(557): n is a, c, g, or t
  misc_feature (564)..(564): n is a, c, g, or t
  misc_feature (590)..(591): n is a, c, g, or t
  misc_feature (609)..(609): n is a, c, g, or t
  misc_feature (630)..(631): n is a, c, g, or t
  misc_feature (637)..(637): n is a, c, g, or t
  misc_feature (646)..(647): n is a, c, g, or t
  misc_feature (649)..(650): n is a, c, g, or t
  misc_feature (655)..(655): n is a, c, g, or t
  misc_feature (669)..(669): n is a, c, g, or t
  misc_feature (680)..(680): n is a, c, g, or t
  misc_feature (700)..(701): n is a, c, g, or t
  misc_feature (707)..(707): n is a, c, g, or t
  misc_feature (710)..(710): n is a, c, g, or t
  misc_feature (726)..(726): n is a, c, g, or t
  misc_feature (730)..(730): n is a, c, g, or t
  misc_feature (734)..(734): n is a, c, g, or t
  misc_feature (739)..(739): n is a, c, g, or t
  misc_feature (758)..(758): n is a, c, g, or t
  misc_feature (814)..(814): n is a, c, g, or t
gaccgttccggcggccattgcgaaaacttccccacggctactgcgtccacgtggcggtggcgtggggactccctgaaagcagagcggcagggcgcccggaagtcgtgngtggngtnttcccgggnnaatccatgccgggttggggggtgctgnggcgaggtgggngcccnggtgntgggnngactcggggacggcctgggtgctgnncnggggnnggggaanagaagcacacatnngggtttttgntaggggggttnnnggaaagngnggnacanggggggatggggntctntnngangannatgtgncattnatgtanggngtnggnntgtgatgnngatanngnncaattnggnngtnaanngtgtgntntgnaagnngaaccangggntatacatcnntggganggnggnnggnttngggtnggggtnnttgggtgggnggnggggntgatgggttnnnggnggnnggatggtgannagggngtggtgagnttggnngnggnaggngggtgtggtgngttanaanntaggtgnagaggaaaagngtgnnggannaatgggnagggtgtgtgtgggaggggaaagtgnntgaggttttggtaaaggnagatggatattggaattttanngggaanttggattgnngnngaaanagacagttaaaatntttaatataanagataatggtggaattaaannagggantgntgtttatggtggtgantttngtgnagganagtatgtggatgtgacagncaaaagtattggtaaaggttttgaaggtgtgatgaaaagatggggatttaaagggnaggctg

SEQ ID NO: 591880 - DNA, 1299 bp, Homo sapiens
cccttactaaaaaaagtgtgtattaggaggagagagaggaaaaaaagaggaaagaaggaaaaaaaaaagaattaaaaaaaaaaaaaagaaaaacagaaaatgaccttgatgggaaaaaaaattattttttaaaaaaaagatatactggtggaaggggggagaatcccataactaactggctgaggagggacctggcttgggggagtaggggaaggcccagggagtggggcagggggctgcgttattcactctgggggattcgccatgggacactgtctcaactggcggcaagctggctggcccatgtgtttccctggccccatttcacccccttggggggctggctcaaggggtaggtggggctgtgggtgggtaggagggtttttttttttacccaggggctctgggaagggaccaccaaacgtggtctctggctttggttacctttcccttccggtctttcttccttcggccttttcacaggtccccttccttggcctgtgcgtccctggtccagccagggttttaaccaaccaaagcgcaaacgcggttctttcttcagggactccctgggcccttccaagatggcgcggggagaacatattgtgggtaccatttaggggttccatttaaccaggtatagagagatgggactacactctagccaggggattctgggaagccggggaaaaatccaccgagctcccggctcccagagggacacacgcgggaaagttccccttcccccgggcggaaaatggccacaaccttggttactgagagggggataagggagaggcaacggagtaaacccaattgtgctgagggtaatagaggagatgagcaattattcccataggaccattttagccgctttttattggcaggcggacatggtagagcaatttgggaaccacggacacgcgtgagagacggacaatatgagaaatatttacagcacaaataaccgcgggggggagaaatttctaaaacatgtggtgcgagaaacacggcgcgccctctgcgcaaaacaacaacaagaaaaacaaacacaccacacagacgacccaacgacgacacaacacagacaagagacgacactacagaacgaaccagacccgcaccagaacaacacacaacagaggggcacacgccacacaccgacagcaaccagccaactcaaagccatcgcacacaaaagcggcgcacacgaacaggaactacgagccggtagccccaacacatatagcggaccccatcatgataagacagcaccgcagccaaagagaggcagcaccg

SEQ ID NO: 591881 - DNA, 399 bp, Homo sapiens
tttaacaacccccccccccttttttagggctggggttccctgggccccaaattttaccttaagtaatcccagggggcccttttttccttggaactggggtaagggaaggaaaaaagccaatttttaaaagcccctgaaaaaaagggcgccccttaaaaagaataataagagggtggggtggattttttttaaaaaaaggggtaggaaaaaagaaaggaaaactaattttcccttccctttggccccgcaacaagtcacgcccccaaaaatttaggtttagcttaaatgacaaacggtaaaaccttttgggtaaaatgttttcccctgggggacaagttttttcccagggggcccggaaaaattttcccccaaattcccaaagaaaggcctttaccccca

SEQ ID NO: 591882 - DNA, 319 bp, Homo sapiens
ctgctaactgtgactaagtttccaactggcaatgctgcagttatttattttactttcgagatagagtctcactctgttgcccaggctggagtgcagtggtgtgatcccggctcactgcaaccccgcctcctgggttcaagcgattctcctgcctcagcctcctgaatagctgggattacaggtgcacacccccatgtccggctagtttttgtaattttagtagagatagggcttcaccatgttggccaggctggtctcgaactgctgacctcaggtgatccgcccgcctcggcttcccaaagtgctgggattacagaca

SEQ ID NO: 591883 - DNA, 1019 bp, Homo sapiens
cataagatgatcacataaattctaactgagtgcagcttggagcatgcaatttttcaggcaacatagtgatataattctagtgataaaacattaaactcctaaataaattttttttgccatcatgcttctatagcatacatcatatatctatcagttgtccatctgcattaagtgatccagtctttgcaaaatcactgaagttttgaagccgacataaacatagttttaaacagctgcataacttcaagcattctgtatcggtgctgagtgactaaaatatccaaaaactttaaaacatcacaaatacttacttgctgcttaacacagctggtggttggcccattcttctgcttcagcagattttgcgcatgtcatttgcttaatctcttttttcaacacattttccaaacaccttattctcacggacagggacaaatgcaccagacacattaaataaacaacaaaatgcatttcaaggacaagcttctgacagagtaactcctccctcactcaagggactaagaacaatggtggaccacaacttgctgggagcacaactgggaaacttggggcattcaactgccagatattccgtggccatctcaagcgtcgcatcagttggcactagcagtaccttacacacgtggtgggcacatccgacaggcacttaaggcacaggcacacagcagcaactaccctaaactttccatccacaatccccgaagaactttccctctgcacgcttccacgtcccgctcgtcgcacatctcgccgcacacacggcctagtcctcttcacagaattcagctggccagggtctcctcaacagtgggcattacccttatcacctggcagcacattatgcccacacactggattaccaccgttgccttaccaaaaaacagaccaactggactacaccaccacaaggtggcttatctacgggaatagcaccactcggtcgcccagccaattacaccaacacaatgtcatgggaagcaaacccactctagccagaa

SEQ ID NO: 591884 - DNA, 161 bp, Homo sapiens
gctcatcccctgtgcatacagtggcaactctgtcttccctgcccagtagtggccaggcttcaacactttccctgtccccagggggggggtgtgggggggggcagtatttcatccaggtctcctccccacccccccagcatcaataaagtgtcataaacaga

SEQ ID NO: 591885 - DNA, 1043 bp, Homo sapiens
ggttttcctctttttttttaaacggtagcaggttatagcttaaactccttctgaaacagcatccatttctcaaaaggcctgagcaggaagctccgggaaaaccaagcttgcggagcttgtcagggacgtccacttgggaacgcttggtgtccacttcccaccttgcttgggcccttgcaattgggggtcccttggagcttggccaggctgtggggcgccagagagcacagcacccttattgaccacgctatggagcttctctgtggaacgcgggtgggagactggtctctttgaagccttcaagccacccgaggtctcaggaaggtctcttggggagtgccacattgtcctctcgcggcccttccctatacccgtgacaagttctcaggggccaaagtctctctcagccccgcggtggtgtgtgtgcccccgtactagtgaacgtttcggagagagtctcccagacatctctagcgtgaaaaccccaaagtaaaagtcccccagcgtgtgcgtgacaaagagtctctgtgcacgagagaaaagtctcagcggggcgctgtgacccgccagagacatataagttataaggtcggtgtaaaaataaagcgtttctccacgcgtttttcacccgccgtgttgtccccgcggatgtggaagaaccacgctttttacaagcgctgtatctgtgggcggagatatatatccccccgcaaaggagctttctccacaacaaggagcacaaacacacagcttctctctaccagacacagcacgcgcgcctcttctttcacaggtgttgtggtctcccacacgaggaggccacacacggttgtccccaccaggtgggccgccgataacaagaggttgggccgttgcccacagggtaattaacccccccacaaaaaagggcggcctcttgagtgtgtatatatgatgacgaagatagaaaggcggggtgttggtatacacccacgggcgaagggggtattaagtattaccgaaggcccccatggttgaggtgatacaattcactttccccggcg

SEQ ID NO: 591886 - DNA, 165 bp, Homo sapiens
  misc_feature (55)..(55): n is a, c, g, or t
  misc_feature (57)..(57): n is a, c, g, or t
  misc_feature (60)..(60): n is a, c, g, or t
caactacagcacctattccaaggcttctaacatgatgatactatttcctcgtatnancancattccaatattgttctgttgtccactagtcgccatctccacacattcatctatcacaatgttcataaagggatcaaatccccgcaatattccttggaatagctg

SEQ ID NO: 591887 - DNA, 172 bp, Homo sapiens
cggctccggagtatatagcgagcaaatatctgggaaggtagtcctcaatctccgatttcccagcaaggactttctcagcgaacagatctagcttgttgaggaacaggatcacagagatagtgcgccgccatctgtatgttccagatgctctatgaagaggttcagagcctcc

SEQ ID NO: 591888 - DNA, 259 bp, Homo sapiens
  misc_feature (28)..(28): n is a, c, g, or t
  misc_feature (40)..(40): n is a, c, g, or t
  misc_feature (47)..(47): n is a, c, g, or t
  misc_feature (49)..(49): n is a, c, g, or t
  misc_feature (51)..(51): n is a, c, g, or t
  misc_feature (57)..(57): n is a, c, g, or t
  misc_feature (65)..(65): n is a, c, g, or t
  misc_feature (67)..(67): n is a, c, g, or t
  misc_feature (96)..(96): n is a, c, g, or t
  misc_feature (121)..(121): n is a, c, g, or t
  misc_feature (158)..(158): n is a, c, g, or t
  misc_feature (195)..(195): n is a, c, g, or t
  misc_feature (213)..(213): n is a, c, g, or t
  misc_feature (244)..(244): n is a, c, g, or t
gagctgaccatctttacctggtcctggnactcaaaaactntagcttntntnaaaatnagcctttngnccagtctttattaaaacaaacaaacatgngtagtctgcatatcgaatatctagngctctaaaccccccaatacttaaaagtctaattgctntcctgtggtttcattagtctgataggaagatagggcnttcctcagtcacagatgnctatttttgaaggaaagctgcaataaagccncaatgatttggggtc

SEQ ID NO: 591889 - DNA, 916 bp, Homo sapiens
  misc_feature (904)..(904): n is a, c, g, or t
gacctttgtggtgattccacgactgctgcagcctgtctctgtccaggtacagtgagggagcccaaagccaagcaatgggcaacgtgaaagtcactagtgtggttcggtgtggcaatcacacttgaaatcagccacccagaccgtctttatatttagattctggtgtcctcgaaactatcagatatgtattgagccactacttgtcgagagccgcgaggtgctttgggcgagacacctgatgcgtaccctgacgaacagtggctgagctcacaggggtgtccgatattggccatctgaagcacggttaagtccaacaattggacatgctgtccttgattcatgcaaacatcagccatgaccagagtgaccggggagaagcgggtggaggtcgtccagaatgacggccctttgatggacccctcaccatggcaatgggcagttcaccgagaagcgtgtgtattctcaacagaaatgtgctagttggggctagagctgttgtccccaaaatattttatgtgacagagaaggttggaactaattatccctacacaattaacagaatacacatgttccctttctggcgaaatttctccattcatatagaaaccaaagtattggcgacaaacaaagggaaagcaatggcccatttttccggccaattgaagccaaaggacgtgcgacgagaaagttggcttaattgagaaattggctgggatgaaaattccggaggggctatacaaagaatctgggggtcctaaggccttcagttccagaaacaggccggcactcttaggaaggtcgggagaatgttacagccataagtgtccccacaacgggcagtgaattgggggcggggtcaccccctggcgcctgtcccggcccaaccgggtggcaacacgtcggntaggtatacccc

SEQ ID NO: 591890 - DNA, 413 bp, Homo sapiens
ttttttggttgttgttgtttggattggtttgtttgtttttttgaggcagggtctcactctgtcacccaggctggagtgcagtggtgagatcttggctcactgcaacctccacctactgggttcaagcgattttcctgccttggcccctcaagtagctgggactacagatgtacgccaccactccaggctattttttgtatttttagtagagatagggtttcaccatattgcccaggctggtcttgaactcctggactcaagtgatccgccagcctcggcctcccaaagtgccgggattgcaggcaggagccactgcaattaggttttggctttgttacttagttccatgttacatcttggttgtgtaatcactcaagtatatgtaccgcagacgagcaggtggcccccaaaaa

SEQ ID NO: 591891 - DNA, 526 bp, Homo sapiens
accatgaatgtattgtatgggctggtggctgcatgcagccacgaatgctggtttacagtttgatgaggagctggaggacattgccagtgtctgtccgtgtgggccaggacagtgagatgtggtgggccaaggctggcaaggccagaaacactatcacagggttccagacagcatacaaacccagtgtgtatggaccacaaggggaacggggcagaatcggccactgaaggagtcacattcctgtcacccccatcctcggaacggtatcgtataccttacgcgaagcaacccccagagtcagtcgatactctaaaggtgacacacccagagggccacacagaaaacagcaagcctgaccgttcactcaggcaagggcaccacggcagtcactggcatgcgccaaagcggcgggaaccacccggtggcaagacaatcactgcacggcgaaacgagacgcagcaccatgcatccctacggtcaccgacgggagcaaacggctggcgccgatacacccacggacccccaa

SEQ ID NO: 591892 - DNA, 685 bp, Homo sapiens
cagtatagagttaggtctcaagatacgggtatatgcctgggaggtcatcgagtcttacattagttggagggtcgaagtcccaagggctcatccatgcttcgtacgagactagttatgcgttaggcaagtaagatgtgttcacgcctacacagtacttggcatgtaatagacacctggtcagcagttggtacatgaaggaatagagtcctcggatgtataactcccgtgccagtggactcaaaattgcatgcaggtgcacaatgcattttttggacacagagggcttttaattaattactttgtttttaacttgtaagagcaatttatgatgataaaagtccaagcaccgtgcactagtatatgctgccatagggctatctggaataatcagctttcgaatattgaggcacttaagagacaaataactaccctgtttccttggacagtggaatgaaatgggtagaaacaaggcaggccttcttagtgaagacgtctgctcaataaaaagccttcgtattttatgtgaattgataatcatttgcatttgcctgttccgaatgctcaagtgacaaagtgaaagctagttgtctacactccagctcgtctcagtgtggccttagtcctttgtaaatgtggtttctctctccagtattgatgagctattagagttttcgaccgcatctta

SEQ ID NO: 591893 - DNA, 498 bp, Homo sapiens
  misc_feature (112)..(112): n is a, c, g, or t
  misc_feature (115)..(115): n is a, c, g, or t
  misc_feature (279)..(279): n is a, c, g, or t
  misc_feature (324)..(324): n is a, c, g, or t
caggggtgagaagaaggagaaaaggaggggaaggggaaggaacaaagaaaggaaaaggaaagggggacgaaggggaaagaccaaagaaaaaagagaaagaagggaggggcanacnaaaaaaaaagagggggggggagagcacggcacaaaaaacaaaagaaaaggggcggcccaaaaaaaagaagaaaacccccaaaaacggggaaatgggaggcggacggtgcccaaggggggccaaggggcggggacaccaaagaagggcgccacccctccaaagcngcctgggagccagggtgagagtctgggtccaggcctggccatggngccctccagtggaggagagggccctgcctgctgcatcttttctggggccccaaccaccgccagcttcccccccctcccctatcccattctccctaacaaggcaggggtcatagatcctaagccataaaataaattttattccaaaataacaaaataaataatctcctggcccca

SEQ ID NO: 591894 - DNA, 799 bp, Homo sapiens
  misc_feature (2)..(2): n is a, c, g, or t
  misc_feature (86)..(86): n is a, c, g, or t
  misc_feature (114)..(114): n is a, c, g, or t
  misc_feature (120)..(120): n is a, c, g, or t
  misc_feature (145)..(145): n is a, c, g, or t
  misc_feature (154)..(154): n is a, c, g, or t
  misc_feature (189)..(189): n is a, c, g, or t
  misc_feature (212)..(212): n is a, c, g, or t
  misc_feature (217)..(217): n is a, c, g, or t
  misc_feature (223)..(223): n is a, c, g, or t
  misc_feature (263)..(263): n is a, c, g, or t
  misc_feature (267)..(267): n is a, c, g, or t
  misc_feature (305)..(305): n is a, c, g, or t
  misc_feature (322)..(322): n is a, c, g, or t
  misc_feature (352)..(352): n is a, c, g, or t
  misc_feature (399)..(399): n is a, c, g, or t
  misc_feature (433)..(433): n is a, c, g, or t
  misc_feature (436)..(436): n is a, c, g, or t
  misc_feature (452)..(452): n is a, c, g, or t
  misc_feature (479)..(479): n is a, c, g, or t
  misc_feature (490)..(490): n is a, c, g, or t
  misc_feature (518)..(518): n is a, c, g, or t
  misc_feature (529)..(529): n is a, c, g, or t
  misc_feature (544)..(544): n is a, c, g, or t
  misc_feature (548)..(548): n is a, c, g, or t
  misc_feature (550)..(551): n is a, c, g, or t
  misc_feature (685)..(685): n is a, c, g, or t
  misc_feature (734)..(734): n is a, c, g, or t
  misc_feature (796)..(796): n is a, c, g, or t
tnacatttctcacatccattccagaggaaaatcttacatatgagggctcagctgaatgtgatggactgagttcagtaaaacttttnaaatagtaaatagcaatgaacgtattcncaaacngtgccaagtagtgagaaaggcaacnataaaatcnataaggataacacgtggcaggattagaactgtgcngtgaaacattaagaaccacatcnctgtnttagangtgacctcagtgcacctctttcactggtaaggcaacggcntgcngtgggtgccacaatgattaccaagtgtcttcggaagtnaaagacactggtgtgancaagactcaagtgagtgttctttcccaatnttgtgcttttgaagcagaaggaaatacctggggctttgagatatatnaggaggcaaagatgaaagacagcggtgataatcntcnaaatcacaagggcaangaatgattcattttctttgaaaatatncagtctttganatagttcattttgaaaataacaaggctncggaataattnctcaaaaccagcctnccantnnagtacacgagtcgataaacatagcacatgagagaggtatttagcaatttcttctaccaactacactttgccctcactaagggttagagtatgatttgaaacaatttctacatataaagcatctttaaataagtnttgtgttcactgaactgagacttctttcacttatgtacctatggaagtnaatctgagcatacacatatatacatacttgcatacatatgtgtacatatgtttttttaagtnagt

SEQ ID NO: 591895 - DNA, 1041 bp, Homo sapiens
agcgggctgcctcctgccaggcggggccgggccggtgccgagccccgggcgctgctggcgacgcctggatcctgcctccgcctagtgccggctgcctggtgccccgaggaggctgcatgagccccaggccatgggtcccctctcgcaggacgtggaacctgggagccacgccctcgcgtgtcgtggggccctgtggagagtgggccgggctcccgagatgcccagatgccggggatggctcgccccgtcgcccagcactcctagccatgaccgtgcctgaccgccctttcccagcacaccaggcccggggcaggttgaggaacatgcggcgtggaacagatatccccagtctgcagggttgacgagtggaactccgagctggccagcttgaagttgccaaacgttcgccccaggccctctaagcttcaagttgcccgaaggcctcttttagggagttgggagcgttgcggcttgtgacctcctgcgaaggcccccccatcgggggctacttactcgtagaaccacttgaccagggttagaaagcacctgacaggcgaacgaacggactcatactttaagggacccagtggccccaagggacattgtgaacgtcgccgagctgcagaagtcttgcacgcttgcgcgagtgggcgaccgcgaccttggcaccgaaaggtcgacccgtgtggaacccttggcttgcagttggaggttgggcagcaactgggccgccgaccttgaggagcccgacaggacgacttgccggccgccttggttgaagagccgcggaacaccttgcaatagaacccattgcgggccaccagaagtgccccgagcaatggttcccgatgggccccatttggtttggtgcacgcacccacgcccacggggaacgaaagcggcccaggtttcccggttgacggaagccttttccccagggccttgccatacttggagagtggggggagaacaggccaaaaaggggcgttgcgttgtccagagacctgaaacccttagtaggtgttccacgtgtaacaggac

SEQ ID NO: 591896 - DNA, 490 bp, Homo sapiens
ctgattctccaagctccagcaagctcacaaatagaccaaagcagctttttaattcttcattctatcatatcactgcatatggttgtcttctttgcactcataaccatatcaaataataattaataagtttacttgtttaacgtgtataactatcccttaggaaggcaggagtacagagataagagagacactagtatactcatatgtctagaaacagtgccttctacatagcaaacactcaataagcatttgtaaaacaaatcaacaaaacaaaaaagcaagctttaagatatacataaaacaagtaagggaaagaaatggatggtctaccaaacaaggcaagaaacattctactgttagtatatgcaactagacaggctgcactggtgttatagggatctgttatctataagcatcaaaagtgtactactcaacagttcacagtcaagtagaatggtttcacatgctatatagctagcccacggtatga

SEQ ID NO: 591897 - DNA, 519 bp, Homo sapiens
  misc_feature (121)..(121): n is a, c, g, or t
  misc_feature (124)..(124): n is a, c, g, or t
  misc_feature (367)..(367): n is a, c, g, or t
  misc_feature (391)..(391): n is a, c, g, or t
  misc_feature (404)..(404): n is a, c, g, or t
  misc_feature (489)..(490): n is a, c, g, or t
  misc_feature (493)..(493): n is a, c, g, or t
  misc_feature (507)..(507): n is a, c, g, or t
tgggcattagaaagccttccccagcaaggtgccttgtcaagatccaaggggcagaaacttaccagtctccaagtgggtcctaaggtgtgcttgatgattttgaggagggccaaaaggcatntgntccccaccagtcaaaatcaccctcctttttgcattagtggagacaaggacccttgtgggtttcaacaggcccttcctgatgatcattgtccctacagacacccagaacattttttttatgagcaaagtcccccattcccagcaagcctaaagcttgccctccaacaggggggctttcagtaaggaacttggaatgcaaactggatgcctgggtctttgggcccaacctggcccctgtgccccnagtggccatggcatgtgtggcccngtttgcttatccntggaaggtgacaacgattccctgtgtagctttcccatgcccaggggcccatggacttttcagtttggagggtcctgggcctcctnncancaataaataatttngttggccccgta

SEQ ID NO: 591898 - DNA, 386 bp, Homo sapiens
  misc_feature (35)..(35): n is a, c, g, or t
cgtgtgactcacacctgtaatcccagcactttggnagacaaggctggaggatcacttaagcccaggagttggcaagaccagcctgggaatacagcgagacccccagctctgcaaaaaaaataacaaaattagccaggcatgattgttcatgccgggtggtcccagctactcaggaggctgaggagggaggacagcatgggcccaaggagtttgtggttatactgcactccagcctgggaaaagagcaagaccctctctctttaaaaaaaacagaatagaacaaaacagaaccgggcgcagtgggtcacacctgtgatcccagcacttagggaggccaaggaaggcagatcacgagatcaggagttcaagaccagccagaccaacat

SEQ ID NO: 591899 - DNA, 293 bp, Homo sapiens
tctggtgcccacactgtccttttccttccacttgggggtggggaaatcctttctgctaggtcagggcatttctctacaaagtggcctgaatgaggcctggccctgataaggagccaccatctggaggaaaggggctccaagccttgtttttaacacccctgctaaacccccacccttccaatatgtttacattaggtgagaatttaaagttcaaatactattaatggactatttgtaattgcttgttccttacgcctatgcagttttcaaaaactttcgacacctgttttatg

SEQ ID NO: 591900 - DNA, 1133 bp, Homo sapiens
tcttaaactcacgttcttaccttgataagcatcagggtgctcacatttaccttatatctcacgtgcttcaggtggtcacaaacctcggaaggtcttctaggaaaaaccatctcatctaggttacaaaaggaaaaggaaaagttgtggagggtggaaaaaaaacccttgatccgggaactaattctcagaagccaccaactttcattccacctttcgaggctctcgaggtgttcacgtgggttaaccactgtgaccaagtgtgtcgttctcgtgcttgtggagaacgagaatatttagaactatttttgtgtggcaatgtgggaatctctttctacaactctgtgaagattctctttattcacagtgggcgcgggtctcaggggtctcgagatactcgcgtgtgtgtgtgagtatagtgtgtgtatacacatttgtgtgtatgtgataacctcttatagacaaagagttttattataaagagtgtgcccacagagaaagagcgtgtctaaaacaacaaaatacaacaaaaacagagagggcgcgcgcgcgcgcgctctctaaaagagatatatctcccccggcgagaggggggcgcccacagagagctttacgcgccgtatcaccacgaggtattcacggtgttacccaaagggaggggggcccccaaagagagaggagagatgcgcgctatataaaataacagagctctgagagcccgttgggcgcgcgcgcgccgatatttcaaacaaacgcggagtgccgagaaccgcggggaacaaaccgcggggcatcaacacctggggggaaccacctgtgtaggggcaagagggggaccccccctaaaactatccggaggggggggggcaccccacattaatgtggggggcgcaaaagagtgtagcccctataaaaggaataatttttttaaaagaagggtcccaaaaggggtgaacaaaattatttagaaaatttgtaaaaaggcgggggtaataaaggtgggtgtgtttacaactatattgtggcaaatattaatgttattggggacgttataaaacaaattggagggtaacacgggaataatgaatatatttgagaaacaaatattattcaatgaggggagaagtatagataaa

SEQ ID NO: 591901 - DNA, 103 bp, Homo sapiens
gagatcagagctggccaagcagtgtatgcaaccccatctctactaaaaatacaaaaattagacgcacacctgataatcccagactacttggtgaggctgaggc

SEQ ID NO: 591902 - DNA, 85 bp, Homo sapiens
gacagcagcttctacatctgcagtgctagaacagggacagcatcctacgagcagtacttcgggccgggcaccaggctcacggtca

SEQ ID NO: 591903 - DNA, 178 bp, Homo sapiens
cattgtactctgccgtgtggctgtcctgggcagcgattctgtgccagtgagaacaacaagcccaaagacaggtctggatgaagcctcctccagacgcctccactgaccccctcccaggctgcccagtgcccttgacctccacctacatcggctccttctcccaggcaccgggcagcgg

SEQ ID NO: 591904 - DNA, 186 bp, Homo sapiens
  misc_feature (72)..(72): n is a, c, g, or t
  misc_feature (83)..(83): n is a, c, g, or t
  misc_feature (155)..(155): n is a, c, g, or t
tcgaattcaagcttctaacgatgtacggggacatgtggagtggaggaagatgctgcccctgtggttgtgaancatcctggggntgacccccagacccaagcctcgctgggctgtctccgctgtccctcatctcttcacttctggacccaaggctngacatcctaataaaataactgttggattaga

SEQ ID NO: 591905 - DNA, 366 bp, Homo sapiens
gggttttgctatattagccaggctggtcttgaactcctgacctcaagtgatcctacacctgagcctcccaaagtgtagggattacaggtgtgagccacagccgctggccttaaaaaatccttttattagagacagagtctcactgtgttgccaaggctggtctcaaactactggcctgaagtgattatcctgtctcagcctccggagttgatgggattacagacataagccacaacacccagcctgctgttactgttaaatacattctttcccttattatcctagaagatgaacccagaatattgtccatggtcttgtatatgctgttggactacttgtgtagctcaatttatgtgcaattcgctt

SEQ ID NO: 591906 - DNA, 180 bp, Homo sapiens
  misc_feature (53)..(53): n is a, c, g, or t
caggtgtaacatacagggaatatgcctgcttcaaaaagaagctagcgaaggcnatgcacagtcttgggaagagaaatacatttcattttggccgctcaacaaatgatcccacaatagctcttggaggtctcccatctcacacaaacctattcctcattccctgcctgaaccagggagggt

SEQ ID NO: 591907 - DNA, 383 bp, Homo sapiens
  misc_feature (43)..(43): n is a, c, g, or t
tgtgacggcagctaagtgagctgtattgcaccactgcactccnagcctgggcaagaaagcaagatcctgcctcaaaaaaaaaaaaaatccaatttatcagcagtttcaaacactttgatttccaaactttatcccactgagaacagctcaaacagccaataccaattctaaaatcttctccaggaaagttgagggttaaacccccgtgagctttcctcctgaagagccctgtgttgtttaggctccttacaagttttgtgccggctgctgcagtttgctgcttgatggctccattttgcaactttctccgttctcaaaggaccaacggggaagcacccacggattcattaagggaacgtgtgtcccatttccacaagggcttg

SEQ ID NO: 591908 - DNA, 567 bp, Homo sapiens
gcagcgggtcaacgctgctgctgtaggtccagcacgccagtaagcagatcgttcgccgaacaagcagtacaagggcaatcagtggactgacattgtccgcactccccaatggagcagggctgtgctgtccttactggacgtgtgtgcaatcttgccaatcgtcattcgcatacttccccactcaagcacctcgacattactgccattcaaggactaagtacatagcacgatcttcctagtgggcgcgccgtgagaccaaggcatcatcgcaagttacttgagaggtactatatgccgagtacacacacttgcgccttccgggccggttgtcgacgcctgtgacgcgaccctccctctcatgcctatcagtgtaccccctgacttggattttctgcccaagaagacccggcccatggaccacacgggacccgtgcggcacaaccgctcccgcgacaaccagaagaccgccgaagtatccgcgaagagcccctgcgcggcagcaaccatggcccatgcgcttggaaacgaatccaaccacaaggtaccacgagccgggccaattccctg

SEQ ID NO: 591909 - DNA, 476 bp, Homo sapiens
ctgcaggattcggcacgaggaaacttgcgagacttcctgttggtctacaatcggatgacagaactgtgtttccagcgctgtgtgcccagcctgcaccaccgagctctggacgctgaggaggaggcctgcctgcacagctgtgctgggaaactcatccattctaaccaccgcctcatggccgcttacgtgcacctcatgcccgccctggtccagcgccgcatcgcggactacgaggctgcctcggccgcgccagctgtcaaaaagaattgctgtgaacctaggggaagaaggtaaaaccaaacaacaaaagcaggaagaaaactctacccccttaggctttagccactgcttcctaggaggtcagtgacaacagaacaaagacaagcctctaagaattcaggaatgttgaccatttccccaatttactctcttagtacttcctgcctttgtgaaattagcaataaagactttaaaca

SEQ ID NO: 591910 - DNA, 544 bp, Homo sapiens
ctgcaggattcggcacgaggaaacttgcgagacttcctgttggtctacaatcggatgacagaactgtgtttccagcgctgtgtgcccagcctgcaccaccgagctctggacgctgaggaggaggcctgcctgcacagctgtgctgggaaactcatccattctaaccaccgcctcatggccgcttacgtgcacctcatgcccgccctggtccagcgccgcatcgcggactacgaggctgcctcggccgcgccaggtattcctgcagaacagaccagagactcgccatcaggcagctagccgtccctggcccctggagagaagctgtcaaaaagaattgctgtgaacctaggggaagaaggtaaaaccaaacaacaaaagcaggaagaaaactctacccccttaggctttagccactgcttcctaggaggtcagtgacaacagaacaaagacaagcctctaagaattcaggaatgttgaccatttccccaatttactctcttagtacttcctgcctttgtgaaattagcaataaagactttaaaca

SEQ ID NO: 591911 - DNA, 151 bp, Homo sapiens
ttaagctctggcctcagagctcctccttctcctggctagttacactaggtaccaggttctagggcctgagagagcctctagagatccagggaactgtgagcccaggagttgccatctatggtatcattcctcccatggctctgctccctat

SEQ ID NO: 591912 - DNA, 306 bp, Homo sapiens
acaggatcttctgtgaccgagacgacctcccaaagtgctgtgattacacacgtgagcactacaccaggccggaagactggatttttgttaacagatgacagttacagaataagagtttatacttagtatctgaagttgaggttcatttctgcatactgtcccttttccactgactaccatgaaataagtagttgcttaattttataaaattactttcccctgcccaagcaacagtaaaagccaaaacaaaaaacaaagaatcatgtcaagcagaacttatgtaacagttcccaaagaaaacaaaga

SEQ ID NO: 591913 - DNA, 1075 bp, Homo sapiens
tgagatttgaacccccgttgatccttcaccagagcccatgctcaaccactgtagtgttctgatgcccctgctattgaccaaaaggatgtttcgtcccattatccttgcaggccaatgagtacaaaactggactcttagggtcagtgcgtgcgcgtgttgctttgtaggtcggagagagaggcatgagtgttgcgttggatggttggcgtgcttgtaccttggatctgtgcgcgatggatccacgtctcttgagcgccctgatgtgatgctagatgctctacctcctctgaagaattggctaatgttaatggcgtggccattgtgtattgcgattgtccaggcacgcaattcgtatgcataatactctgtgaagtgctgcctgatgaactgattgtaaatcactagacagtctctaaatcttccttgtgtaggattactgggctcctgaatattttagcagattgacttactgttcttgtattcctgatgcactatacttctacttgaataaacgatacacttgccctacgagacagactgtcgtatcatcgttatcttttacatactgtgcagtccctcattatttgctaagcgtaatcctattacaactcatatttctccgaccttccatattactcaaacaaaccccctagggagatgcacctcccataacggatcccgatcaggcgttccaaccttactacgtacatcagtatcttctccgttttgttcccttccttggtctccttaatgaaggttaagcactagttctgaccaggacctcttaatggactcggaaattgtaccctatggcaacccttggaagccctccccattggggcgggagatattgccaatcgtctcacaagttttgagccgtccggacaaattagaagcgttccttgctttgtggttaccacccgactttgtagccacgctgtttcaatagtttaattaagggtgtaaatattatatgggccccttactattgggagaaagctctccttgagggccgcttaaccaaaaccttgaactgtgaaaaaaaaaggtcgcgcgctccttttgttccattctt

SEQ ID NO: 591914 - DNA, 120 bp, Homo sapiens
gctcggtccctactcggctatgcgaagagaagcgcttataggagaagtagtacgggggagggggtcgcttagcgcgtggacacagcacaaaacacaacacgggcagccgcgtagtcagat

SEQ ID NO: 591915 - DNA, 369 bp, Homo sapiens
  misc_feature (58)..(58): n is a, c, g, or t
  misc_feature (67)..(67): n is a, c, g, or t
  misc_feature (259)..(259): n is a, c, g, or t
caggacctctccatgagggtccagtgaggagcctgtcacagagcctcgcccaggtggnatgcatggnggagtgactgggccctgacaaaggggaagtctgtgtgaggtagacccctggatgatccggcactgaggttcagtgacaggcagaaaaatggcggccgcatcataggtgtttcaatgggggattcacagcagagccatctccaaggccccacacaagctttcctggagacaaatgccagcttcagacggtccngccaagtcctgagtgcacaacgtcctattatatctggtcctattatataacccaaagactatgactattttttcctaagtcccccttcataggccaactctggggaggac

SEQ ID NO: 591916 - DNA, 190 bp, Homo sapiens
ccagacggttaatatctagaagataccatacatcaactagtggtttaaacactttgaagaaaaaacactggaacaggtagtgtacatggaccagtttctcttatacaagagtgctaaaacatgaaaaacacccaaaaccagcatagagcgttaccatcaaggtatgaactctagctaatacaacataaaa

SEQ ID NO: 591917 - DNA, 340 bp, Homo sapiens
  misc_feature (47)..(47): n is a, c, g, or t
gtaccctgcctcgatgtcctgctgcaagctgtccagagatacgccgntggtgcggatgtcgctcaccagcgcgtgaatctgcgcgatgctgccatccacgacttttttcgcggcctggccttcggcgtcagtctgctgcgccgcaaccgccgcgccttgggcactgcgggctacttcatgggccgcggaggacatttcgttgatcgcagtagccacctggtccgtctcgtgacgctggcgttccatggctttttccgagcgattggcttgctcgccgacctcgacatgcagcgcatctggcacccgctgctggtgcgctttggcgccaacaccctcaaga

SEQ ID NO: 591918 - DNA, 215 bp, Homo sapiens
ggagtttgagaccagcctgggctaccatagcaagacccccatccctttcaaacatatgtttttaatacttagcctaaatatggctggccggctaataccagtctactcaggtaggctgaggcttgttataatcgactttagcccagggacttggatggttacagctgagctactgattgctgtcactgtcactctcatcctaggtccatagagcc

SEQ ID NO: 591919 - DNA, 132 bp, Homo sapiens
tacatatacgaactcgagcttgtaccctgtgacttggggcacatcctggtaggcagaaggagccttacttggggaagtgagtgaggatgagggtctcttctcgggcaccaatttgtccttctccactcggaa

SEQ ID NO: 591920 - DNA, 318 bp, Homo sapiens
  misc_feature (286)..(286): n is a, c, g, or t
  misc_feature (294)..(294): n is a, c, g, or t
gagctactcacctacatgatggaagataccgtaacatcactccatgcatccatctactgttcatggccaagaatttggagcgaatcggcgaccacgcgaccaatatcgcggaaaacgtcttgtttcttctcaatggtgaacaaatgctcccaccacgggaaaagtgcgataacaccagcaacgtaaacctagattgaattttagattaaagaatgagctatcaactagagttttaaagcgttatttcgcaccatcctcgtttcataacctcgaaagagcttgtganaaaaagcncgaacttgaatgaattaccttcca

SEQ ID NO: 591921 - DNA, 171 bp, Homo sapiens
  misc_feature (35)..(35): n is a, c, g, or t
atacgcaattcctgctcaccgagatatacatgcangtgtcatgtgatgcttctagaaagatcttaaagttcggagaagcctattttttgccttcctcctcactgctgcagcaaatacgtacgtgacagcttgaaaggatgatctaaccaacatatatggaactttgcactc

SEQ ID NO: 591922 - DNA, 335 bp, Homo sapiens
  misc_feature (6)..(6): n is a, c, g, or t
  misc_feature (29)..(29): n is a, c, g, or t
agatantaacactgaaaaaaatgtatccngtcccctaaaataagttatcaaatcgtgtatttgtaccccattaatcaacttctccctcattctttccctcctctcaaacagtcctaccttctgttttcatgagatcccatttttttcagctctcacatgtgagtgagaacatgtgatatttgtctttctgtgcttggcttatttttcttaccacagtgaccttcagttccatccatgttgctgcaaatgacaaaatttcagtatttttaatggcagcatagtattccattgcatatatacaccacattttttttctgtatttcttctaaaaaaaa

SEQ ID NO: 591923 - DNA, 299 bp, Homo sapiens
tataggcgcctagtgtgtagggataaggcgtgaccacagctccttgggccttcgagagtagtgattactaccttcctgcgtgcatttcacccggcaaagtgaaatttgattaataaatttcttagtaaatttatttagaaaaagaactatcagccaaaagatagcacatagggcaaatctggagataaacagtatcatgatgtatatgagggctaacccattgtggtttacttaaaaattagtttaagtggagttagaagtgggttattttcctctggtgaaaattatggacatagctg

SEQ ID NO: 591924 - DNA, 422 bp, Homo sapiens
gtactccccgggtttggcgagtacggaatctggtacaggtgctgatgcagattcaggtcgcatggagccaaaaatggagcggctacaacagaagaggtcctgaaaaggctcaaagattatccattaagtccagcgttatcgctgcaaagtgaattgctcccgtgctggatcatgatctgcatttcccagaatatgctatttcccggtggattgggccacgccgccggctgctgtgatgatcgtgtggagaatagggtagtcgctactttccgacatgagcttatctgtgtccagcaggctatcctcctccctggggacgggcgtcttccatccatccccgtgtttttgcccctacagtgtgtcctcgtcctgcaccacgctgcagaggtcctcatccttatgctgtctgtgccttctcttga

SEQ ID NO: 591925 - DNA, 494 bp, Homo sapiens
  misc_feature (276)..(276): n is a, c, g, or t
tagcatatagaaccatgcctggcacttagcaggtgccagaccacttagctttcttttctataaaaggtttttaggaggaaaacaagatttttttttatctaaaatacttttcacaagggtttttaaccaaagggccaaatttggcctacataatgtttgtaaaaatcatatttgaagtaattgccaactttaaacatcagtaactgtcacataaaaatctgtatttctcacttatcttgaaaaagtgtattttctggcacagagcttccccagttntgcttggaactccaggcagaagctgagtattggctgctgctttggacacagcatttgctaaacagctcactgcagtgctttgaatgacttctctaggcctctgcacctggaacttcttcactatgttacccttttcctaatgaatcttcatttcatgatattttcaccaaagaacaatagaatctgtaaaaataaatacttgcagtgcttaaatggga

SEQ ID NO: 591926 - DNA, 473 bp, Homo sapiens
  misc_feature (57)..(57): n is a, c, g, or t
  misc_feature (171)..(171): n is a, c, g, or t
actcttcaggaatacccccaaaaattaaagttttttcttttttccaaaggttgcccnacggccacccccctatgtccacggcccttgaaagttagttatttgaggaaaagtcggtccccttttccccctttttcttataacccaaattagaccaggaaatggaagattctncctcgggggcctgaaaagctttcggggatgaataacttcctcctccttcaggcccagtcccaaggtacaaacttgcaccagcagcaagatagcagaggcaggaagagagctggctggaagacacgtaccccctgaagatcaagagggaggtcgccctggtactacatagcagtcacgttaggctgggacaattcctgtttacagaggactataaaacccctgccccatcctcacttgggctgatgccattttagcctcagcctgtctgcatgcaggcgctcattaaaacagcatgttgctcc

SEQ ID NO: 591927 - DNA, 223 bp, Homo sapiens
atagaggatccccctacagtcttctgcgggcgcacagcttcttcggacgatcggccaccacagacttctcctccggcggactgctacgcgcgcgacgacgtagagggcagctgcgcgtgagccttcaaggctaaggcgcgggtccgggatggagccgctcgcagtgtgcagatcttaggtggtagtagcagatattcaaacaaaaagctgtggcggccgggaa

SEQ ID NO: 591928 - DNA, 541 bp, Homo sapiens
tatgtcggcgtcggtagtgtcatgtcatttcgcggttcttagaagagtactagagctcgagctccgcagcgtcagaagttgctggagcgcgtaccatgctgtatatacgggctgaccggggcgctgcagttcggttactgtctcctcgtggggaccttccccttcaactcttttctctcgggcttcatctcttgtgtggggagtttcatcctagcggttggcctgagaatacagatcaacccacagaacaaagcggatttccaaggcatctccccagagcgagcctttgctgattttctcttggccagcaccatcctgcaccttgttgtcatgaactttgttggctaaatcattctcatttacttaattgaggagtaggagactaaaagaatgttcactctttcaatttcctggataagagttctggagatggcagcttgttggacacatggattttcttcagatttgcacttactgctagctctgctttttatgcaggagaaaagcccagagttcactgtgtgtcagaacaactttctaa

SEQ ID NO: 591929 - DNA, 1393 bp, Homo sapiens
gaagtggcatgagtatcacgatcgctacggcgacagccacttgtgttgatctgctaacctcatcctggatgcgcttgcttgctgctaataatcggtcgcctagagctcatgcacactatgatagcatatgacgcgcatagctttttaggagttcgtcatgctcctcttcaactcatgccctcacttgggacaacctgttgcctcgacgaactcgtatcctacgaggtgagagatagtgtgcctgtgttgattgatgcacttatgagcgaactcgtagtttacttggatcatttcgtcatcgcctttgaactcaagcgacctcgtctctcggtacgtacatgctctatctctatcatgttacaacttttcaacgcatcggtatgcatcattttcgtagggcaccatagtatgatagacatcggttatacgtcgtgtggacacctagaccaggacttcttgcgtatttctaccctaacgtattactttcgcaaagagggacataaggcggatatctagagcatggaacggacttcaccccttaaaggattatgttatcggaggcacatagggacctatcggaaggggttatggagcaccgtgacctgttaagtaacggattttctaagttaagcacatttttggggtaacggaaaccacacacaaaacggtttacacacgacgttttctcggaaatggggactcttaagctcccctggacgacacacaaaggcttattttctacgcatggcgagcttgcccccttatgtcataggacaaggcaacataaacttgggggttatgcgtttcgaaaggcctttcgaggtgggaaagcatttcggcggttggctaaataccaacgctgaataaagttataaggcctgtggtaaaatcttacttgtgggcggaaatttccgaacactttagtggggggacaaccaaactccgcggtatattagtagggggtatgcgcacaacactcctactgactcgcggttggttcgcattttggcccggaatatcgacagcgggggacaattttcagacgcgtttctctggcaggagtactggagaaccgcacaggccggttttcatgagtgtcgcccgcccagtatgggccaagttggtgtggactcccaccgttggtgtttgtccggtccacggggggcaaacaaccgatggtgggaaaacttctccccacccatttacattttggccgacgagagagtgccaaaataaggcttttcacgggcaccttaaagcgggtaaaggaccggcgacaggtatctccgcccaatatatattgggcgtacgggcggagcaaacgggaccagcgcgcaactatgatagggcagcagaggcagatcgtaatacgtaggggatacaaccgctaagt

SEQ ID NO: 591930 - DNA, 414 bp, Homo sapiens
cagcctaaatgcccatcattcaacgagtggataaatataccagagtttctttatccactcgttgaatgatgggcatttaggctgtggataaagaaactctggtatatttatcccatggaatactactcagtcataaaaaggaatagaataatggcctgcgagcacttgggataggttacagcattgctattgtgagtataatgtaacaggaatgtttatcatctcagcgtaagtaatcattcataaggggtagtttagaaataagaacgttaggtcacaacaatcccccagtttagttgtgctggtgcatacgtgtaaaggcagctggtttccaggcgaaggggtgtagacaaccagaggtcaccagttcgacgccatcatgcccgttatagtaaagcgccctctttgtataaa

SEQ ID NO: 591931 - DNA, 998 bp, Homo sapiens
  misc_feature (427)..(427): n is a, c, g, or t
  misc_feature (570)..(570): n is a, c, g, or t
cggcaactcggttaagtcttcccccagcgcccactgaaatcgctcgccccagccgcgagggactggtggtaggagtaggggcgttgccggtggtgagcctcgagaactcctagggtcagtacgatactctctggcctcggcactccgcgagacagctgggactaacacgcgtgcatgccagccgcccccggcgaatagaagatttgaacttagctcccttacgcagaacagggcaagacgggctgtctgtagaactcgcgacaggagtcgaacgcgtcttctgagctcgccgtctttgggtatagcagtcgccagggcgtgaagctggtggtagacggcgtggtccaggagagggcggtgggaattacggttgacgttcggagcagcagggtcagctggacaccatgaggactgcacgaagcgagtntagagcggcggaaatacgtgaaaatgcccgcttggcaggtaccgcagtccgcagacaggctcgagcatgacctgaggcgccttaatggcagaggatgcgagcagcgtatcaccgaggcggtagccaccagctgcggcaaccanggtcacacatccaatcctagagggtttggtgccggactgcataggggctagggggggcaaagacggacgcttaggaggaaagctgcgaaggcggttagaaggcacaaggggggcggttagaggaggggcctgattggcggagagataccgggggcagcggatatactaccaccagacacccggacagagggggggtgggaccagatcggagaaggcaggcgggtgacgccatgtcgtgtgccagaaagggaaggcgaatagccgacgttggcaggggtagccacggacgcctaaggtggggcaaaaatggccacggaagtggcacaggactctggaaatgggccgaaatcacctggcagggaaatagccgtaagcgcaaggaggtgcacaaggtacacagcacacagaccgttaggggcgcacaccca

SEQ ID NO: 591932 - DNA, 1182 bp, Homo sapiens
gattccactgatgacatttgataaataaacatcaggatcatgtttatgttggtttcagtctttgcactatattaccagtatatggtttccgaggaagattatctactgcaaaacaccactgtgggaaaaataggtatttttaaatggtttttaatctttttgggtgcttttaaacatgtttagcaaaaaccaattcagttccattccccgcaaaaaacccctaactttactctgaactttatggtatttggcattccatgaggttctgtattcagtcattctctaggtaatcgtcattttggtacacatatatttatataatcactgattgagatttaggacacacagcatttctaaagaatattggcttcccttagaactacagactcgacaatctttaaagatggtgcctaagcatctatatatactcaagttccacagatcttctgtgggcagcaaggattataaacacttccctaaaaggcaacattaatgccaaagtccccagatgcaataccaagtatcccgtggtaccacatatattcattgtgaagtgggtataggagcacattatctaaaccattggtagttccaaaagcatctaaattcttgagtccgaatttgaccggattcctgtagcggaccacgttagatagacttctgtacaaacggaaattgagtggacacgcgttccaaccaacgatgcggcccacacatcggggacattacaggctgtggctactagagcaatgcaactcaacggtaaatataccaagaacacactgtatttcgcccaactacataatgtacacacaagttataatcgatgatcattctctctctgtctctctcccgtctccttcaaaacaacattcgaagagagaagcagagtcagcaaagcaggcaagacgaaaacgcaaatcagagaacaagagagcagaaagacgagcaagaggacacacggaaaagcagacgagacagagcaacagaaaacagaaacaaaacagaaaaggatgcgaaaacgcgcacgacgaagccgagacattagacaagacagaacagaggacgacagagaggagcagtcaagacgagcaagtgagcagagcgagcacggagaacgacagagaaagatcataaacagcgagagagagagcaagagcggagacaagctagaaacacaac

SEQ ID NO: 591933 - DNA, 472 bp, Homo sapiens
  misc_feature (470)..(470): n is a, c, g, or t
gaagataactgaatcaaggagtttattatgatgatgtattatgaaaaaaatcaggcagtattggttatgaatcccatacagtactgtccatattttttccttcagttaaaggtaaatgtctgatgaagaatacattttttagcaaaatttgcaacatgttagcattttaaaatatctgacccataattcaacttttaaaaatcatattttctcatatacttgtaggattttcaggcatgaattttcaaagacacactgtgccactgatgagaaactaatggtttcctgactaatgctggctcattggaaatgctctattaagaacaatgggttcaggaaggggcacaaagtatgggtcaactggctctgttctgtttataatcttgccaccatccaaagaagaaaggaatctgggctgagcgcggtggctcatgcctgtaatctcagcaccttgggagaccaaggcaggngt

SEQ ID NO: 591934 - DNA, 861 bp, Homo sapiens
gctattcttttattacctttactttcctagttaaacttgctttcactttactcaccctgaattctgttcttgctcgaaatccaagaacccccttcttggggtctggatcggggccccgtttccggtaatatctttcttgcgaccactgaagagactatagtgccaaaaccacgaacccaaaggctaactttgggtgagtggtggggtctggtaatatctttctggtgaaccacagaagggacgatactgaagaacaacccccacatcgcccccctcccacccccgcaaccatctgaaggaaatagactgcagcactgattggctgactttggctgtgcatgcttatgaggccctaaaaactgcacaccttaacgagaaacttagaaactggtttctgataactttggaaaccgtgatattagaatagaggaaaaaactttcaggacgttcatggagagctgaaactgttcatgaatatccaacaaaacaggagttaactgcatggactgaactttaactagcacgcattcacagtaatctttttgactttttgcttaaaacgttgctaatccttcgtttgttttcagagccaggaaaacctctttgctttcggagactatttaccacgcttttagaccaattggagcttaacaggtattatcctggctgacaacaccgcaaccactcgagacacaagacttccgaagcactatggggcccctccaaccatctcacgggtgccggcaaaaccgcgtgcgtattggactgttcgccccctgtgtcacattaccggttttccccgtgaccccacagctttccgttgtgtacacagtgtgggtcaagcattgctccgggtcttcc

SEQ ID NO: 591935 - DNA, 381 bp, Homo sapiens
cgcgacctagtgacatagtttggatctctgtttcccacccataacctcatgtcaaactgtaatccccaatgttggagatggtgagcctggtagggaggggattgaatcacaggggtgaatccgttcatgaatggtttagcaccattcccttgctgctgtcttgtgatagggttctcatgagatctggttattcaaaagtgtgtagcagctctccactccttctcttgcccctgctccaaacatgttgaatgcctggctcccctttcgacttccaccatggctgcaagtttcctgaggcctcctcagaagccgagcagatgcctccatgcttcctgtacagcctgcagaagtacgagccaattacctttctttatagattac

SEQ ID NO: 591936 - DNA, 127 bp, Homo sapiens
gacttaggtacgccagttagaaccagaaccaagcctatttcacttttctaatacagttattgaagctgcggaacagaattatatggaaatattacacagattatctgttccgcaagctacaactcag

SEQ ID NO: 591937 - DNA, 768 bp, Homo sapiens
  misc_feature (15)..(15): n is a, c, g, or t
  misc_feature (115)..(115): n is a, c, g, or t
  misc_feature (160)..(160): n is a, c, g, or t
  misc_feature (162)..(162): n is a, c, g, or t
  misc_feature (168)..(168): n is a, c, g, or t
  misc_feature (179)..(179): n is a, c, g, or t
  misc_feature (182)..(182): n is a, c, g, or t
  misc_feature (187)..(187): n is a, c, g, or t
  misc_feature (195)..(195): n is a, c, g, or t
  misc_feature (210)..(211): n is a, c, g, or t
  misc_feature (267)..(267): n is a, c, g, or t
  misc_feature (281)..(282): n is a, c, g, or t
  misc_feature (295)..(295): n is a, c, g, or t
  misc_feature (368)..(368): n is a, c, g, or t
  misc_feature (401)..(402): n is a, c, g, or t
  misc_feature (430)..(430): n is a, c, g, or t
  misc_feature (462)..(462): n is a, c, g, or t
  misc_feature (464)..(464): n is a, c, g, or t
  misc_feature (468)..(468): n is a, c, g, or t
  misc_feature (475)..(475): n is a, c, g, or t
  misc_feature (542)..(542): n is a, c, g, or t
  misc_feature (577)..(577): n is a, c, g, or t
  misc_feature (580)..(580): n is a, c, g, or t
  misc_feature (585)..(585): n is a, c, g, or t
  misc_feature (593)..(593): n is a, c, g, or t
  misc_feature (743)..(743): n is a, c, g, or t
gggccttgatttttnttggttaggccggctttgctggtgacttcttccaaactctgcaggagcagtctaccccaacacacatcatcagtcccatataaaagaataagatggaaantttctcaatgtatttcatcagtttagcacatctctggtacaaaantncaaganaggtagcacanggnggagnggccaggnaagcttacatataannaaacatgcatacatcctaaatactagagaatagtacccaaatgaataaaacattgnattaaaggtataannggggtgtactganaatttaaaagttacaggtgaatactgcactgtaaatgctgaatactataatgggccacgccccacccttccanagcgctggtgagggtaagagaacattcatttgnntcgagagtttgctagtgctcagagagantgctgcgagggtagtgggcagtgggattaggntngggnagaggtntggggtggtggagagcttctctgtatcgggagggccaggcctgggggtttttcttaaagaccctggncaggaactccatgatttgcatcttggtgatttcgnggntggcncgggagcnccaaaagaactggtattggggcggctccacgtatgggacgcgctggtacttcaggtaattcatttggacgaactcctcagtgatgagcttccgcacgtccccgaagtgggagtgcttcttccagggccgcagcccaggatgcgcaccgtntccagacggcgctctctctggcgcg

SEQ ID NO: 591938 - DNA, 239 bp, Homo sapiens
ggatgtggagatagcactaccggaagctgctggagggagaggagagccggatcaatctccagcatccagacctactctgccctcaacttccgagaaaccagccctgagccaaacggcgttctgacggtccataccaagcaagacggctgatcatcaagaccatcgagcacacgggactggggcaggtcgtcagctgaggccacacacgcagcagcatgaacatgctctaacagacagag

SEQ ID NO: 591939 - DNA, 644 bp, Homo sapiens
aacggtgggctatcctttatccaaatcagatagtgtttaggctctttttcatcaaatataaaaatccagcccagttcatggctcgttcggcagcaaccctgagacactttacagccctagaccctaaaatgtcaaaaggccgtcttattctcaatatacattttattacccaatctgctcccgacattaaataaaactccaaaaattaaattccggccctcgaaccccacaacaggacttaattaacctcgccttcaaggtgtacaataatagaggcagccaagtagcaacatatttctgagttgcaattccttgcctccactgtgagacaaacctcagccacatctccagcacaaaagaacctccaaacgcctaaaccgcagtggccaggcgttcctccagaaccgcctcccccaggagcttgctacaagtgccagaaatctggccaccaggccaaggactgcccgcagcccaggattcctcctaagccgtgtcccatctgtgcaggaccccactggaaatcggactgtccaactcacatggcagacactcccagagcccctggaaactctggcccaaggctctctgagtgactccttcccagatcttctcggattagcagctgaagactgatgcatgccgat

SEQ ID NO: 591940 - DNA, 248 bp, Homo sapiens
tgattgggcacagaaattcccatgtatttcccccacataggcacagcctccctcatcatcagcatcccccactagagtggtatgttgttacagttgatgagccgacattgacacatcatcacctaaagtccatagtttacactagggttctctcttggtgttgtacatgctgtgggtttggacaaatgtataatgacatgtattcactattatggtgtcatacagaataatttctgtgcccatttcaa

SEQ ID NO: 591941 - DNA, 633 bp, Homo sapiens
ccccggaacttccccacggtggtttatcgggcgtcgtcggggctgggtcccctggacttgcgggccacagctcggctggggaggaggtgctcgccgccctcacccgtttctctgaaagcagtaaaatgcctccccgctcctcccagggccctcgggtccccaccttccgtaaatcgtgcttccccctcgggcactccggtgactgccgagagagacgccgagccagcaagtaagaatgctccctggtgggatttggtggtaaatatagacaatctctgcgctctcggaggagaagtgtcctgcgggggccgctcgtccgccggcgacgggcggacggagcggcggtcgaggatggtgcgccgtcgtcggctcgccgccaccttccctcacctgcgccggaacaacgggccccgcgccatgccctggcccggcgcctcccgcaggccgcgcctccctgcacgccgcgctgccggggcttgttccttccctcatgggcttttgccccctggaccgtcctttccaacattgggcaccaggtccgaccttcacagggcggaccccacggaacctcccagacccgggctcccgggccccgatgacccggcgcgccagtcgggccaggctcccggaccc

SEQ ID NO: 591942 - DNA, 448 bp, Homo sapiens
catctttagttggttgggccaaaaatgacctaagaaataatttgtattctgctttactaaggtaaaagagaattatatcctgggtgtttttttgctcttcttaaaagaaatgtgccccttttaaattttgctttatttgtaattacccaaaatattctatatatttaaatacttaatttaaatctactgaattgcctgttaagaaataatttttaaagagcactgtcgtcaatactaaactttatcttttctgatgtttcttactaagactatgggtactccataaacattgttattttcaagattgatttaatgtatgtaaactaaattccactatttattcctaaattggtaacagtgctatttgaaaaatagctttttgcctgtatcctaagatatgtatttaaagtgcttgttgctcaccagagtccagtttatctgtcctcat

SEQ ID NO: 591943 - DNA, 970 bp, Homo sapiens
ttcttatttttacggagggcttgtggccttagacgccagtatgcttatggaaatgaaacagaatagtccctgtccaaaaaaaaaaaaaaaaaaaaaaaaaaaatttgttgggagacctcaaaaagttaaaaccatttgtggaggcaccgagagaccaccacgaaaaggaacaaggatgaaaccacggagacacaggaggtgtaccaccaagagaacaaacgcggacgcaaagaaccagaagaggcaaggaaaaatcaaacaagaaaaaaaaacaggacccgagaggaaaacaccgacacggttggaaaacaatcacgaaagagaagataacgaaaaaaaaaaagagaaacataccaaaaagagagatgtccaacaagaggagacgtcagaatcgatacaaaatagaaacccacacaacagtcgaaaaaaaaagtgagagagagtagaagggaggggggagggggtagtgaggagtaagcggagaggggaagtagatgtgaatagagatataaaggtgaggaggagaggaaggggagggagatagaggtggtaggaggaggggtaggtgagaagggaaagggaggaacgaaggggttaggtaggtgtagggagaagaggagggggaagagaatgataagagaaggaggcgtggagggtgttgagagctaaggggggaatgactaggggagagaggagtggaaggggagaagggggcgggggggagggcaaggagggaggaggtgtgagcgagtggacggggcgggggggggggaggggagtgagtgaagcgagaggggaaggaagagagggggggagcgcggtagaagaggagggggcggaaggggaagagctaggggaggagagagagggggggggtgatagagaggcgaggagagggagagagcagaggggagagggggggaggaggggctgggcaagggggaggaaaggaggggggaggagcggagaa

SEQ ID NO: 591944 - DNA, 208 bp, Homo sapiens
ggttcatggagcccctgtttttttaaaaaaaaaagggggggggtttcccccaccaaaatacccattttttaaggggaattaagttgaagatcaaaaaagggaaaggtataattaaatcatacttagcaattttaacccatgaaatgtaacattggcaaagggagaatggggttccttttttgaaaaccattaaaagtttgagacctta

SEQ ID NO: 591945 - DNA, 1129 bp, Homo sapiens
ccacgcgtccgggcgggcggccggtggagacggggtggcggctgcagcccgggtagggacaggagacccggtccacgttatgcaaacgcatgccgaacgcccagtgccgaccctgtgcctgcccgagcgccgcgctgctgtccgctgccactcttctctgcgcgccccgattggctgttccgtggtgctggagggcccccgtgcgtcaccggctgctccatgcgtgctgctctgggtgacctgggcatggcatgcgccctgtggctgggcactgggctccagacgcggagactgcacgatcgacgcggcgcattcgtgccccgacgagtgccctgcgcagccgtgcgcagcggcgacattcagtgcgactaccacatacgatggggacagttcccctgacggccagacagttcgactcacagctggtgtgatcccacccgcaattcagtgcgttcatttagatgtacttctgatggatattgggaattctgaagaccaggttcagattcacacctatttcaagcccccgagttgccctcggaccatccaggtgtctgattagtgaggtacactacaacgggacgtacctggacggaactctgttagattcgagtcacaatcgcatgaaaacatatgacacgtatgtgggaattggtgggtgattcctggcatggataaagggctgctggggatgtgtgtgggtgagaaaggcatcatcaccattactcttttctggcgtatggagaggatggagaatggaaagaaattccggtcaggataacggatgtgaggtggattattggactcataagccaggaaggattccattgaaaccaggagactgaaagggtacggaaagcaacggggcaccaggacacaaacaggaacaatttggagatggcacctttgagtctaggaaacttggaagggagagtgaaaaaaatgggcagggagaagatagaacagaagaggaaaagcaagggaagtaaagaaggggagaggagacaagagagaagagagaggaaaaccagagagagataagaagagtaaagagaggatagagcaaaatagttagatatagcagaaacaatgaggagtagaagtgtgctattgtgtgatctcgagaaga

SEQ ID NO: 591946 - DNA, 282 bp, Homo sapiens
caaatacaacagactccaagagaagaagaaaaccgaagatagcaacgggaacggagacatataacacaagtaacgctgggaagaaaagcaggaggtcttttgacgggaggagaacgagtggcgtacggaagactaggaacaatgccgtccaaattcacaagaacggggagaccagaggcaaggctttggagacaaaatgcaaagagtagggtagggggagggtgcctaccatgtcgttcccgggagggtggcagcggagagagggctcataatagtgacgtt

SEQ ID NO: 591947 - DNA, 122 bp, Homo sapiens
atatgtggtgatactgtgattgtgatatggtggcagtgatagtggtgatggcaatggtagtggcaatggtggtgatgatggtgatgataatggtgatgatggtggtgatgatgatgtgatcg

SEQ ID NO: 591948 - DNA, 490 bp, Homo sapiens
  misc_feature (73)..(73): n is a, c, g, or t
  misc_feature (107)..(107): n is a, c, g, or t
  misc_feature (120)..(120): n is a, c, g, or t
cacgaggtcgacaaaccctacgtcatggtcggcgccaatgtcttcgccgcagacgaagaggcggaagcgcggnggctcctcagctcgattcagcaggccttcctcancctgcgccgcggnaccccggcgccgctgccgccgccggtcgaagacttcgaggcgcagctgaccccggtggagcgcgccgggctcgaccaggcgctgtcgaactcggcggtcggtacgccccgtcaggtgcgcgagcagctggcgaagatcgtcgagcggacccgcgccgacgagctgatgctcaccgcgcaggtctatgatcattctgcccgtctgcgctcattcgagatcgccgccgaagcgatgaaggccatgcaagcataagcatcgcgccgcgcgcgagtttcggctaaactccttgcggacccataagaaagccgaagatgggccgctcgctccgtatgctccccgtcgcccctctcgcccttgggatgctgggcgg

SEQ ID NO: 591949 - DNA, 348 bp, Homo sapiens
gcggttgaggtagtagttgcccacgtggtgcaggcgccagcggatagggtcgtgggtggtgtgtacccgggcattgcgccagaagcggtcgaggttccatttgctcagggaggaactggccccccacagcgagaagatgtcgctggagatcttcagcgaggcgctgtcggaatgggcccgggcggtggccacggacaggatcaactggtcctgcagttccttgttgtccgggtcctgctcgtgttcgtcgaacacccgtgcggcatcgcgcagcaaggattcggcagcacgcagggccacggcgtattcaccgatctgcttgatgatgtgcggctcttcgctggcgtg

SEQ ID NO: 591950 - DNA, 325 bp, Homo sapiens
  misc_feature (269)..(269): n is a, c, g, or t
  misc_feature (306)..(306): n is a, c, g, or t
  misc_feature (316)..(316): n is a, c, g, or t
gtggttataatgagctcaaagcctgtgccggtctggtctgtgaaagggcctgggtgagccaaggtcagggccctgggcagagccatcgggctgctctggccgtggcggtggtggttccaggcacgtctctgggttgtgaggaacccgctggccccggggctgggctccgactggggcccaggtgtcgatcactaaggtatcggggtctctgaggggcaccacgttggaggatcacacgggcatgtgcagctcgttgtattcatcctggncgtcctcgtcaaagtttggttcagcgtcttcagagtnccagcggctncagctccct

SEQ ID NO: 591951 - DNA, 697 bp, Homo sapiens
  misc_feature (16)..(16): n is a, c, g, or t
  misc_feature (26)..(26): n is a, c, g, or t
  misc_feature (31)..(31): n is a, c, g, or t
  misc_feature (35)..(35): n is a, c, g, or t
  misc_feature (53)..(53): n is a, c, g, or t
  misc_feature (142)..(143): n is a, c, g, or t
  misc_feature (161)..(161): n is a, c, g, or t
  misc_feature (309)..(310): n is a, c, g, or t
  misc_feature (368)..(369): n is a, c, g, or t
  misc_feature (427)..(427): n is a, c, g, or t
  misc_feature (429)..(429): n is a, c, g, or t
  misc_feature (446)..(446): n is a, c, g, or t
  misc_feature (474)..(474): n is a, c, g, or t
  misc_feature (697)..(697): n is a, c, g, or t
ggccaacaacctgccnggtgcgcatnctggncganctgagcctggtgggctgntacaacctgtccttcatccccgagggcaagcgggcccagctgctgctcgagagcgccaagaagaacctgcggggcatggccttcttcgnncctgaccgagttccagcngcaagacgcatgtacctgttcgagcggacgttcaacctcaagttcatccggcccttcatgcagtacaatagcacgcgggcgggcggcgtggaggtggatgaagacaccatcctggcgcatcgaggagctcaactgacctggacatgcnngctgtacgactacgccaatggacctcttccagcagctgctaccagtacaagcggcagnntggatgctgcagtggagcagcgcctgagtgatgccgctgaggagcgtctgctgcaccngngccaatgatggcactgncgcgggaggatgccgacgagccgggccngctgtgcccaccgaggactacatgagccacatcattgagaagtggtagtggcggtggtggccacggggaggcctcttggggggtgtgggggataaaacaggacagacgacaggtccacccaagactgtcaagggatgagcatccaaactgctccacagaggtagctgcgtctgaaaaaaactgagcacgatgtagtgggctgggcaggatggggcttgagaan

SEQ ID NO: 591952 - DNA, 219 bp, Homo sapiens
cgtttttttccccagggataatattcccctttttctctcctatttctgatatgtggcgctcttttaacaagcgcttttttgtttgcagggtaaagacacatgagtctgttttttccctgccgggattctcccattgaaggcccttggcaggggttgccaggtgagccatcccgctgagtcccgacctctgcgctgtgcatcctccctttttggccaccc

SEQ ID NO: 591953 - DNA, 214 bp, Homo sapiens
  misc_feature (195)..(196): n is a, c, g, or t
ggtgatctagaggatcggctttggcggcgcttttccctaggaagtcatactcaattctttcatcccccaattaatcattccctttagtgaactcttgaagagtgagtttacacactttagcaactattttctatggggtagtttttcttttcttttcttttcttttttgaagacagggtctcgctgatcacccannggatggagttacagtggt

SEQ ID NO: 591954 - DNA, 899 bp, Homo sapiens
  misc_feature (812)..(813): n is a, c, g, or t
  misc_feature (838)..(839): n is a, c, g, or t
  misc_feature (842)..(842): n is a, c, g, or t
  misc_feature (865)..(866): n is a, c, g, or t
ccgggcaaggaggtctggatgctgagggcggtccctgaggggcgggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctggttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgtgagtgacatcaaggcagtgaaagccaactggtgaggcnncagaggccatggcacatgcctggcnnacncaggctctggggggccccccagnncctcctactatatcctgacgggcaggctgcaga

SEQ ID NO: 591955 - DNA, 857 bp, Homo sapiens
  misc_feature (770)..(771): n is a, c, g, or t
  misc_feature (796)..(797): n is a, c, g, or t
  misc_feature (800)..(800): n is a, c, g, or t
  misc_feature (823)..(824): n is a, c, g, or t
ccgggcaaggaggtctggatgctgagggcggtccctgaggggcgggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgtgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgtgagtgacatcaaggcagtgaaagccaactggtgaggcnncagaggccatggcacatgcctggcnnacncaggctctggggggccccccagnncctcctactatatcctgacgggcaggctgcaga

SEQ ID NO: 591956 - DNA, 1097 bp, Homo sapiens
  misc_feature (1010)..(1011): n is a, c, g, or t
  misc_feature (1036)..(1037): n is a, c, g, or t
  misc_feature (1040)..(1040): n is a, c, g, or t
  misc_feature (1063)..(1064): n is a, c, g, or t
ccgggcaaggaggtctggatgctgagggcggtccctgaggggcgggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgtgagtgacatcaaggcagtgaaagccaactggtgaggcnncagaggccatggcacatgcctggcnnacncaggctctggggggccccccagnncctcctactatatcctgacgggcaggctgcaga

SEQ ID NO: 591957 - DNA, 1061 bp, Homo sapiens
  misc_feature (974)..(975): n is a, c, g, or t
  misc_feature (1000)..(1001): n is a, c, g, or t
  misc_feature (1004)..(1004): n is a, c, g, or t
  misc_feature (1027)..(1028): n is a, c, g, or t
ccgggcaaggaggtctggatgctgagggcggtccctgaggggcgggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttctggcaacagggatcctggcctttgtcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgtgagtgacatcaaggcagtgaaagccaactggtgaggcnncagaggccatggcacatgcctggcnnacncaggctctggggggccccccagnncctcctactatatcctgacgggcaggctgcaga

SEQ ID NO: 591958 - DNA, 110 bp, Homo sapiens
gatcctgtggtcatcaacagagtcttcaaggactgtgaagcctggtaggtgtcatcagactgcaggaactgtgtgggaggtcttggggtctgcagaatgatctacaagct

SEQ ID NO: 591959 - DNA, 162 bp, Homo sapiens
  misc_feature (7)..(7): n is a, c, g, or t
  misc_feature (145)..(145): n is a, c, g, or t
ggagaantggcaggtggcaccgatagccatcatctacctctgagtggtgtaccggcaacctggccagtgcatcttcctgccataccgagcagaggtgggtctgctggctccagttcggcatctggctgctcttgtggagctcttncagagctggcagatcct

SEQ ID NO: 591960 - DNA, 178 bp, Homo sapiens
ttatacgccaaaaccaacacaaaaacgactacgaaaacacaacaccaagtcccacagaaccatcaaacccacccaatacaagacactccccaacaaacccaggcatcctcgcccccccaaatcaataaacacacaaacacacgaaaccttaccctcctccatctctacacgaacgcct

SEQ ID NO: 591961 - DNA, 313 bp, Homo sapiens
  misc_feature (45)..(46): n is a, c, g, or t
  misc_feature (50)..(50): n is a, c, g, or t
  misc_feature (121)..(121): n is a, c, g, or t
  misc_feature (126)..(126): n is a, c, g, or t
  misc_feature (128)..(128): n is a, c, g, or t
  misc_feature (147)..(147): n is a, c, g, or t
  misc_feature (154)..(154): n is a, c, g, or t
  misc_feature (158)..(159): n is a, c, g, or t
  misc_feature (161)..(161): n is a, c, g, or t
cgaccctctatgtcatcacgcttcccttctggcagtgatccgtgnnaatngtactttgggaacttcctatgcaaggcagtccatgtcatctacacagtcaacctctacagcagtgtcctcntcctngncttcatcagtctggaccgntacctgncatnngncacgcgaccaacagtcagaggccaaggaggctcttggctgaaaggtggcctatgttggcgcttggatccctccctcctgctgactatcccgactcaatctttgccaacgtaagtgaggccagttgacagatatatctgtacccgttctaccc

SEQ ID NO: 591962 - DNA, 153 bp, Homo sapiens
ggggtggcacttgttggcgagtagccttgctccaatgtttcaaacatatgatgcctgccgggtttgtgctactgccgcacttttctggcgtcttctattttaaacccttccctcttccttccaatgttaactgcatcttcccagcttgctcca

SEQ ID NO: 591963 - DNA, 465 bp, Homo sapiens
tgggcatgtgcctctcacttagctacctgacaggctgaagcaggaggatccatgagccccggagttggaggttgcagtgaggtatgatcaaagcactgtatgcaagcctgggtgacatagcaagactctgtctcaacaacaacaacaaaatctggaacaaaacacatattggctaggcacggcggctcatgcctggaatcccagcactttggaacaccgaggcagttggactggttcagctcaggagttcaagacccagttgggcaaatggcaaaaccttgtctctacaaaaaatacaaatattaatggggcatagtggcacatgcctgtagtccccactactcggaaggctgaagtcgaaggattgcttcagcctgcgaagttgaggctgcagtgagctgagattgcaccactgtactctagtcagtgtgacagagtgagaacatttctcaaaaacaaacaaaa

SEQ ID NO: 591964 - DNA, 1168 bp, Homo sapiens
ggggggggggggcgcccctctgttttcttgttggaccccccccccctccttcttcattttgattctttctttctgtcggctcttccgctctgattgctcttttgtgttgagctgtgggtgttgtcgctcctctggtgtttctttcttcaatttgtgtgtttttttgtttctctcgttctctgtttggttgctgtgcctgtggtttgtagatggatgtagttcttggtgttctctcccacttcttctcgtttcttgtggttgaggtcgttttctttttgtgtgtttgtgtgtgtcttgctcgttgtgtttgtggtgtctcctcttcctattttctccctccttcctctcctcctgggtcttcttgtgtctgcctcggtctgtgtgtttttttttgtgttttcggctctgtgttattgtgatttaaggtggtattgccgttgtggtgtgttgctgttatagattaggttagtgggctttcctcattccttctgtttttagtatactgccctctccctaccgttcgggccttttttgttttgtctgtctttcagtttgagtgagagagtgagcgcctctcgtgtctattttttttcgtcgtcgctgtccgaggacagcattattggtttctccccgcgctgttctttctgctgtctctcgcctcctcgcctctcctgtctgtcataacatttagatgtcgactgtgccgggtgtgcggtgtgtctctcgtgagctctctagactcctctctctgtctgtctctttggatcgttctcttctttttggtctctcccactccgaatgtacgatgacgttgtcttgtctttttctcttctcttctcttctcttagatcgacttcgctcgcgcgcgcgcaccaccccccctctctctcgtgttgtctgttgagtgcgggagagagggctctggcgtccacccccctcctactttcttttctctctcctgtctcgccgtgccgcccagctcttttcttgtcgtcgtgcacggctccttttctggatcttccaccgctccccccccccctgcgtggtgtgcctccctcctcgtcgtggcaggggtcgtacctcttgctttgtgtggtggcccccccccccccccccccctcccctctcttgttttgaggggggggggggcgagaaaaaaaaattatga

SEQ ID NO: 591965 - DNA, 93 bp, Homo sapiens
gcctcggacaccgccatgtattactgtgcgagagtgtttttaccgcacgggcgggaagaagcagaagccccctttgactactggggccaggga

SEQ ID NO: 591966 - DNA, 426 bp, Homo sapiens
gctattgcttagtattgactatgctatgcttttaaatcattattttgaaagtgtactcttactcattaaaaaataaatgttgactataaagcatcctcaggcaggtccttcaggaagtattccggaagaaggcactgttatcacaggagatggcagctccgtaaatgttattgcccctgaatacctttcagtggggcaccatgtagaggcaggagacagtgatattgatgatcctgactctatgtgggcctaggataatgtgtgtgtttgtgtcattgcttttagaaaacacactttaaaaagtcaaaacaaaagtttcataaaggaaaaaagttacagtaagctaaggttaatttattattggcgaacattaaaacaatacctttattgtcactaagtctacagtgtttataaagtctatagcag

SEQ ID NO: 591967 - DNA, 1097 bp, Homo sapiens
tggtgcctcaagacaccggtttagtgggggacacgactctgcaatagggatgacaggaatcgtaccaaaaatagcgacgtctacggggccccgtgagtggggctagaagggtacaggtgccccccacccttcaccccttgtgtgcaacaattaaacttctcacgcctagtggaccagcaaagacgtggcagaggtggctcctcaacagggacacaaaccttctctgtgccagcccagggaccccgttcttgtgacccttcaccttctgtgccacttcataaggcacgtggtgacctccctttgggcgtggggtgggtaccgccagcccaccctcctataagcccgccgggcctttccacctcgtggtccgccgtggggcgtgggatcgtgggtcccagcgcgtgcccccgtgggtggcttctcttacccaattacctttaggcgctcccccgatccgggggggtaagctcactaagctaatcggcccctgagggcccattaccggttctgagccccccagcctgcctctccgggtctggacagccgggagccctcttccccttcctgcgaaggactgggaggggtctatccgtgatgggtactcgggccatagggcggggaacccgtaacacctgggagtggccgggggacccataacccggcggctcggaggtgcactcgcacggtgccagggccctgcactcagggcgcccacgtgccacacggggccagaacaagggacacgaggagagggcaccccaaggccaggatcgacttccgcgccctggccgcaggacaagggccagagttcggcccacacgctgaccgttgcacgcgtcacccaggatgggagctccaggggacgaggcagagcgaaaggggcgggaaatagagcccccacccgaggcagcgtgagaaaagagcgcgccaacgtggcgggaccccagagaaaaaagagaccaggttacgacgcgcccccatcccagagtcacagaaaacagccaggacccacgacgaaacgcaacgacagcactcaactgaggtgcaagaaacagaaaagcagaagcacaaaatagagaacggaagcgcgtcgccga

SEQ ID NO: 591968 - DNA, 111 bp, Homo sapiens
cattaccaataagtataggcgatagaattgacactgcgcaataatatagtaccccaaggtctagattgaaaaattcttacccccgcatattctagcaaggcgttaaccccc

SEQ ID NO: 591969 - DNA, 467 bp, Homo sapiens
cgcgcatatgtgaaaccccgtctttgctacaaatagaattaatagcctggcgtcatggcatgcgcttgtaatcccagctacttgggaggctgaggcaggacaatcgcttgaacctgggaggcgcaggttatagtgagctgagattgtgccattgcactcgagcctgggcaacaagagcgaaactccatcttaaaaaaaaaaaaaaaaaaagatacattcgggctcttataagatattgaaggtaagctaatttagtacttccagcactattagacagttcattttctgggaaataccatgctgacccccaaatccacgtgtcgatctccagacttgggaacataatctctattacagtctgatcccattctatatgtatgggcaggaaactaaacagctattagggcccttaaacataacgtaccattgataatagggctatatccgtgtaaagacaccatcagaat

SEQ ID NO: 591970 - DNA, 561 bp, Homo sapiens
gcacgaggtgtatgataatagctagaatagacatactgttgtaagtagaattctgaaacaacttcagattcatttaaacatacatcaattgacagttaagcaagctaagcttaagcaagttaacttgttttgccatttctatcaacgtaagaaatagggaattttacacgacagtaaccctatgtcaacatatgccgttttacaagacagtccaccttgacaatcaagccgtagtaaaacccaccgacctaacatcagttagataatgcaggcccacctctttccattggacctcgacagcccatatctccacatgtcaaaatggtaatcaccaattcctttccccttttcagtatcttcaaaaaccaagacacaaaaaggattttttctaactagaacttctagtttacctgatacatatctattgatttgcataacaaatatataagatagacttttaaatgtacaagaacctcataatttaataagttttattatcctaacataatgtaaacattatagcaacagtttaagtcaccatttgttataagcatgattaaa

SEQ ID NO: 591971 - DNA, 350 bp, Homo sapiens
gtggatgaggtatatactactcattgaagtttctggcacatgggtcatactataggcccgtatcctatacagtgtcgcggaaattgcaactggtgacccttgtgattttacagtgttaagaaatatgttgatcacaacacatcgcccgacttgcatgatgtctctgagataatatccactgatcgagcactatcgaatcatagaaactggccatgctggtgacttatcatggagttgataacaagaagaataaagggcagctcactaagagccctctggcacaaatggaagaagaaagaagggagcaagtagctaaaattaagaagatggagatggagatggagcaggtg

SEQ ID NO: 591972 - DNA, 414 bp, Homo sapiens
cacacatcacaaagtagtttcacagaatgcttcgtctaagttattaagtgaagatatttcattattgaccatcaccctcaaagtactccaaatatccacttacagattctacaaaaagagtgtttcaaagctgcttaatcaaaagaaatgttcaactatgtggagatgaatgcacacatcagaaagaattttctaagaaagattctgtctagtttttatgggaagttacttccttttccaccataggcttcaaagccctcccaatgtccattgcagattctacaaaacagtgtttcaaaactgttcaatcaaaagaaatgttcaactctgtgagatgaatgcacacatcacaaagaagtttcacagaatgcttctgtctagtttttatgtgaagttatttccttttccaccgta

SEQ ID NO: 591973 - DNA, 358 bp, Homo sapiens
tgcttcttgaaactctgaacaggtgataaaggaagctggtagtcttgaagaaacacaagttattaagaggcatacactggtcgttgcccagatgaaacgtgtgtccaggttgccagatctaacgccccccacagggtcaaaccgaggccagcccgtgccaggagagcttctgccattctgccaggagttctgggtagtgagaccctcagtaacgaatgtattccaggagtcagaggaagagaagcagcctgaggtcccttgctcgtgggccaaaggagaaagcctttctcttccctgggtcgctagctcaaccacagatgggactgagcaggtgattattgcaagaagcaggaactgg

SEQ ID NO: 591974 - DNA, 847 bp, Homo sapiens
ctactaacagaccgcagcctcaacaacaacttctgcgatcccgccggtaggaggagaccccatttctataccaaacaactattctgattttgcggtcaccctgaagtatagtattcttatcctacccaggcttcgtgaataatctcccaatattgtaagttacatattccggaatagaaaagaagcatttggatacataggtatggtctgtagctatgatatcaagtatggcttcctagggtgtatcgtgtgagcagagcatatatttagacagtaggagatagacgtagaggacacgagcatagttgcgacctgcgctacctagtaatcatctgatatgcccgaccgggcgtgaagggtattgtaggcatgatgtcgccaaacatctcatggaaggaatatgaatatgatctggtgcagtggtctggagccctaggattcagtcttactttttaagcgtgaggtggtctgagtggtatgtattagcaaactcgatcatagacatccgtattagaggatggtactagttgtagctcattccagtatgtgctatcaataggaggtgtattggcatcataggaggcttgattcactgatgtactctatgctcagggtaaggcctagaacagaatctgagcttaaatccagttcactatttatatgcatcggggtcaattaacttttttccagaaattttttggttatcggaagccgagtatttgataccgtggttaaggaatgaaattatattggaggattattctaagggagataaaatgcgattggaagtgtcaagaagttttataaaccttaacggggttgttgcccaaaatgaaggttttttaag

SEQ ID NO: 591975 - DNA, 281 bp, Homo sapiens
  misc_feature (30)..(30): n is a, c, g, or t
  misc_feature (201)..(201): n is a, c, g, or t
  misc_feature (223)..(223): n is a, c, g, or t
cagctcgtgacggcctccgagacgccagcngccccttctcggctgtgtggcttcgacttcctgattctcccacgacgtccctggccgggagacccgctggactctgcggctggccaaaaggggagggggagccccgcgtcctgggggcccctagcggaaggggcgggggttgcgctgggcatcctgtctggggcatctgtntgggactctgttggtgcctctnacctggcgaggggcctgtggtgtgggtaggggggaagtccctgccatgcttggccaag

SEQ ID NO: 591976 - DNA, 104 bp, Homo sapiens
aggatccccagtccgaacccccgactcatattctagatttattttagtttgtatgtagctgttacctaaatatattttataatccaggttgactgatctagtca

SEQ ID NO: 591977 - DNA, 151 bp, Homo sapiens
gcgtctgcgctggggctcccggaataccccgcccgtccctacgctccttgtgtatcctcgcatccccctcctcagtgaaagactgaccaggatacacaagccgcttcatgtgccgcggcttgtgtctttcctagggaagctatactcactg

SEQ ID NO: 591978 - DNA, 165 bp, Homo sapiens
atctagaggatccctttgcaggctctctaccttgggacagcaggtgagacgggaggccaggagaggaaaggcaagctgaggagagggctctgagccagagaggggcctgaggagtgtgggacctgagagctagcagacgcactttacgtgcttatagcctcttcc

SEQ ID NO: 591979 - DNA, 188 bp, Homo sapiens
gtgcacagaaaatttcacccgcatcgtggacagattgctcgatggttatgacaacaggctgcgtcctggatttgggggtcctggagcagaagtgaaaagtgacatatatgtcaccagctttggacctgtttctgatggtgaaatggaatacacaatggatgtgtttgtcaggcagacgtggattgaca

SEQ ID NO: 591980 - DNA, 785 bp, Homo sapiens
gcggcgttggagtccagatggaggagtacgcgcgagagcctgccccatggacgaattgtggattgactgtggtggggcctttatcgatgggtaccattggtcgggtggctatgctttcaaggcaactgcaaaggtttacggcagttctccagctgggagtaaatcacagactacgagggtagtttgatcagctattaaaagcagggctccactaggttaggaggtagctttgcagtttggggagggctgttttccatgattgactgtagtatggttcaagtcagaggaaaggaagatccctggaactccagtcacaagtggtgccttaacgggagccatactggctgcatagacatggacctagtggccatggttggagtcatgacctgcacctgggtggcattctcctagctttaattgaaggagctggtatcttgttgaccaagatttgcctctgcatcaggtttcccaatggtcctcaggtttgctagagagacccctccgcagttgcctttgaactcagattacctgtcctcatctttggagactatcgactatatcagtgaggacttctttcctaggatttctttaacagaaggagttgtggtgcgagaaggatttcagaagatcacgtgacaggctgtttttaaaacgcgataggtgggacagctatggccaataggtataaagagacatttagcacttttctatttaaggaactagcggggaagggtgcttacagattaatacgttatttattcagaacttgaattggcttgtgaatc

SEQ ID NO: 591981 - DNA, 880 bp, Homo sapiens
tgagtacagcgagaagtgggaccttgtgtgagcgagctgaggggcgcaggaagaactaaagcgagccttgggggaaggtgaaaaatatgggaaaccaaaagtgtggtcaggcagaagatcagaaagaggatggttcggacctagaagctcatagacttctcacacaggatatggtccattctcacaatggatttcctcgtgcacattctcagcgcgtgggcagattgggcttctcaacaccagatggggcggatcttggcctgtgccagggggtccggaggaaaacctggaaaacccagggaaggaaaaaggcttcttctgtccgcaccagaaatttgggatccatagatcccaggcctacaaaaatcgctctctaccaggagcccagcaaatatgtgtgcaaaggatccccaaggatgatgacgactttgaaactttgtgtccccacaacaacaatgtgattgcttcccatctcgatggccagcttgaaggggcgcaatgaatagtgactgtgcttatgagctttgggctggaacaattgtccccgaggaggctgtcacaggcggtggtcaatgcggggaggaaatcaccttaaaaagatattagtgggggtcagtggggtcagaaggaacgttatgcggacacaggagtgggcatttaaatatgcttgtgaagagaagtgtggccccgaagccaaaacctggagagtatgtgggtaggttacaaacttaataaaacgtcaaagttaatgtcctgtggtggcaaatcatcagttttaccacccctggtgtgttgtggcaggtggcttgtggaatggcgggacaactgttttgtcggagagagaatattgagacggggggggaagccaacattggtgtgc

SEQ ID NO: 591982 - DNA, 712 bp, Homo sapiens
gtacttttcctttctgctgccaagtgaagaaggatgtgtttgcttctccttccaccaaggttataagcttcctaaggcctccccagccctgcggaactgtaagtcagttaaaccactttcctttataaattaccagtctcaggaatttcttcatagcagtgtgagaacagaccaatacacttctgaaatatactgattcatcaaatcccatttgactgtagaccaaatgcaaactcagtgtttgtgatccccaggtttcaattagcatggctctgtgtgaggaatatgaaggccgctaaaacatggcagaacctctttcttctacaggaagaccttcttttgatatgtataatcttagaattgtaaccatttgaatcacctttccaacaatatcactaaaggatatatttcttgatcagagaaactaagacttaaaactataagatttgtttactctattaataatccccataaagaaatatatttctctcacttggttatgtagactatatgacatgtagttaattaagaaagacatgtaacaggcccatttttataaacttattttcttctaactatatgttttgccccattaaccaacctctctttatcctttccagtacccatacaccctcccagccctctagtacctatcattctatggtctaccttcatgagatcaagtttttaatcttttccatatgagtgaaag

SEQ ID NO: 591983 - DNA, 923 bp, Homo sapiens
gaaaaacgaccatcagcagggcagtccactcctagccccggatcctgctctagggcccctcatgccccaggtgagcagctctcctaggtcacagcctgctgggctgggtcgcgtagccctagtggtggaggcagaacgatgctgctgtggttagccctttgcctttcatgcccatgcttgattcttgcacctcagcagctgaaggtctcagagcacagtaatcagaaggcatccgatgcattaagtgtgcagcgcttgacaagaccatttaccaactaggccaggattagccactgtggaagggtggacaggcaatgttcagtggcctgggcttgtggcaggaactccaagtgcccaggccttcttggggcagcttagggccctgccttctggtttcatgattgcatgggtcattggtcttggggtgtcctaatcccatatggagaagaacaggggctctaagttctgctctgacttcttggggggtctctgtacctgaggaaaccaggccctgggtgactttgcagatctgtcaccctcggtgagcacacaggtgtcagcatgcaagcaggacagaatggtgactggggtgccttggtgagctgaggtatttcctaaggcaggtagcacactgtgggcaaactggggctacataaaaacttatgtgcgcaccgccgccacaaagaaaaacacaaacattgtgggccgcactcacccaggaaaaagttacaacacactgtggggcgccgccactgattagcacagtgcctacgttccaaagcacctgtcagacatcggttgagtccacacacaggcggggacgcggttgtcaacccaaggatgcgccatggtccaacggacaggccacaccccccgcgcggaccacaaacacacacacaacagcaacgcgacggcaacgacga

SEQ ID NO: 591984 - DNA, 505 bp, Homo sapiens
  misc_feature (55)..(55): n is a, c, g, or t
  misc_feature (76)..(76): n is a, c, g, or t
  misc_feature (189)..(189): n is a, c, g, or t
  misc_feature (211)..(211): n is a, c, g, or t
  misc_feature (254)..(254): n is a, c, g, or t
  misc_feature (275)..(275): n is a, c, g, or t
  misc_feature (324)..(324): n is a, c, g, or t
  misc_feature (429)..(429): n is a, c, g, or t
  misc_feature (481)..(481): n is a, c, g, or t
atttttggtcccgaggagggtggcccgggtatcttcgatttttgaggaaagaaanggggggaggggggaggtgaanaggttggggaagttagaggttaaattgggcgttaggggacgttggagttgattagtaagggttccggggaggtttgggggcagtagagaaggggtttgggcggggggcttganaggttaggggtaagcaggagtnagggtggggggttcaggttagagaggtaaggggttagttgganaggggatggggagacggtttnacggaggttaggggtaaaaaggaacagggttgaagcgttagggttcganaggttaggggttggcagaggcggagtggggcaatgggggtaaggggtaggggattaggggggggtagggtgcattggtagattgcgcatgggatttcagttttgngagttgttgggagcttttggacggtggacttgcgcttgggaccgcgttcgtnttgtttgcagcgcatggccgggaa

SEQ ID NO: 591985 - DNA, 575 bp, Homo sapiens
  misc_feature (26)..(26): n is a, c, g, or t
  misc_feature (62)..(62): n is a, c, g, or t
  misc_feature (65)..(65): n is a, c, g, or t
  misc_feature (80)..(81): n is a, c, g, or t
  misc_feature (88)..(88): n is a, c, g, or t
  misc_feature (109)..(109): n is a, c, g, or t
  misc_feature (132)..(132): n is a, c, g, or t
  misc_feature (178)..(178): n is a, c, g, or t
  misc_feature (182)..(182): n is a, c, g, or t
  misc_feature (199)..(199): n is a, c, g, or t
  misc_feature (245)..(245): n is a, c, g, or t
  misc_feature (290)..(290): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (362)..(362): n is a, c, g, or t
  misc_feature (398)..(399): n is a, c, g, or t
  misc_feature (402)..(402): n is a, c, g, or t
  misc_feature (414)..(414): n is a, c, g, or t
  misc_feature (554)..(554): n is a, c, g, or t
gcgaaaaaaaacaccagccgaaaccnaccccccggaaacccccccagaccacgaagcacccnccnaacccggggccaccnnaaaaccncgccccccccgccccccgcanaaaccaccaccaccccaacccgnacaaccaacaaccccaccgccgacccccaaaccacaccacgcgaancccncaacaccccacccaccncccacacacaacccaccccccccaaccacaacccacaaccccaccncaacccacaacccaaaccccccacacaggaccccaccaaaaccanaccccancanacnacaccacccaccccccccacaacaaccccacccacccccccccccacccacacccaccnccacccccacccccccccccacacccccccaaaaanncancacacaaaagcnaaaccaccacacccaacaacccccaccccacacccaccccccaccaacccaccaccccaccccccaaaaccgaccacaaccacacgaacccacacgaccaccaccccaccaccccaccccccccaacccgaaccccccanccccaagaccacccccccccc

SEQ ID NO: 591986 - DNA, 1140 bp, Homo sapiens
agcggagccagtgcggcagccgcggccgccccttgtccagcctctggcgcccggtgacccgatgcgcgtcgctcgcctgccgcggagccgcgcgtagcctgtgagcgcctgggcgaatggcggagcatgaagaaccaacagccggccgcgcccccgatccacccttgatagagcccttacctgcctgccaagaagtcccaagtttgaacacttaaaacttgtgcaccaaaagagccaaacatagtgggaaagcaaaaatcaaccttacagggaacaagacacccactattacgcaattcgtggaaccaggtcaaaccaacgggagccaacccaagtgaaaggcaaccttacccacatgtgaaacaacttcgctaacgcaaaccccagcggataaattaccccgtcgctaattcatcaaaaacagatggatcaaaaactaacaccatggaaagaaccgcctatagccaattagaaaaacactccaaggccaaacaatgggacaggcagaagcccctaaacacccattgcgcaccagcagcacttgccaccacacaaccattaacccacacccgggggtaccacccacaggacacacacacaccagacttaaccacaaagaggccaccctgagtcacaacacacaccaatatcgacagctaaaggacaaaaacccccccatagcagtggcaaaaacacaaaatgatccacagacataatacacactaatgtcacacagcacctatgggaaagtggaaaacaacactgtgccaattaataacgaacagaaggcctataaaacgagcaccatgtggggctatcgcgagccacacagacaacaccccatttcaaccacatatgacatgtgaaacgcgccagagggatactacacccaagatacgcaccacgaccggaaaaaacaccgaggacacaacataacgatgtgcggtgaaaccagacaacaaccaacacgacgctgttaaaataatcaaaggcacgaaacagcgaacaatacaacattcttacccaaatgataggcagcagaagaaacaaccctctgttgagcgaacaaaatcatcacgcacacgaaatactatacagcacaagccatccccccacgttgagcagaacacgcgctcactt

SEQ ID NO: 591987 - DNA, 170 bp, Homo sapiens
gagagtactaagctcttgatctaaggtctatgcaactggcactcactgcggaccaggacattcaatgccagacagcggtagggctggtactgggcggaatgccagatcctgggcaacagctagcctttctgctcatggttctctggtagaccacgacgatggcctcttgc

SEQ ID NO: 591988 - DNA, 253 bp, Homo sapiens
atatgaatgtacctcaagctattttatattaaaaaaaaacaacaaggaaaagagacaacagtgcctcatgttttaagaaaactactgctcagtaaagttgtttaaaccactttctggatagctacatgacaattttatattaacatggtatcctaaccttaaggtgaacactgatttttattagttgtttcacagtacaacatacttgtattggtatttttaacttgcagtattccccaatgtcagcagtaat

SEQ ID NO: 591989 - DNA, 465 bp, Homo sapiens
cgcgagctcgcggcttggtgccgggggcctgtcctgagggtagaggatgtgagagggatgttggccattacggggtgccaccacctcagtctctgtccagctctgggatcttatttggactccagctgcttctggtgattcagctctgctatgtccttctggagagactcgcagaggttgagagcagagcacacctccccaggacggctcatttctcctttaatgatgtccaggatgacaaggaaggtaagaatccactatctccttgcataaagcaaactttttcggtatcgcgaaggccagtcacaggtccttctccaaggttaaacaaggatctcctcctcaagttggcattgtccttcagcatatcaccagctgcggtgaccacatctttgcatatttcgcccgggaacggatttccactgttggcttaggtccgaacggtctggaaggccgtgcaacccg

SEQ ID NO: 591990 - DNA, 124 bp, Homo sapiens
cgctgcccgatctgcgctgacgtgcggtgaccgatctggtcgagccgggttcgacgatgaatgccgctgaccattgctaccgcgctgcaggccggtgcggtgaccaaggacaccatcatcgata

SEQ ID NO: 591991 - DNA, 220 bp, Homo sapiens
tgtgtcatgcagctcgcaaattactgactctggctgagcacagtggctcgcacgtgtcatcccacaatgctgggattacggtcatgagccaccgtacctggcccaagctcttgtctacttctctactacataaactcacagaccaaacctgacgccatcgggagggttctgggacaggacggggcacattatggcctcaccctttcccaccccttatgct

SEQ ID NO: 591992 - DNA, 450 bp, Homo sapiens
ttatgcatggttcactccctgtctctgctgtggacaagacttcgagagaatgagaccatgacttactatcactaatgacacgggccgtttgagcaaggaatacattgaacgtatggtccaggaagctgacataggtacagcgctgaagataacaagcagcgggacaaggctgctcgatccacgaattcacttgaatcctctgccttcaacatgaaagctactgtggaatgatgagagtctgcacaggccaagatgaacgatgaggagcaacagaagattctggacgattgtactgaattgatcaggtggcttgctaagactcagacctggtgagaaggccgaatcggaactactctagcagaataggagctcgggaccttttgcaagcccatcatcaccaagctgtaccagagtgcaggaggccattgcatgagcgcaatgccgggggta

SEQ ID NO: 591993 - DNA, 875 bp, Homo sapiens
  misc_feature (87)..(87): n is a, c, g, or t
  misc_feature (169)..(169): n is a, c, g, or t
  misc_feature (176)..(176): n is a, c, g, or t
  misc_feature (184)..(184): n is a, c, g, or t
  misc_feature (193)..(194): n is a, c, g, or t
  misc_feature (208)..(208): n is a, c, g, or t
  misc_feature (213)..(213): n is a, c, g, or t
  misc_feature (218)..(218): n is a, c, g, or t
  misc_feature (241)..(241): n is a, c, g, or t
  misc_feature (243)..(245): n is a, c, g, or t
  misc_feature (247)..(248): n is a, c, g, or t
  misc_feature (268)..(268): n is a, c, g, or t
  misc_feature (272)..(272): n is a, c, g, or t
  misc_feature (284)..(284): n is a, c, g, or t
  misc_feature (305)..(306): n is a, c, g, or t
  misc_feature (324)..(324): n is a, c, g, or t
  misc_feature (328)..(328): n is a, c, g, or t
  misc_feature (339)..(340): n is a, c, g, or t
  misc_feature (347)..(347): n is a, c, g, or t
  misc_feature (352)..(352): n is a, c, g, or t
  misc_feature (360)..(360): n is a, c, g, or t
  misc_feature (370)..(370): n is a, c, g, or t
  misc_feature (375)..(376): n is a, c, g, or t
  misc_feature (489)..(489): n is a, c, g, or t
  misc_feature (495)..(495): n is a, c, g, or t
  misc_feature (510)..(510): n is a, c, g, or t
cttgcaagaaacaataacaaacgggaggaggaagcgattctggggtttctgtgttgaacggttctgtccgcgaagatgcgcttcggnctctgtcaggggacttgaacgggcttagtgggcttcagccagcttttctccaccggttccccacggggaccccccccccccnggccgtngaaagggngggcgtggnngccggggggctacncggcnggagntcgtgccaccgccagagtgcccngnnntnngagccgagtggggaggagtncacnagatccgctcanttaatcggccgaatccggccnntgggcggagaaaaccggnatcngcaaaattcgnncgcccanggacnggcagccnccattggccngtganngtacaaagcttaccgtttcactccaagagtccacgagcctgaatgaccctcggaggcaaggaccagagtgacgatcgggatatctgggactacagctagcaaaattgggggancttcanggatctactctgaanatccctggggtaggacgagcaaaagtccgggaactacctgattctgctttgagacacacgatggttttgccagcaagcggaagggttctggcaaacttgggtccccccaaagaagaacagaatgtggctccctaacggtgggttagtccgccatgggggagtactcgtgccagggaacaagggacaccggcggaccctcctttgtccgaacagtacacaattattttgaaacaaccaacttctgatagcccctgatgtgagctttgacccaagtctgcgggtgttgtagcccccttatgggcttgttcacaaatctgctctaattttcgaactctttcaccgaaacaccgtggtcgaccgtaagt

SEQ ID NO: 591994 - DNA, 544 bp, Homo sapiens
ttttatgagctccacttggcctttattacaggcagatttttaaaggcaaaaaaggagggggacaaggattggactgatacaaagttctgccgcggattctcattgatttacagaaataacattgattagtgattggctacccattgttaagccttagagtgtgggatgttgtgtccagtgaggtgttattaggttaattcatagctacttgtggcaatagcaggcagttttgacagatgaatacatagctctaaagggggagaataagatgtgattgccgtatcatttgaatgcttctctgggcctaataatttgaaagagcccacattcctcgataaaagttcttttctttccttgggattaagttagatgataaatttacaatgtttagcatgccgatttatatgtattaagtattcataaagtgttattccatgtgctgagcgaggggaacaccctcccacgtgctcccatgagccctatttctggcagatgtaaagattttttttaaatggctttttttggccacatctaggaagtaaga

SEQ ID NO: 591995 - DNA, 797 bp, Homo sapiens
taactggatctgatctgtagctctttttaagtggtgaaagcaactgcattatgggattcttcaaattcagacatgaatgtgtattaaaatgtgtgtgcttacctttaatcctctccccaccgacaattaggaacacgtttcgtccgaattactgttggcaagattaccaaagaaaagttgtgaattagaatcccagcaccgggcacggggctcacgcctgtgatcctagcattttgggaggtcatagcaggtggatcacctgaggtcaggagttcgagaccagagggactaacatggcgaaaccctcgactctactaaagatacaataaattatgccaggcatggctggtgggccgcctgtaattcccgactactcgggaggctgtaggcaagtgagaattgcttgaacctgggagtttggaggtcacggggagctgatatcacgccagttgctactccagtctgggcaatcagagcaagaactctgtctcaagtcaatctatccatcaagcgataagaaccccagaattgtataagctacatgtgtttagccccctttttcaaaaggtatatgtgctcgcttggtagttatttcgaacattctggagttttgctacatatgcttttatcaagcctctttaattaaacatcattggcctgatttgagagataactggcgtgcttcccgataggtgtttgaatgtactgtcagtcgggtcacatcaacgcgtttaccggacaaattacaaaaaatacacatatttggggcgtcagctagaaattgaaaccaatggggg

SEQ ID NO: 591996 - DNA, 846 bp, Homo sapiens
tcaagggaaatcaattcttcaatgattgaaaaatctcagggccatcgggggccggggggtcccggaccggggggaaagtcgccagtatttgatgaggggctgaaaggttgcgttcccaaagttcgggtaagagctgggaaaccgctggccggcggggacgggggccccccaaggctggtcggggcccaggggctggctggtccgcaaagagcgcacaaggaagtgtacatgacgcgccgatagaggtccaggccagccgccacgtatgtacgccatcgctggccagaacagaacgccccgtgagccacacggaggatcatccccacgtattgggtacgccatctggattgggccacgcagggtcgaaaagtggtggcctcagggtacactggccgcacgggggtgccaggtgtaagaagggcccaagagatcgcgggggccaggacacctccattaaccaccacagcacacagctgctggtgttggcaccacagggcccaggacacctccggggagagaaacccttttctgagaatttgcccacgtggccatcccagcccagggaggccagggtaaggtaagagaaggggccacctcgggggggactaacttaaaagggtccaggggcgccagataaaagggaccatagccggggggggggccacgacgaagagcccataacgaactgcggtacagggcaaatcacccataaacatcgatgctgttaaacgggcaaaaaccacagcacccaacacttcatgggccacgtataacggttggggaccacaacaaaaaaaatccttcggatttcgcacaagaacaaacaagggcagtccctgtgacaat

SEQ ID NO: 591997 - DNA, 182 bp, Homo sapiens
aatatcgagccggaccggttgaccgtggcttgtgggttggacttactgtctgggagtagcagagatggaagaggtagaggaggtggaaggagaggcaggagaagccaacacactcagtgaatttgtttttatttttttgtagagatggggcctcagtatgacagccacggctcaaccctggt

SEQ ID NO: 591998 - DNA, 117 bp, Homo sapiens
ctgcttgtgacttagaggatcccgtctagcctcgccgtcgacgcgggtttcgtgttaagtgctgaccgctgtgttcccctcaacaacggctgcggctgctgggccaatggcacctac

SEQ ID NO: 591999 - DNA, 415 bp, Homo sapiens
tctgaatacctcatattaaatagaatcattaaatatgtgaccttttgtgtttagcttctttcacttagcataatgattttatggctcatccatgttgtagcatgtatcagtttttcattccttttcatggctgaataatatttcattgtaagtaaataccacaatttgtttctccattcatatgttgatggacatttgggctctttccaccttttagctattgtgaatagtgttgctatgaacatacaggtacatgtatttgcgtactagttttcatttcttttgggtaaatacctaggagtggaattgctgggtcatatggcaactccatgtttaacttttagagtaactgtcaaactgtttttcacagcaccttatatgtatactttacaataaaaaatttttaaaaacccaa

SEQ ID NO: 592000 - DNA, 732 bp, Homo sapiens
  misc_feature (245)..(245): n is a, c, g, or t
attgcccttcgttctctctttagctcggcttatcctatgggtgtgtttcgtccagatgcacacacgagtgaggtggctgatcgtgttatagattagggagacgacaatatcacagcctcggtgtggattgactttgctcaatatcttcagcagagatcattagaagatcttgtataattagcgagtgaagtatctgaatatgcataatcatgtgttgatgatgagtcagctgagactagtgacanatcactacatacactgtgtggagacaaatgatgcacagatgcaactctgcgtgagtgctactcgcatcacaaagatgacaacccatacctccctcgattagggagaccatatgttgatgagatgtgcactgcttttcatgacaatgaagagacatttttgaataaatacttatctgaaatagccagaagacatccttacttttatgccccggaactccctacctctgctaagaggtatcaagctgcttttacagaatgcagccacgctgctgataaagctgcctgcctgttgccaaagctgcgtgaacttcgggatgaagggaaagctccgtgtagcaacagagactcaagtgtgccagactccaatagttcgaggagctatcatagcatgggcagtagctggcctgagccatagatttcccatagctgagtttgcagaagttttcgagctagcgacagatcttaccatatccacacggtgctgact

SEQ ID NO: 592001 - DNA, 272 bp, Homo sapiens
  misc_feature (38)..(38): n is a, c, g, or t
tctacaggatccttgagtgggtccctgcatatcgtctngggagataaattgctgtatttcctgaattgggggacggcctacgcggccatcgaaataaacaaaaatacgcgagagaggttgctcagccttaggctgcggcagcttctttttgctcgcgaactgcagccagagtacgagccagcttgctggtagcgccttgaatcacgctcatcagctgcgaaatggcttcgtcgcgggtcggcagtgttgccagtacgtcgatttggttagct

SEQ ID NO: 592002 - DNA, 321 bp, Homo sapiens
ctatttccacaggtctaggtaggctcacacaaaaatgagtgacatatgatgcaggagaacatagcaggattatcatcacacagaacgacaaatggaataaaggagagagatacaattcaaaaaaataaaagatagtaagtaagtgataaaatggccattggtaaatccacggatttggtatcacataaacttacagcaaatagaatgataaacagttgtacaatttacacatgatcggacatttaaaatttcttgcatcagtaactggaggttctttcatatccccgtttaatactcaacttcttctagagtttaatggac

SEQ ID NO: 592003 - DNA, 119 bp, Homo sapiens
aacaaggcgcggggtccccttatccgtgtttgaccggctgacagggctgtccgcggtaaacgacatcttgcagtatttgtcagaactgtccggtcgtccggtgacgtcaatataccgca

SEQ ID NO: 592004 - DNA, 1015 bp, Homo sapiens
agggtctcactctcacccaggctggaatgcagtggtgtgattgtagcacacttggccaccaactcctgggctcaagtgatcctcctgcttggcctcctctgagaagctgggattactggtgcacaccaccacacctggctaattttttatttttttttatttttggaaatagggtatggctatgtgccttgggcccgtcatgaactcctagcctcaggtgaccctcccacctcaggcctcccaaagggtgggattacaggagtgagctactgcactgggccaacatgttaatttttttttttttttttggaaagtggagtctcccaggggggaatgcaagggtgcgatctcgatttcacgggaatcttcacctcccgggtttcgagcgattctcccacctcagcctccgtgagatagcgttgggattacaggcaccgttgccatcacgctcggctaatttgggtgatttggagcagagtagggagtttcaccatgttgggccaggtgatctggcactcccattccccccacatttcccaaagtgcggggattacgggcataagccaaaagccacctcacccagccaaattgttacatcttaattctgggatttctcacggcagggtgggggggcgaaataaactcttcaaaggctaatctgggatccctgtgaatcaataatctttacacaactgcggttcaaaatccctcctttcccttttccgagtaattccatccatcttattagaagggaaggaataggctgtgggtctgtacccctgccatctttcatccgtgtgaagggttgccgggatatagggggcttcagcgaaccgctacaacggctaaaaagggaggccggaatggtgccggaccacgtgtcggtttcgcttaaacgcgcgcctcgaaagcggcagccgcggttcaaccccgcgggcacacccggtcgcagcttaaaggggagcaggccaggagaggagggcacgggacctcccataaaagcgactatagtgcg

SEQ ID NO: 592005 - DNA, 213 bp, Homo sapiens
caagccctcgcgcagggtcgaccgggtggagaccacggccaggggcgcggcctcggcgatttcgctggcgagcttcagcgccgcggcccgcagctgatcttgcgccaccagctcatagaccaagccccaggcgagcgcctgttcgccagtgatgcggcgtcctgtgtacatcatcagcgccgcttctgctcgcagatcaggcgcggcagagtc

SEQ ID NO: 592006 - DNA, 135 bp, Homo sapiens
acgacacgggccgacgacggaacgacggactactggaacgacggacacgacacaaccgactgactgactgaccgactgactgactgactgaacgaacgactgagggctttacctgactagactgaccgactgacc

SEQ ID NO: 592007 - DNA, 1427 bp, Homo sapiens
ggcgcagcgcagcagccagtcgacgagatgcctatcgccgggaatggagtagcattactcctaggtgtgcagcgcaaggagcaatagagattggcgacatggtagtgagctggagacgtagccgacccacgtctgaacgccctggcacctggagggaagcctggcgacgacctcgaccgacgggaggaccctaggctgtcgcgaggacctagcgacccaggcgaacgcaccagtgtacccgtgggcgatccaccgcgaccttaaccacagagagagatcttgtgactccattggaggatgctgtgggcagtgacgtgcggcggcgatcgcctctgggatccgcgttactctggatacagggcgtcaccacaatcatcgtctatggcccctgagactgacgcgcgttgccgcatcgagctgggccacgtcatgatctactatgagttctggacgtctcgcggggctaccgcacaatagagggaagcactgccaaggatgcaagcctggcgagagggaacgcacgagagggcctcaggaagagctggaagcccccatgggcaggaatccccccggggagtgtttcctaactctattgggcacccaccgagggcacgagacgcaagagaacaacgttatgtgaccgaactctgcgtgcgtatgcgggggaacacaaccggaatactatgcgtggggcacggtacaacgccgcgagtcatggggagcgcgacgtaggggaccttggggcacaaggtcgcccgcggcgaagctccacccttgggccacggcggacacgaaagacaggcgctaagtgacgcaccagtgctccctatgtccccgattcacggccgaaccgaacgatagagcaacacagggcaggatctgtcgtgtcgacacccattcggtccggagacgcaatcatcaccgcatccacaagggcagacgacatcggctaacgaagggcgagcaaaagccccctgggccttatccaagcacccaccacatcgtgaggaacacggccggccaaaatactgcacagtgcgccatgtgtggaacacagccacgcgattcccaccaatacaaatggaacctctaacagcgacaagatgaacacccacacgccgacgagcgacggccgaagaacgggcacacatcaatcaggacggcgagcagaacgaagggaacctagcaccaaggaggtgtgacacaagggcgccattccggacttgaacggagctagttgtgcgcagggaaaaagtgtattacgccatactatccggtacacagttgtgtaccgccacctcgggatatgccatatgcggcgactgaccgaccaacaaaaatcgcacacaaggggggagcggagctccccaagtgcagaagttagtggcaacgaggcacagaattccaacgggcaatggcacaccatg

SEQ ID NO: 592008 - DNA, 598 bp, Homo sapiens
actaactgataactttcatttcacttttgaatttttacacttttcctgatcattcgtgtaaggtgaaactagacacgtttaaaagacatacacaaatctagtacatcaataaccggggatttttcttttttcgctatactatttacacaaccacgggtgtgcttgctaggcaatataaccatcacagaagcaaacgttaggcagaatagtggtaagaaaaaacaaagcaagaaaagagctaccagatatacagacaggcttggttccacattcactactgcattttcaagcgccaagtattaactgcacattttggttcagctagaaaggagggattgttttggtttggttttattctttacttttgggttagtttaacatcagtgcataaatttttcttttctcatttcagcagatggacaaacagatggactctacagctaagtggaatatcacaggtagaggggtgatactgtgagactgataggcctgactattctcaattctccccagtgcagtgttcacgcaacttccctgaatatagggtctccttaacacatctgggcactgcctggatgcgtgcactggaaaacctggt

SEQ ID NO: 592009 - DNA, 296 bp, Homo sapiens
tacacggatacccagccaatcaggacacagtgcacctctctgctccctgtgccccagctagtacatatgtctcttcttgctaggccacaggggcccagagaggattagtatcgacagtttcatcgatgaactgtaacagcatttacaatctgccctgcttgaccttcatcatctatcgtttgtcgttccctctgccaccttcctcctgtatccacagaaacaactgctgactgcaccgtgggaatcgagcccgtctaacctatcctcaattggctaggtaccgagctcaaacttcc

SEQ ID NO: 592010 - DNA, 932 bp, Homo sapiens
gtggcgggataagatgcggagcagttggtcggagatgtggcgagcggtgcagttctgtcatttccactctgctctgcttgcacagacaggcataagttccctggtcgtcccctgctgtgttcttcagtgacgaacacgtcagggggtcttcctccaatggttctccagaccccagaccacctgtgagagcgacaggtgctctctatctgcagtgtagtagggggcgccccatggctcctcgtgaggcctcgcttatgtcatggtcatgatggcacagtgtgagacagaggacgtgatgcagtgcttactgtgtgtggatgtgacattggggcgtcttatgagccaggtactctgaacggtacgggctgcatgatcgtccctgtgacctactggttgtgtgcaccaaattgttgtcgcttcggaggggctggaacgacgaaacatgaccatgtgctactttggatgtgtgactgtctctgccgttgttcactcagactgtggactgtgcttagaattgcgccgtggtcgagcaagcggagcccgtcaagaccaaactggcggggccatcttaccgttgacacgcattggtgcccacggggggctgtggtggcattctcattccagagcccgacctttgttgtacccacaccgcgaagattattaacgcccagggaactccattggcctgccgttgctttagaagcggacagggggacgcgcccttcagattaccgcgaagggtctttacccaaggggaagcggattggcgaagtaggaagcgttagggtagaccctctcgggagggggaacgtttcacaaagtgaccccaatccacacgcccaagtgtagggcattccttttgcccaactggtcaggttttctgtagactttacgccaagaaacagaactgttggcgttgggcacgggaccaa

SEQ ID NO: 592011 - DNA, 156 bp, Homo sapiens
tgctgagattacaggcgtgaggcactcatgcccagcccatgcctggctaattattgtatttttcatagagatggagttttgaaatgttgctcaggttgctcgtgaactcctgagctcaaaactctctatctgccttggcctcccaaagtgctggga

SEQ ID NO: 592012 - DNA, 217 bp, Homo sapiens
cccccccccaattttgggcccgaaggggaccccccccgggggggggggggaaattcccaaaaacccccaaattccccccggggggggccccccctttttaaaaggggggtggttccccggaaacccccaaaaaagggtttttttttggtttttttttaaaccctttttcccaaagggggggtccatttttttttaaaaaaatttttttttcccctta

SEQ ID NO: 592013 - DNA, 205 bp, Homo sapiens
ccccttctgtgtcggggttgaggcgtgagccaccgcacccgggcccttccttcgtcttagtcaatcctatcccacctcttcttccgccagtcccctcaccctgatggtcccaacatcttcatcatccagccatcgtcctggagggggtaccccgacggtgctccgttggaggactctgtctcattcttgtcagtgcgcgttgatc

SEQ ID NO: 592014 - DNA, 195 bp, Homo sapiens
ttgacatgatagaatcgagctcggtacctgttttgctacccacccaggtggtgccacccatatactctcctatcctcaataccttcctccacaacccattattctgttctagataaacctagctgaccccataaatcctaaatcctttccccactcccctttccattccttaaaaaacagccctaaaagctgctc

SEQ ID NO: 592015 - DNA, 171 bp, Homo sapiens
acggccaggagtacctgtgataacggggagtctcacgtggtggtgacttgaacgacacctgacagctggaagtacctgtgtgacggtggtctcaggtggttgagtgactcgacacacagtgaccgctggtagtacctgtgagacgttggtcctcgagtggtaggtgactcg

SEQ ID NO: 592016 - DNA, 625 bp, Homo sapiens
gaccccggtttccggcgggtctttcccgggttggtttgggccttgggctgttgtgggccccttggggggggtcgctttctgccgggcccctgggcctgggcccgtggttggcggtttgagttcggtctcccttagacgttgtgcttttgctgtgcggtggtgacgttagggtcgggcgccgttcgcctggtactgttcgttggctcctggagtcggccgtgcctgttgtccgccctccctggacttcgcgctcctttcattctcttcatttgcttcgagcacattgggttgtgtttccatcactcaccgctctttgagtcctctgctgccagggttctggtgccctgcgcagcgtctctccggttttcggtgtcagatccctcggttttgtgggatgctgccacgtccctggctcagcctgctgtgtccacgtctttgagtctcggagagcgagggttgctcccgcgtctggtgtgggttctcgtatggtggcatcgtgttgcccctaggcggagtgctgcgtgctttccggtggatcagtcgtggtgctccggcctagcctgctgtcccgtcataggtgcctgtcgcatatgtgcccgcccaaattctccaccgtccacgtgtc

SEQ ID NO: 592017 - DNA, 354 bp, Homo sapiens
ccggaagataggacctctgaaaattcaaaaagaagtcaactgactatactcaaattacatcacagttaatgaaacattaagctcacacagatgaaaaagaaccatcatgagaactctggcaaatcaaaaacccagggtgtcttctttcctccaaaagactgcactagtttctcagcaagggctcctaagcggctgaaatgacagaaacagaactcagaacatggacaggaacaaagatcataaagattcaagagaaagttgaaacccaatccaagaaatgtaaggattacagtaaaataatagaggaggtgatagacaaaatggccatgataagaaagaaccaaactgatctaa

SEQ ID NO: 592018 - DNA, 245 bp, Homo sapiens
ccccactcctgcagcagtgagatccggatcaccgaacatttctggaccccaagtgtcagaccattcacgtaaaaacttgagcggtctggcccatcagtgacacccacctcagctggcgtgatgttgacgaacgtcctcctcggggacggcggcccagacggagggcgactccttgtatcccacgatggccgcgtcctgacaggtcccgtccgccatgacgttgtcgatgataccgttgcactccg

SEQ ID NO: 592019 - DNA, 763 bp, Homo sapiens
  misc_feature (341)..(341): n is a, c, g, or t
actcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcggnggttgctcatggagcatcctgaggccgtgcagcagggagccccatgcccctgggtcgtgagcttgcctgcgtatggcgtggtgtcatggagcctcatgcccctgggtcgtgagcttccctgagtatggggtggtgtcatggagccccatacccctgggttgtgagctctcctgcatattcatgatctgtcatggaacatgccaagtctagtcatcattgaaccccattctccttggacatgaacccacctacttagaatgctttttatcaggcttctacacgctgtatatagtcgttttgacacacgaattcacaatttacacttaccgacacataaatcacatgttatcccatcctaacccagcttaaagacatccacatttgtactacttcccaagcacttcttttccattacatccacc

SEQ ID NO: 592020 - DNA, 934 bp, Homo sapiens
agaccagcttcttcacaggttccacgagtcatgtcaacacatgcgtgtggctaacacactcaacacagacaatgggtccacgtcctgcagctgcacgccgctgcagctactcctgctgtccgcaccgtctccacagctataaatatgctgcaggagttcgcaatcctcagcaacatcttactgcacagccacaagcttacaactgcaccagcctgctgctccatgtacacggctcaggaaccttcggactgcttccacgctcggccatctgcccctcctcacgagcacacagccaactgtccgcggtgaacgcgcctgtctcacctacattattcaagcccactgccaccctatctctctgcatggctcacacactccacatgcgccatggtcgctcgtgcagactcgcatacctcgcagagactctctgtctctctgcctcgccgctctctcggccgctcccctccgtcctctcctgcgctccgcctgcacgctctctctgcctgtccctccccagctcccacgacagcctctctgaggcgctgctctctacacacccgcacgccatacaccacttgtcctacttggcctcgttccccaaccttgttcctctccgcttggcatctaccgtgactcatgcctcccgcacccccttgcacgcattcactcttgcaccttccccactatcctctactcaattttgccaccaaccttcgaactctctccattcgcgcacgcactacaaaactcgggacgccagcacaacacacccccaccctgcctgcaccacaggccgcacggcaaccgctgcggaccaccccacgaataaacgagtgcccctcagccccgagccactcacccccaccatagagagaacaccgcagcaaagacacccccggcacccgtacaccccaagcgaccggccgaaacgcat

SEQ ID NO: 592021 - DNA, 107 bp, Homo sapiens
cacgtatcagggtactcctatacttgcacacgtctttgatgtcaattcttcttttgtagcccagaatgggatcggtttctcaaatcgaattgcgtgcacagaagtgc

SEQ ID NO: 592022 - DNA, 298 bp, Homo sapiens
  misc_feature (39)..(39): n is a, c, g, or t
  misc_feature (115)..(115): n is a, c, g, or t
caatcccttctccggtctggttgatgcatagcgatcgtnttggctatgaaacgcttggccgtatctggcagtggctaaaaggttcgtcaggcgagccacggcaagagtgattttnatgccagatcgaagttgcgccgactaaatcgtccggtattaaccagttgcgcaacttcatcccataacacatacaaccaacgccgccagatgaacgactccgccactgggcgcgttgcaggtaactccagagcaaatcttccgccagagaattatccattagtcggaacagttcgtattctcg

SEQ ID NO: 592023 - DNA, 682 bp, Homo sapiens
  misc_feature (28)..(28): n is a, c, g, or t
  misc_feature (94)..(94): n is a, c, g, or t
  misc_feature (105)..(105): n is a, c, g, or t
  misc_feature (125)..(125): n is a, c, g, or t
  misc_feature (162)..(162): n is a, c, g, or t
  misc_feature (187)..(188): n is a, c, g, or t
  misc_feature (201)..(201): n is a, c, g, or t
  misc_feature (204)..(204): n is a, c, g, or t
  misc_feature (207)..(207): n is a, c, g, or t
  misc_feature (210)..(211): n is a, c, g, or t
  misc_feature (219)..(219): n is a, c, g, or t
  misc_feature (245)..(245): n is a, c, g, or t
  misc_feature (279)..(279): n is a, c, g, or t
  misc_feature (294)..(295): n is a, c, g, or t
  misc_feature (367)..(367): n is a, c, g, or t
  misc_feature (387)..(387): n is a, c, g, or t
  misc_feature (407)..(407): n is a, c, g, or t
  misc_feature (425)..(425): n is a, c, g, or t
  misc_feature (444)..(444): n is a, c, g, or t
  misc_feature (507)..(507): n is a, c, g, or t
  misc_feature (511)..(511): n is a, c, g, or t
  misc_feature (574)..(574): n is a, c, g, or t
  misc_feature (588)..(588): n is a, c, g, or t
  misc_feature (632)..(632): n is a, c, g, or t
ccagttagcccacttccacctggtttgngaagacaacagagtttgccttcctcatccattactattgttaaggttcctgttgccagatgttccncctctccagtngggtcaactataagcaaagngtcatcaaacacagcaaaggaagatgcaactggatgngttctaatattcaaataactttccnnctttaaattaacnccngcnaanncagtttcntcatttatagtaactccaggcaactntccatttttcaaagccgctagcaaagcaaatgtncaggcatccaaaatnnttccatcgtagtcgaggcaaatcacatcacagtatagaacccagacaagctttcctggagacatgcataagncctctttctgaattatctgngaattttcaatgacatctgnaatgaattggctagccanttgggcctcttctccaggnggtccagatcggaatctcgatgaatacaggggtggtagatccacattaggtacaacggatccnttancaggggcatctgttgatggtgctgcaaattctgctttaactccacagattactgtagtatttnccaacttcactaangcagaaccatctgcggtactaattgaaccgatgttgacagtggnggttctgaattcaccaagttctcttccatcaggacggcagtcctctttca

SEQ ID NO: 592024 - DNA, 146 bp, Homo sapiens
aatttacgcccccgcccttgggaggatgataaatagggatcggtcagtgggaattccgtgcgaaaaagtggtgctgcgaaggactgagccgtcggtagtaatcaaactttagtgcacgccgggtgcgctgtctgcttgcttttttg

SEQ ID NO: 592025 - DNA, 260 bp, Homo sapiens
ttgctggggtactctagagatcccgtgcgccagatcatgctcatgtagcctcactggagggcattgcccggaagatcaagtcgtgctctggcaggcgcgccctggaggatgaggcactctgggccagtgcggggtggaggcctgataccctggagtagcaggcgatgttggaggtaaagtcatggttcctggcccgtgctggaaaagtgagaggtcagactcctaaggttggcaaacaggagaagaagaagaagaagaca

SEQ ID NO: 592026 - DNA, 230 bp, Homo sapiens
atcctagaggatcccagcaacatgggatcgagtcttcagtgttataactgcccttgaagtaagctggctaagcagaggaaaacttgttctgtgtatctttttaacccttaccccctgcacataatcacatctttacacttctttttttttttttttttttttaaaagaggggaagtcggattctcgctctgtcgcccaggttggattgcaggggggccatctcggtccat

SEQ ID NO: 592027 - DNA, 259 bp, Homo sapiens
  misc_feature (37)..(37): n is a, c, g, or t
  misc_feature (92)..(92): n is a, c, g, or t
  misc_feature (173)..(173): n is a, c, g, or t
  misc_feature (239)..(239): n is a, c, g, or t
ggacattaaatctagtatgtatacatgggtgggcatngaagagtaagcttcaaatatctacaaatttcactcacaggggagagaaaagttantgccttcatttatccatatgtgggttcaaagaaggttggacaggtggggtgtggtggctcacgtctgtaatcccagcactnggggaggccgagaggggcggatcacgaggtcaggagatccagaccatccgggccagcacagtgaanccccgtctccacagggtacc

SEQ ID NO: 592028 - DNA, 1297 bp, Homo sapiens
  misc_feature (510)..(510): n is a, c, g, or t
  misc_feature (745)..(745): n is a, c, g, or t
  misc_feature (747)..(747): n is a, c, g, or t
tggccgatctgatcccaattccccgaggagggtcttatattttttcttttccaacatcctgtcctgcggtctcccttggctcttttgcgcccgtatcgccagaaaacgccgggctgttggcacggcgccatacggaaactagcagaaggcttggaaattcttctcttcctcagtgatagactcgagctttctccttcttataaactgtcccgagacgggcatacaccggcccggtcagctggtgtggccatgttaccagtgtctctttcagcaagaatcgtgtctcccctttcttgggggcgccagagggctccctggggagaaagagagatgagactgtttggaacgcggaacttccttcagccgtctggcactgttggcgcctgcagggaactcccgtggaactttgtcccggccttcctctcggatttccaccaaaaaatgtcgccgatgtggtctccgggccaccttctctttggtgaattgccggcgccaccccgtagagcctcncctccaggctatgaaacgccggggccaggcgccgccacctttcgttgtgtggatacacagaaacccgttggtggcacgccgcaacaagattagtgcgccgtgagaagtgtgagcacccccagaacacgctggagtgcccgcttgtgtgagccagactagcgaggcagcgcgccttattggctttttgcccaggcggccctatataaacagtcatcgcggagacctccttatacgngngcgccccgggcttgtttttagacccccacttttggccaacgggccgccctggtatgccacaagtcccttttgtgtgacaacacgtcgtgggggggctttcaaaagacccccatttggcaaatatcaccccaggatatgtatggggccccccaatgatgatatgccacttaagcagggccccgtgggggggacacccagtgaccgccagggaaaaaacaggcccagaagcggaaaacagtgttgtgggccccggccccctcaccagcgggggtaaaccattctcaaaaaaaggcccctttggttgaaacacaagtaaaatcacgcgccggtagagaaaaagaaggaaatgtgccccggcccaaaaaaaaaaagaggcacgccaaacgcacgtagaaaacaacaaggcctttgtgctattagcgggcccaaaatattgtcaagagaaaccccggggaagaaaagagagcaacgttgagcaccaagaaattccctgtagaaagggagcgaaaagactattgaaccaactgtgtgtgacacaagttgcaacaat

SEQ ID NO: 592029 - DNA, 176 bp, Homo sapiens
ggtcgatctctagcaggatccccgtatcccagaaagctatgggacctcttataactaatgatagtcacccctgttcaccccaggattttatcggcttatcaattctgtacaacactatgatgataaattaatgataaagtataattcatgtaatgttcctatttgacttcactaga

SEQ ID NO: 592030 - DNA, 328 bp, Homo sapiens
ccaactcaccagaggcagtttgttttgagaacatgacaaagcctcatgacaaaatgaatgggggtggggccaaggaactgcatgaagaaaccagaaggttgtgtggaagtaagagaaaggatagcagcctagggctttaggaccgctggaaaccaagttgagttttggaaagattaagggtaaaaatggttcaggacctcaccgaaagatctttgtagacaaatgttaggctctccacatgggcttctgcggcaggactcaggtgggattctttggtgaggctctgctgagatctgcaccacctggcccccgtatctccctccactcg

SEQ ID NO: 592031 - DNA, 597 bp, Homo sapiens
ggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaccggccaatttttcaaacataccgtaaagattatttccagggtgccattttatagtatagcagcagggctttaactctgtgtttgcccagatgcagtctgggggcatggttggtggtgctgggactttctcaggggccatcatcagtatgcttatgggatttggatgacaggcatagcctggggcatatcacctcatggctaaaggggctagagcctttcttttttatgggcacttcttttttggagataggggtcttactctggtcacccgtggctgtagtacacgtgttacaattcacggctcagtgtaggcttaacctccgtgggctcaggtgtatg

SEQ ID NO: 592032 - DNA, 193 bp, Homo sapiens
aagaaggagatccttgagaccattcagctccccctgagcaccctttactattgagcctgggcctgaaacgctcaggccttttgctccatgggccccctggcaccggcaagacccttttggccaaggcagtagcccctgagtgcagccttaccttccctcaggtttggtactcaataaatcggtgtcccttcca

SEQ ID NO: 592033 - DNA, 286 bp, Homo sapiens
caaagtagacgccacacccggctaatttttgtatttttagtagagatgggggttcaccattttggtgaggctggtgtcgaactcctgacctcatgatccgcccggctcagcctcccaaagtgctgggattacaggtgtgagccaccgtgcccaacctgtattttttttttttccctctggggaatctggtagaatatatttggatctcagggctctgaaatttcatggggggggtgtctactttgcttagcatgggacattccttttcaatctagaaacccttgta

SEQ ID NO: 592034 - DNA, 631 bp, Homo sapiens
gttcctcgtctcggaggcagagaaattaactgaaggccatcagccggatagctaggctgatcacaaagtgctaaggttctgggttgcgaaaagagaatgaggctggttcttaaggaaaagactaccagagttaatctaatataccttcgtgtagagaagtgtttgctctaggtagatgttatcacagtatataagcagacctaaataatgagggatagatttgatgtaggaatcttttatagccaaatgagagaatgaaggggttgagggtgaggggggctgtgatggggcatgaggaagagggtcaatgagagtggaagaatgataggtccatagcaatgaattggtattgttgcttttactgctagccctttgtagtaacttcgccgcttctgagtgaaagatcagcaaggaaggacggatcgagtggtgtattccaaagtcaatatggaagctgtcatgtttactggctctcagctaagcaggcaaggatccatacactggatgttctcagaatgcctattggatgctcaggtgagtcggtaaacgatctagcatagggggtactgcgggtagttcctgtaagacagcagattagtgccatcacgcaatgatatggaaaagccctcag

SEQ ID NO: 592035 - DNA, 298 bp, Homo sapiens
  misc_feature (82)..(82): n is a, c, g, or t
  misc_feature (224)..(224): n is a, c, g, or t
agctagcgctgatagctcagtgctcagtacttactgttaatggggtaatataggactactcacaggcttcttagaattaatntatgatacgtaaaacactaagaatggtgtaagcagtgctggcactataatcctagtgctttgggagacccaagcgggaggatggcttgaggtcaggagtctgagaccagcctaggcaacaacactacaagaacctgtctctnaaaataaaaaataaaaaattagccaggcgtggtggcatgcatctgtagtcccagctgctcaggaggcagaggtg

SEQ ID NO: 592036 - DNA, 915 bp, Homo sapiens
  misc_feature (419)..(419): n is a, c, g, or t
  misc_feature (595)..(595): n is a, c, g, or t
catgtttagttggtccttatattccggttcagggaacagatgtgcatgattctcactggtccaggggtgctgccaaacacatggcatcgtacagtactctgaaattcactcacatgagagagagagccatgtgtctccatctgtctctgatcatctgcttgatatcatggtgtcgtgaacaagtaccagtacatgtaggaagggcagtctttcctcgttgtccttatactttgcgtgtctactagcatgtcgtcagtataataagttaccatgcgaattgctgtaaggagctaacctgcttcaagatggcttgggtctaacttttgggacgctggaaggaactccgtatgatcgagtgatcgtcactaagtagtctgaatatgatgaagtgtgcagtggggttgctcattgcgaatgtngagtaggtaaattctcttcagacgtatcatggaacgatgagtggacaggcgagggtacactgcagggttgtactcgtagtactagtcctgaactcagtgagtcgagtaggtattcttgctctcagagcacttctggaaagatcataatcgcatgagtgtagccgtgagagtcacancagtgaaatagtcatgataggtcagtacatgtgtcgatgtaggagcatgggctgaccaatggtcactttgaaggagtctagcttgccatagtgtgtgtagggggaaatgggaacaccactaacttgttgaatctcagtggtgaacatcatttacattcgaatttagtgagtggaacgcatattcatgtaaacctggtggcgtgaattagggtcaggtactagagggttagggttggaccattattaagggaagtgtggttagggattccttttccggtccagagttaattctctagaatagagattggatctgtgatgag

SEQ ID NO: 592037 - DNA, 437 bp, Homo sapiens
tgagtatatctgaagtatgttccacatctttgcattcaaaagacttttcaccagtgtgacatttctcatgtcggtggaagtctgccatttgaatgaaatatctgccacattgtccacattcataagatatctgaccactaggatttgtctgatttgtagtgagttgtgtgctgacgctaatattttttcctaatttctcaaacttctctccattcttgacctcataggcctcatggtgcctggctgaggtatctgtgaaatgtctcctctttgactttgtcttaattatccaatgaccttgtggctgctctaggctgctcccaaagtcaaggtgctgggaaacattccctggcaggccccccaccatcagtctgaaggactctgtttctttggacacatgatcctttggagttaatccttcctattagaactggctt

SEQ ID NO: 592038 - DNA, 401 bp, Homo sapiens
gctgttcttactcagcctgggtaatccagcccccatgtagtccttggctggaaaaggagaggagtgtcagattaattctgaggaggagcggagaaggagctcgcccctgagcctgaggagacctgggtagtggagatgctgtgtgggctcaagatgaagctgaagcaacagcgagtgtcacccatcctccctgagcaccacaaggacttcaacagtcagcttggtaggaggataccccagagagcacctccaatcctgttctttctaaaaagaggaaacttccaataaccacacttttccaatgggaaagatacgcccccagtggctgagctctccacgcaggaggactcagaagtgatcactcatgagggacacttaggagacgatagaggactaggcta

SEQ ID NO: 592039 - DNA, 221 bp, Homo sapiens
  misc_feature (195)..(195): n is a, c, g, or t
cctccattctgagtgacagagcagactctgtctcaaaaaaataataatttagctggtcatggtggttcgtgcctgtagttccagctacttgggtagggactgaggcgaaaggatcacttgaggccaggaggcagaggttgcagtgagctgagatcacgccactgcactccagcgtgagtgacagagtgagacccntatctcaaaaaaaaacaaaaaacaaa

SEQ ID NO: 592040 - DNA, 297 bp, Homo sapiens
atcgcccaagggagtgcgtgatgtgatcatagctcacgcggcttgacctatgggaggctgaggcagagacgataaatgtcttgagcctaggagttcaagaccagcctgggcaacatagcaagaccccatctcttaaaaaaaaagttagatcacctgagcaatacatgaatatgtgccttttattaacaccaaatgcaaataatacatataacatcaaagtcttcctgcaccagggctaccaggttctatcccttctctgtcgtactgaccagtggttatctgcgggggatcctctag

SEQ ID NO: 592041 - DNA, 194 bp, Homo sapiens
ctgttactttttaaaaataggcatttcatcttccaatatttctgttgtaggtaggatcttttcttcagcagattttctgacctgcggttgcagaatgaaatttggggatctctctgtccctctctgcatgcatccacctggctcccagcgtcccagctccttgctggtctcactgtcccttctgtcgtcttctc

SEQ ID NO: 592042 - DNA, 779 bp, Homo sapiens
gggcaactacacgccgctagccactgacccactacatgagcccacatgacgaagcatcggagagacagcttgctctgtgttgtcagaagggagattgaagaaggtgggcccagggtgctgttgacagtataggctcatgtgctgttccaaggtctcatctctggctcttgcctggtctggacataccatgtccacatccgctgtacttaggacttcctctgggcaccagggcagtggcctcaccaagacctggaggcctaatgatgaacatcatactggtgttcgctgtggcttgtacattcccatcagcagacatccgtgtacgggcctgactggccaacagggaagctccagcggaggcacacagtataacgctgcttggcggctacggaggatcagctggaaccctcttgttgaactctgcaccagtagctgaatgccttcacccatggcatgtattccctgtgggtggggagcgcgaacgctactgcagacctgacccactccaactgactctcccacacggacaaccaccagcacctcttagcagaactccctcttaaacacactccgctgagctgctgcccactgggtagtctgggacattcctccctgagcatacacggaccaggacagcccctcaacctctgctatccttatggcgctctcccagaaccctacccaggcccactggcggtgacgtctagcacgcacatgaccagcggctggtgaacgccgccatcctgcttaacctggccacttccccccgccgacccccg

SEQ ID NO: 592043 - DNA, 785 bp, Homo sapiens
taggcagtacgagctgggtggtgaaagggtgagaggggcggtggggctagggtggagagcaaagcacggatgttggacggaaccatcagccaggcaagctggacctggtggatccaggaagactcttctggaagaggtctctgacccctcccgaggcatacatgccgcagccccacgtgagcccaggagtaggggcctaagggcagggtaacctgtgaatgggctgtgtggttctgcaagaaatgtggagccggtggccacggaccaaggaggatgctggccctggaaggggacttcagaatgctacggggactagcagaccactactgggacctgaccccactaaggcccggcctgcatcctcatttgcccagcatccccaactacagcaaccttctcctctcaggccatcataccctggcttgcttgatagtggacaccatcaggggtgtgtccgggattggggtgaggcctgttacatatgcgcctgtatgactatgagggctcgaagctgaggatgacctcgccttcaccagagggcgagaagttccactagtcctgaacgatactgatggtgactggtgggaggctcggtctctgcagctccggagaaaactggctgcattcccggcaactacgtggccgctgtgtgactctattccatgctggaggagtggtactttggaaagatcgggagatggatgcaggagaggcagctgctttcggcatgcaatccccaggggggcttactcatcgggaaagcgagaacagcaaagggggctata

SEQ ID NO: 592044 - DNA, 668 bp, Homo sapiens
ggggcgagaagactcgttcctcattttagggagagccacacttatcactgctcacaatgagaggcgcaaagattaccgcttggcatccaggatctctattgtgccagacctggctaggagcctttggtgaagatcattactgttggagcggcacagcgcaggatgagcacatgcagatactatgatgacgaggacgaataggtgctgtctgtcctacggtcccacatagggctcctggagaatatccacatggagcaactgcccctacgccttgctgcaaggttgcaagggtcttcatggagactggcctatagctcgttagagcacggtaccaggtctaagacgctctaccggaaatcggtatcacttgacagctcggtcctattggtcatgaaggatatggttaatcagatattggtagcatatgcaactcatgctttaaagctcacagaccactattggcacatgcgaagcttggctctacacattcagccttcatgataagggctttaagtggagtgtgaagactctatactctatcactggagacataagttctttagaacttggtgctggatgtggacgatttgcctatggctagatgctgaattataccacggacgatacagatcttgcagcactttcaataatgacattctttccgtagg

SEQ ID NO: 592045 - DNA, 100 bp, Homo sapiens
aaaatgaaaattccccattagcgccttttgtggctacacttaggaattagaacttgcgggatcggctggtccgcgtgatgaacactcacaggggaacact

SEQ ID NO: 592046 - DNA, 583 bp, Homo sapiens
ggtcccacactcctataatcagtgtcccagtggggactctataggggtggtcaaccccacatttcccctctgcactgccctagttaaggttctctgagagggctctgctcctgcagtaggcttctgcctggacatccagagtttttccatacatcctctgcaatccatccaggtggaggcttttgagcctcaactcttgcgttctttgcacccacaggcttaacattatgtagaagctaccaaagcttagagcttgcaccctctgaagcagtggccgaagctgtacctggaccccttttagccatggctggagctggagtggctgggatgcaaggagcagtgtccagaggctgtgcagggcagcaggggctgggcctggtgcaggaaaccattcagtccttctagcacttcaagcctacgatgggagggtgatatggtttggctctgtgtcctcaaccagatctcatcttgaatggtactgccacaattcccacatactgtgagagggacctgatgggagataattgaatcgggaggcagtttcccccatactgatctataggagtggtgggggatcctctag

SEQ ID NO: 592047 - DNA, 213 bp, Homo sapiens
  misc_feature (103)..(103): n is a, c, g, or t
  misc_feature (118)..(118): n is a, c, g, or t
  misc_feature (120)..(120): n is a, c, g, or t
  misc_feature (125)..(125): n is a, c, g, or t
  misc_feature (131)..(131): n is a, c, g, or t
  misc_feature (143)..(143): n is a, c, g, or t
  misc_feature (152)..(152): n is a, c, g, or t
  misc_feature (165)..(165): n is a, c, g, or t
  misc_feature (177)..(177): n is a, c, g, or t
ctgagccactgtgtggggggattcggccagcgtcctgcgccactctttgggggggtatcggcccagcgtccctgagccactgtttggtgggtattggccagcntcctgcgccactgtntnggggntatcgnccagcgtcctgngccactgtntggggggtatcgnccagcgtcctgngccactgtgtggggggtatcggccagcgtcctgagc

SEQ ID NO: 592048 - DNA, 160 bp, Homo sapiens
  misc_feature (23)..(24): n is a, c, g, or t
  misc_feature (27)..(27): n is a, c, g, or t
  misc_feature (29)..(31): n is a, c, g, or t
  misc_feature (34)..(34): n is a, c, g, or t
  misc_feature (36)..(37): n is a, c, g, or t
actaccgcacgagttcggagttnnggntnnnggnannaggagatggagctgtgtcataggagaagggaggatggagctgtgtcataggagaagggaggatggagctatgccagaggccgaagggaggatggagctgtgatcagcaggagaagggaggatg

SEQ ID NO: 592049 - DNA, 206 bp, Homo sapiens
ccagcccaggaaggacccaggacacccggaagccggaaatggactcagtggcctttgaggatgtggctctcaacttcacccaggaggagtgggctttgctgagtccttccagaagaatctctacagagatgtgacgctggaaaccttcagaacctggcctcggtcgaatccaatggaaagaccaggacattgagatctgtacaact

SEQ ID NO: 592050 - DNA, 1357 bp, Homo sapiens
aagctcaaacttgggaaggaagatgacagttcctcagcacagttttgaacaatttggcacagcaagaatcccaatgcaaagtggtcagcccattttgcaccctggtatttgaagttgaagcctaaacatctcataacgataacccagaggcaacatgtactgacaggtaattccctgcaggcatgcttccagcacatcgtgcagtgcagcacagctcagcacccacacaacagcaggcatggttccaaacatcacggcacacacttcattccattttgcacttgcaggaacccacaccaaactcaatcgcacaatagcatctcgcatcagtagcacggtatagcaccgaaagcacgcatgtacagttcgcagatagcgcacacaagcacggatgcattctttcccatacttgcagcagctcggcgccttggcatccaccaaccacagtagtccaagcacctataagcagcgcacacattcaccctggcgacaacatgacagacccacgagacaccatgcgtcctgaccgatcgtcctatccccacaaaggcgaacgcatgcacacaggacagcacgctacagaccacgactagccaacaaaacaaacagggctacccaatgcacagggtgaccagcagcagaccagtttgcacactcggaacgcaactcagtatcgcttcactggggaacaacagttgcaagcgagtacaacggtctaacgcgaacccagtcaccacgctgggacacaacttgccttctgcacacactgcatgtaagagctttatctcaaaccccacagaattaggacagctggccacgacaattcaacccaacaaattggaaccacgtagcacggcatagcgggagcaccaccgctctggaccacagctatgcacttttcattgcgacgtaaacatgaaagccccatatgcattggcacacccttataagacccggacactataaaacttggaggcacgtcccaactccctggccatatttatatccatggatacacccatgagacaatacggcgcaaaccaaggcccgtgaagaccactgtaaacacgagagaaccaccacaaggagcaaagcaaaaacgtgacaataaaaccgacgaccatacccaatgtccaaacacgcacgggcacaagcacaacaaaaagcccacaacaaacccacaacacgtacaaacaaaaactcaagagcaaccgacaaaaagacaaacaccacacaccaaccaaagaacacacgaaacaaccacaaaccgaaacaagcacacacaaaaaaaagccaacacagacacacataactacgcataaggagacccaaacaacacaaccaacaggcagaaaaa

SEQ ID NO: 592051 - DNA, 221 bp, Homo sapiens
gctcgacttttttttttgacagaatctcactctcgacgcccaggctggagtacagtggggtgatctcagctcattccaacctccgtctcccaggctcagttgattcttgtgcccttagcctcccaagtagctgagactgcaggcgtgttccaccacacccagctaatttttttgtgggtttgttttgttttgttttgtttttgtagttttagcagtcgacg

SEQ ID NO: 592052 - DNA, 130 bp, Homo sapiens
gcccgatatgtgatgtgaaatcaggcagcggtacagtgagatcccaggatgctttgtggtgctatttcacctttgcatctcccatgaggtccacgtgtacggttcggctctccaactaccatcagcttgg

SEQ ID NO: 592053 - DNA, 137 bp, Homo sapiens
cggaaatttgaaaatatattcacgaagatataacctctgaagacatttgagaaatcttatttgcaaaatctttttatgaagaatcttttttcatgtacagaaaacaggcaaataaataggaactaatcttaaaacat

SEQ ID NO: 592054 - DNA, 888 bp, Homo sapiens
gtgctgtgtggtccgcccgggtggggcgcgacgagtagcccagttctggtggcgggggatgggaacccaggagcggggtgaccccgtagtgactgccgtggccctccctctccccgtacttttcccccttcccagtcatttcttctgcggaacctccaccccctccagtgggtgcagtgtgaccctagtgcatgcatgtgccatgggcacctgccagcatctgacattggagtggccccatggaagacagttaactgttgccaggacatgcaaaaagtggaaaagccaggtagccatcttgtgtgtggtgctttgtgtgccagtggagtctccgtgacaagcatgagctgtgtgaggcttcaatcgtgctgcgttggaccaaacattggacatatagaccacattagaccaaagtgggcatttcacaagacactgcaagggccagatcaaattgagatagacacaacaaaggataaagttgggctagaatccacccaagaacagtaggacctagggcacaaacatgtatatcattgcatctcatgtgaatgattggtgaggagtgaaatgtttgacaccccacaaaacaagggaagacgggaagcaagacacagatgatagtgcatctatccttgtgctgtagaaagccacacaatcatcccctaccatccctgtgattgaaataagggcgccagacaatttgaggacctgacaacatagcagagtgtccatgagcggacgagagtcaccaatcaatggctccaatgagaatgaagctgttcagagtaacaggacaaacacaaagggacaacacgataatagaacaaaatccaagacgaagagaggacaagaggccactcgagtataaaaagaagcaaaccagataag

SEQ ID NO: 592055 - DNA, 1111 bp, Homo sapiens
  misc_feature (598)..(598): n is a, c, g, or t
tcaggaaatgccagcagcccacaggtgcggggcgaggcggggcccctccccttctccgcacccaggccgagcagccacaagatggaccaaggagccgcaagagcattccctgaacccttctccactgggccgtgattctcggcagcgagcctccaactgcggcaaccctcgagtctcagtctgacctccgagcccacccagagggcccgggcgactgcaggagggccactgctcctgcccgcggagctggagtggggcccagagacagagactggggtgtccaccaggagactcccaaggctcccagaccggagctccgtacaaaccctggagggcaaagcggggagagggagccaagatgaagagcccaggagcctggagagcaggaaccctttgtctgaggaagctccaaggaaacggaggggactccctgaagtagattccttcatgtcttcagggtggctttttatgctaagccccacctgggatgctggtgtgctgaagcatttagggagctggcccagcagagaggatgcagggaaagcctggggatggaggccaggagaaccacagaccccaccatctgagagcctgaaancaacaacaaacttgtggccaaagcacagtgggtactgggtttgtaccaggagtttctggctgtataacaacccacgcttgtgggaaataatccatcccctcaagaactaatccagtctcgccagagcaagatctcactcacgaccaggagaacagcaccaagcagcattggggaagacccaaccccatgaacccaagacctcctgtcaggcgccactccaaaacaacacatgggggatcccacttcacccagagtttgggggggcgcacaaaccttattcaaacatggcatggcatcggcgaaggccgaaatggaagcccagagggcgccctaaagtaaggcccgttcgccgcgacaaatcaccgagggacgccccctggtgttgaccttggagacacggcacgggaaagacggtgaaataagaggagagggaaaggcggacacagccgccgcaaacaaaaaaacgtctgtgcgcgggggagggagagtggcccagagcagcggagagcaggc

SEQ ID NO: 592056 - DNA, 192 bp, Homo sapiens
gcctccattctgcgcatctgagatattccttgtagatgcttcctgagcctcgaagagcttcttcagcttcttggcttgccttttggctgagtctttgccctccatgtcatgtgtgggcgaccatgcttacattttcatcaaacttggagtatttgtcggtttctgacaagaacatctcattgtgggggaagg

SEQ ID NO: 592057 - DNA, 418 bp, Homo sapiens
agatcgctgggactacaggcagttcgccacacgctggctcatttttttttttcagtggagacggcatttcaccgtgttagccaggattgtttcgatctcctgacctcgtgatccgcccaccttggcctcccaaagtgctgggattacagacgtgagccaccgcgcccagccaatgaactattattgaatgaatacctcattttccctctgggcatcacacctgagattgcctgattggtacgttgtcctcagagccagcatttattacattgcatttgagagtcgctaagaccaggcattttccacacgcttttcctgtttaataagtaccttccaaccttgattggctgataacagccgttggctcgtatataatgctggccttcgcaatgatacagcaaatggaatctgggaggaa

SEQ ID NO: 592058 - DNA, 81 bp, Homo sapiens
  misc_feature (1)..(1): n is a, c, g, or t
  misc_feature (16)..(16): n is a, c, g, or t
ntaagaaagcagtcancaaataattaccaagggcaagtcagaagttgtttataattacaaataaggcatattatgactctc

SEQ ID NO: 592059 - DNA, 164 bp, Homo sapiens
gacaggaggcgggagaccccccctctttcccctggttgccaggtgttctccctctgcaggctcctgggacagtgctgattagcagagacttgccgtctgacgcggggacttggattatggcaaaggggctactgggaagccggttcccctgagtttgaccagtt

SEQ ID NO: 592060 - DNA, 1878 bp, Homo sapiens
gtgactagccagggttgtatattgtgaaacgcaggcagtgagttattctccgtgcctgctgtcagtaggtctatctcattggaccaaccacgacagtgatcgttcacctctcactaacgctagcaagcgcaattgactataatactctgatgcgacgcagatgtcatcacctagtacaatactgacacatcaacacatctcaaggtgcactccactatcaagcatgcatgagcaactgtcggactacccagacactcaatgctaccagacgcagcacatggtcctaaacaaagcattagggtcgctacaaaccgcactagctcagaatatgcaaattggcatgtgggaagacatttacgtgactagggaaactggatagatatacagattataaattaacaatatggagtaaatataggatatcattcatagtatcgaacttaaagatggcaataggtgcgaatataacgagcataatacaggaacttaatggaaatgcagcaggtaagatttcaacactaacttacaaatccataacaaggcgcaacagtatataagaaagttcacacctacaccgtgagaaccaccgaacgattggacaacatacgcacatgtacaacaccccatttaacaagcaccatgcgataccccccacaaacagccatctgaaaaccttacccgatgcaatcggatacaacaaaaatatccgccgatttaacagtcacctccagctcacatacaccccatataatcacggcacgtgagaacagcgggccaactcacacggaggatcaactccaccacaaccatcaactaacaatcccacactcacacgcaaccacacagcgacacggccacactccacccacgattcacaacattaaccacagcatggccaaccaacagaccagaacacaccacacgaaacaacgcgcacactcatagccgacaccatctcacccagcttacacaactacaccacagtcacgacagaacagccggccaacgacaggcgactgacacaacagacctatcgaccaccgagccaccacaggagacgaggcaccagccgcatgtcgactgacggacgacgcacgactaacagacgacagcagagcagcaacgaaccaccacgacagacgacgacacacaacaaccagaacaacacatcagccacaaccacacaacaactacgatcaacaaacgacacacaatagacacgtgaagataagccacgcataacacagcaggagaatgaaacacacaacaacaaagcaacaacacacgacaccaagctagcaacaacacaccatgcacggtgccagacataacgcagaaagaggactacccactaaacacagcggaacaaccgctcagagcatacaactcacgcccaacaacacaacgtagcaccatatccgcgaacagaaaaaatacagcccaacaagacacaagcacagcacaaaaacacacctacggaagtcaacatgaatacagcacacacacagtgaggagcaagcagaagcacagagcgaccaaagagagagccgaacacacacaagcgaacaacacgactggcaagcaaaacagagcaaagcagcgcaagccacaagcacacacgcaaagcacaaagcagcgaaagaacgagctgcgcacacacacacaacacaccaccactgctgaccgagcccgacaagacaacgcgacacaagcctacgcaccacacaccatccgaacacgaacaggagcgcaaaatacaacagcagcgcagcacaacataaccagctagccacgcgcgacagacacgacacgaacacagcaacacaaaagacaaagatgaagagaaacacacgcgagactacaacccactaccgagct

SEQ ID NO: 592061 - DNA, 318 bp, Homo sapiens
gggacagacagggagaaatggacagttgaaagtacaagtctagacaggcacagtggctcatgtctgtaaccctagcactttgggaggctgagataggagaattactagggttcaggagtttgagacgaacctgggtgacatagtgagagctcatctctacaaaaaataaaattagctcggcatggtgctgcaagattatagtccctgttagtcgagaggctgaggtgggagaaccgcttgagcccaggagggaaagcagcagtgaaccgagatcacgccactgcactccagcctgggcgacagtgagaccctgtctca

SEQ ID NO: 592062 - DNA, 661 bp, Homo sapiens
  misc_feature (15)..(15): n is a, c, g, or t
  misc_feature (69)..(69): n is a, c, g, or t
  misc_feature (76)..(76): n is a, c, g, or t
  misc_feature (86)..(86): n is a, c, g, or t
  misc_feature (194)..(194): n is a, c, g, or t
  misc_feature (222)..(222): n is a, c, g, or t
  misc_feature (259)..(260): n is a, c, g, or t
  misc_feature (262)..(262): n is a, c, g, or t
  misc_feature (278)..(278): n is a, c, g, or t
  misc_feature (296)..(296): n is a, c, g, or t
  misc_feature (301)..(304): n is a, c, g, or t
  misc_feature (318)..(318): n is a, c, g, or t
  misc_feature (321)..(321): n is a, c, g, or t
  misc_feature (337)..(337): n is a, c, g, or t
  misc_feature (360)..(360): n is a, c, g, or t
  misc_feature (416)..(416): n is a, c, g, or t
  misc_feature (424)..(424): n is a, c, g, or t
  misc_feature (488)..(488): n is a, c, g, or t
  misc_feature (505)..(505): n is a, c, g, or t
  misc_feature (564)..(564): n is a, c, g, or t
  misc_feature (576)..(576): n is a, c, g, or t
  misc_feature (578)..(578): n is a, c, g, or t
  misc_feature (644)..(644): n is a, c, g, or t
ggttggaggctcagngccccctccggttagcccggacgtcccccccaccccgcccccgccccgcatgcnctgactnctttggggtntgaagtgcactgccccgcacctgcgccccagccccgcccagcgcttctgccgtggttccctggtgccgcctcccgcttgccgaagcgcaggccgaaggagtcccagtngtagttcggcagggccttctcccgctgnaccagcgccgcgccctggggtgcggggatctgggggnngngggggggggagagggncgggtgcggggggctccnggagnnnngggggggggggganagngagggcccccgagggntcagcctgggagtggcagcgggnttcctctgggtgcacgggagggtctgctccccgggggccaggaggcccagggattntagctgcnggcctgtgggtgtagaattccccacagaggccaccttttctaatggctccccaaagtgggtggnacaaaggaaaagcagtngctgccaagaaaccagttagtgcatcttggtgagaagaggcaggtgctagaagtgcctngaggcttgcctnanttctggcctgggcaggagtttggcggagctccttaggtgacgagaccacctggctgggtgaatgtncagagggtgggcagctg

SEQ ID NO: 592063 - DNA, 605 bp, Homo sapiens
ttaaatattacatctaggctgggcactgtggctcatgcctataatcccagcacttagggaggccgaagcgggtggattgctagagcccatgagttcgagaccagcctgggcaacatggtgaaaccccatctgtactaaaaataccaaaaacattagccaagtgtggtggcctgcgcctataatcccagctactcaggaggccaagatgggaggactgcttaagcctggaaagtagcgtttgcagtgagccatggtcacgccactgtactccagcatagacgacagagtaagaccctgtctcaaaaaaagaaaacaagccgggtgcagtggcttgtgcctgtaatcccagcactttgggaggcccaggagggtgaatcacttgaggtcaggagttcaagaccagcctcgccaatatggtgaaaccccatctctactaaaaatacaaaaattagccaggcatggtggtgcgtgcctgtaatcccagctactcaggaggctgaggcaggagaatcacttgaaccaaggaggcgcaggttgcactgagccaagattccaccacaccactgtactccagcccaagcgacagagtgacattccctctccga

SEQ ID NO: 592064 - DNA, 447 bp, Homo sapiens
  misc_feature (330)..(330): n is a, c, g, or t
  misc_feature (423)..(423): n is a, c, g, or t
  misc_feature (434)..(434): n is a, c, g, or t
aattcgcgccatttctcctgcctcagccccccgagtagctgggactacgggcgcccaccaccacgcccggctaattttttagtatttttggtagagatggggtttcactgtgttagccaggatggtctcgatctcctgacctcgtgatctgcccgccttagcctcccaaggtgctgggattgcaggcgtgacagccgtgcccggccgctaattttttgtatttttagtagagatggggtttcaccgtgttggccaggatggtctcgatctcctgacctcatgatccacccgcctcggcctccccaagtgctgggattacaggcgtgacancaggcgcccggccccgcactcttcagttcttgagagatcagggggctaaaggactctttgagtttgtagagggattcagggttttccagtgtnccctttcgtgnacccagcatttta

SEQ ID NO: 592065 - DNA, 1563 bp, Homo sapiens
  misc_feature (1563)..(1563): n is a, c, g, or t
cagaactgctgactagagatgcatacgtgacaacacacacttgtcccaaatgagcacagtaatgttcgtctcggaccctgctccatgtctctggtgtctgtgtgcatgatcatgttactggtgtggtctgtctgtcttggtgggtactcaccgatccaaggcactctagtacacaggctgttggtatcagtctggctggtcttctctctgctcattctgatagtcctccttcgattcaaccaataactagcagttgatgatatgtacattaagtcaagatataagagaagatatatagagacatatgcgagtgcgtctcgcgatgcgagggtacgctctactctccactgtccacggtgtgtcccaaagtccgatatccccccgagtcatgctaagcctttctttcgcggtctcacatctgagggccccgctcaggacgccggcacgtactggcaatgttagataaacaggttggtagagacccaagggcgagccagggggtcggctgctaaaccatatcggagttgcaggttccccggtgtgtgtcacaccaactctgagtgccctttccgagtgtcaaacctccctagtgttgggacaccgggtgacacactgtgtatcttgcgcgtgagtgagggcctgaaacacgtgaaactctgttgtgccccttatacacctttccatctctgggatacagtataaaaggatgttaaataaggccgggccatccaaagaggaggagccccatagattgaggtgaaacaattgggtgctggtctccaggaactggcagtggtttttataaccgctgcgtgtggtggtgcaacacaacgcatacgggttttccaacgattgatggtccgctccaagatatgggttcttaaagccataacaaagggtctctttgcgaaataatatctttgcgaaaagacttatgttagcaatggtgcctctccttaaaccacaataatgtacacaaccactccgggcaaggagggacctcattatttgacctgaggagaactaggggaactatctggcgcttttttaaggggctttacccccccattccttggggaaagggctgttggtccccccaaatttggacctatggggttacttaggggagcagaaacaagcaaagcaaccccttattattccttggacatttttatggcgcctttttccaaaaccaaaaaaaaaggttaacacatgggttgggtttgtacctcctcgttttattaccgccccaaacaccacccagtattgtggcccgattgggaaaagcccccgattccacaggggagaaggattccacaagcccattaggactattatccccaatttcccacattgagggggttggtggagggaaaacagaccatcttcacaagagcaacaccacacactggcggaacacagggcactttcaacattcatcttgtggatcacaagggaggcacattttgttgttagtaaacacaaggaggctctaaaattcaatcggttgctaactcccaagggtacccaggcgcatccggttacaggaggtttctcccccan

SEQ ID NO: 592066 - DNA, 108 bp, Homo sapiens
  misc_feature (37)..(37): n is a, c, g, or t
attccggcggctggctgggttctttggggttatttcncgcatcatcctcgtcttctccctcctcgtcaccttctaattcctctctctctccccagcacaacctgggac

SEQ ID NO: 592067 - DNA, 332 bp, Homo sapiens
  misc_feature (57)..(57): n is a, c, g, or t
  misc_feature (174)..(174): n is a, c, g, or t
aaaccctttttaaaaaagacccccccccaagttttttggttggaagggccccccccnaaggttaaatgttcccggaatttaaaaaggcccccggagtttttatgccccaaagccctttttttcctttttttgaaaaccacatggggaccaaccgatcggaccgtttttaaggtnctgggggggggaaaaaaccctctttcttttttcccaaaagctgggcctctattttgggatggaaaatggggttggggatttacccctttattcaaaggaactttttttgggatttttttgcctttgaccccccctgttaataaaaaaaaaagggttga

SEQ ID NO: 592068 - DNA, 121 bp, Homo sapiens
gagagatatgttggtggaaatgcaggatgattaaagggggcctcatattctctaaaccagctctttcatcagcacttactgacatacgaggtttaagagtgtgcataccactatagtctat

SEQ ID NO: 592069 - DNA, 161 bp, Homo sapiens
tgagcacagaccactgtggaatgagacaccaaaggggctgcgttgtgtggtgttgatgagagatggagagaaacagggagagatggtgagagaggcagagacagaaggagagagacagagagagacaaggagagagaaacagacagggagagagagagact

SEQ ID NO: 592070 - DNA, 169 bp, Homo sapiens
tacaaaaagttttaaaaccaggtatggtggtgccctcctgtggtcccagctactcgggagtttgaggtgggaggatcaccttagcccaggaaacttagggttcaagtaaggtgtgattgcactattgctctctagcctggaaaacagagtgagaccctatctcaaaaaa

SEQ ID NO: 592071 - DNA, 726 bp, Homo sapiens
  misc_feature (250)..(250): n is a, c, g, or t
agcgggggttctttccatcgagcgtgctggaacggaggctgcctaccggaggtcggcggggggatgtaacccgttgactgagctggcgggtcggtgtgcgctagggcttcggacgggtgggtgcggcgaataatctgccatggatcgatgcgttctatgatattcccggctcttctggggcactgggtcgcacgctaaggtgccacgatctctgttgctacgctaggtcgctgacggcgtccaaccgagncggtgagctgtcgacaaaaggtgcgaccgagtcggacggttgcgccgaagctcctcgattgggcagcggcgagctgaatgccccagccgccccagctcgcgctcagccgtgacgccgtggggctgaatattctggatgtgggagagagtcgacaatttacatgcaacctcagtgaatactctcccaagatatggtattggtccatgatgtatcgcagggttcttcttcagcgagaatatactatgcgcctggtaacagagtctacgataattgggggatatatcagtttgattgatatatggtggaaatatatattgcaatagcatacagagatgtacgtggtagtaagcttgctatataagtgttccctgtggaaggagatttgaaaatctcagaattttgaggaagaggatggggatcgtagtcgataacgttaacatatgagggtgggaccagaggttgaatcaaaggaaggg

SEQ ID NO: 592072 - DNA, 404 bp, Homo sapiens
ggtcggcccgataccgtgtatttccttctgtcttgctgtgctccccctgttattagtccattctcacatgctataaatacctgagacagggtaatttaaaaagaaaagaggtttaactagctcgcagttctttgtgctatacaggaagcatgatgctgtcatcttcttggtttctggggaggcctcaggaaacttacagtcatggtggaaggtgaaggagaagcacacatctcacatgactagagtgagggcaagagagagagcgaaggggggaagtgccacgtactttgaaacaaccagatcttgcaagaactcactatcataagaacagcaccaacacgatagtgctaaaccattcatgagaaatacgtccccatgatcttgtcacttcctgccaggaagta

SEQ ID NO: 592073 - DNA, 258 bp, Homo sapiens
  misc_feature (190)..(190): n is a, c, g, or t
acagaatcacttatccttaaagttctcttctggtctttggattataaaaggcttatgttagcatagcttaagagcaaactctgagacttgagtccctactaagataactgaccacctgtttaggagtgtctagctatctggatgtgcatcttattccctatagttcttgtcgtgtcactagttctagccntgtttctggtttatagccctaggagctcacttacaaaggactcttaggactgtacttttgcttactag

SEQ ID NO: 592074 - DNA, 816 bp, Homo sapiens
gaggaagaaacagcggcccaccccttgaaccccatcgatagagccacgtggaaatgagcggagagcccgggagggagcataaggggaagggagagaaaaggaaacgaggtaggcaaagaatgagaacaacggaggaaaaagggggaaaaaaggggagaaaaagggggacaaagaggaaacaaggaagaggacggaggcacgaaaaaagaaagggaaggaaaagaaaagagaaagggaaaagagaaaaagagagaacaagggaaagaggggagaaggaaggaaagcagacaaagggaaaaaagaaggagggaggagaaaagagagagaaagggaagaaacagaagagcagggagaacgcacggaagggcgaagagggggcgagaaacgggagacggacaaggcaggggggacaacagacagaaaaacccgaaaagaaaaagcgaaggagagagaggagcaagggaggggaagcgaaggaaggggcatgagcaaaaagagagcgaacaggcataaaaggcacaaaagcaaaatggcagaaagaggagaaccgaaagacaggggggcgacaagaagtaaggcgaggaggaaagagaaggctgaaaagcggggggaagcaggagaaagggggaagatggcgcatacagggcgaaatagaaagacagcagagacacccagaacagggggaaaaagcgaaagaagacagccaagcaagaaaagaagaaaacaagcggatagagaggggacgaggacaaaatgacaaagatgaaggcaaggggatgcagaagcgacgagaaaagcaacgagagacgggaccgc

SEQ ID NO: 592075 - DNA, 574 bp, Homo sapiens
ttccaggactgctgcgcttcggggcccaggtttcgacagactcttcaaaatgccatcccaaatggagcacgccatggaaaccatgatgcttacgtttcacaggtttgcaggcgacaaagaccacttgacaaaggaggacctgagagtgctcatggaacgggagttccctgggtttttggaaaatcaaaaggatcctctggctgtggacaaaataatgaaggacctggaccggtgccgagatggcaaagtgggcttccagagctttctatcactagtggcggggctcaccattgcatgcaatgactattttgtagtaaacatgaagcagaaggggaagaaataggccaactggagcactggtacccccaccctggtgcgtgttcacccacggggtcacttgaggaatctgccccactgcttcttgtgagcagatcaggacccttaggaaatgtgcaaatgagatccaactccaattcaacaatctgagagagaaaacttaatccaatggcagagaagcttctgagttttatattgtttgcatcccattgccctcaataaagaaagtccttttttt

SEQ ID NO: 592076 - DNA, 312 bp, Homo sapiens
actagggaaattttaaaattaggaaatgctgatagctcatattataaatttttaaatcctaggaaaaaacgcttggagggcttttgaaaaaacaaaagttccctttaagggcaagtttccccgtagatggatcaaaaaactacccactgtaaattgagatttaattccccaatgtattttacttgttttaaaacaatctgtccccaaaaataaaactataagtaataaattgttattttcgcccaatgggaatttttaatgtgaaaatgtattttatgaaaaaaatttttttaaataaaatgttatataata

SEQ ID NO: 592077 - DNA, 187 bp, Homo sapiens
  misc_feature (133)..(133): n is a, c, g, or t
  misc_feature (161)..(161): n is a, c, g, or t
tacaatagtccatagtatttattctgtagaagttatcaataaaaaattgatactaaaaggcctttacatagagtctgcgttcataaaaccttgtgtgtttttttgtccatttggtttttaggtgtttacattngaaaagaaaatccagtccatccccttangtttacatcatttatcaggaatcgtg

SEQ ID NO: 592078 - DNA, 362 bp, Homo sapiens
gccctttccgaccggccccctgggtccccaggttttcagctttcccctgggcccctaacccttctgggccggggtgcctgtttgacccccgggcctagttgtggctttcccttttgtttcctccccgggtccccaatgttttcagtgggggggccccttttggggcccctcctttgccctccccttaagacccccccccccaaccctgaatgttccctgggcctgccccctcgggccccccttggggccgggttttactcaactcagctccttttacggtaatttttccggccaaatcccctggttggggtttgttttttcccctggtacgcctgccatccccattaagcctttaaagtcca

SEQ ID NO: 592079 - DNA, 595 bp, Homo sapiens
agcggaacttaatactacgcttcaaagcataatgaatgggataccttactttcagcccaaatcggaagcgccttaacatgagagaactgagcccccacaccaaattttattccctaacgccaacacgcccacatctttcccgaaattatcccgcatactgatgcccaactttaacgcaaaccctatcctgaccactctttcacctgacccaaaccaccatacctgctccgaaacagacttaagtcagacaggctggaagctacatgacgctgaatggtagggaacgtggcaaagccaacaatatagggagacacgtaacagttcttacgtgacaagggaggactgcaggaactagtgctacatgactgtggaaaacataaaaaagagctgcattctggccagtacgtaatcacctacctagcgagatgcgatggaaatgggcacacatgctaactgttgtcaactgacactatgcctctagaggagctgcagattgaggtcctgaagcatagaaaagcaaccggacatattgatatgcactaccagcttaggctacactatgcatactctgatgactggagagatgaccaatgtg

SEQ ID NO: 592080 - DNA, 1629 bp, Homo sapiens
gttctcccttgtctcctttgcttcgtcttcctttcccctttccctgcctgtcttctcgtctcttttcgtgtgtgggcctcgttctcctttttctttcgtttcttctcgcgttgtgttcttcgtcttttgttctgctgtggttgctgttcttctgttgtttctctgcttttcgtcctctggcttcctcctctctgtttctcctttcttcttctgtgtgcgttcttttttgcttcgtgctttgtcctcgcgcggtttttttgtctttcccttctcgccattggtctctccagtcgctgtcttctctcgtgcgttcccgctctccttgttccctgtctccctctccttcctctgtcctgccctcttctgtctctgttcttcctccgtccttcctcttcctccttctcggcctgctcgctcgtctcgtcagtctcgtcttcctctcttccctttcttctgtcgcgtctgcgtcatcatcctgttctcgcctgtgtcctgttctttgttgttttcctcctttctctttgtttcttgttttttcgtcttgtctctctttcttgtgtctcttttgtcttctttgtttgttttttgtttttcgtgtgtttgtttctgtgtctccgttcgtgatctccggacgcaggaggaccagaggcgacgacgcacagggatcatgaacagtcggctctgtcacccatctgctcttgtcccacaattctgccatgtggggcctacacacaatctgtagtggtgtgccgtcctatttcccccgatggggcgcgcacaaaattgtgtgtgaggccattgaatgtgtctccgccttccagcagggaggtctcatttagtcgccatgcaggtcccgcgttcacagccggatgcttctgccgtgcaagtcaagcctgaccatgactcggaggcaatgatacgacttcaggctgctcgtcaacgccagtgaagcgagtcctcagataatctggtgcaaagcagcacacgaaggcttcagcctttgaagagcaggcagaatgagacactcggtggtgaaagagaagatggttggcggcattgctcagatcatcgcagtcacaggaacaatatgcttcggaaggaacgagagctggaagaggcgcggaagaaaccggcccagatccgtcagcagcagtacaagtttctgccttcagaggcttcgagatgagcacctacagaagcctcttgctatttaagtgcagacccggcccagagactgtgcgtgccaactaccaaagccttctggagcatgtacggggcccaaccatgcgccaaccccagcacttccccaaagtgcatgccaaacctcagggcctggccaccgcaccagtcccgcagtacatccccatgtcccctccccaaccccaagtgccgtgtcatgcctatagggccccccaagtgccatgcccctccctcagagtattaacgctccaagagtattattaacgcgtgcctgtacctcgatctgaatctgcacggggccccagcccactccaacatgccagcagcttccagccagtccccacagcctcatcagctctcttcaccgttttttgatactatcttcccccacccctagcctacccaagtaggggcatgcaagagttataa

SEQ ID NO: 592081 - DNA, 558 bp, Homo sapiens
tcaggctgtccaagaggatccccttcagcccattagtcactatacatcaaaaggataaaatatttggaaataagtttaaccaaaaagtcaaatgataatcccctgaaaactacaaaagatggctgaaacaagtaaaagacaatatcaatatatggaaacacatttcatttccagggatgggaggaatcaatatggtaagaaagataataccccaaagtgagtggcgggatccaatgtaacacctaacagaatcccagtaacatttttggcagaattagaaaacacggtcctaaatctcaccggacaggctcttattaatgacggccacaacagatacacggagaaaaagaggcaccatgaaagggtggaaagtcctgatgacatagaaaatagcaatcagcctttctcacatcccagggccttcaaaattatccaagtgcagctgggccagtatggaatccaccgaaaactattcaccaagctagaaaaggggtgagagacaaaaaaggggcaagaatatcttgggctaatcacctcccactttggcctactaaatgt

SEQ ID NO: 592082 - DNA, 449 bp, Homo sapiens
  misc_feature (239)..(240): n is a, c, g, or t
  misc_feature (249)..(249): n is a, c, g, or t
  misc_feature (254)..(254): n is a, c, g, or t
  misc_feature (258)..(258): n is a, c, g, or t
  misc_feature (260)..(262): n is a, c, g, or t
  misc_feature (271)..(271): n is a, c, g, or t
  misc_feature (282)..(282): n is a, c, g, or t
  misc_feature (284)..(284): n is a, c, g, or t
  misc_feature (289)..(289): n is a, c, g, or t
gaggaatgatcatgaaatgcccttatatatcatgctaaggagttttaacattatactctaggtgatagttttaattgtggaatctgtataatcaaattgacattttataataactgacagcaaggcagattagaagttgagttagaagagaataataccattggcaaggagtctaatcagaaagctttacaggcctggtgctgtggctcttgcctataatcccaacattttgggaggcnnaggtgggtngatcncttnannncaggagttngagaccagctngncaacntagtgagaccctgtttctaccaaaaaattttaattagccagacgtggtggttcacaccagtagtcccagctacttgggaggctgaggcaggaagattgctttagcccagtaagtccaggctgtggtgagccatgatcatgccactgcacttcagcctggg

SEQ ID NO: 592083 - DNA, 351 bp, Homo sapiens
  misc_feature (239)..(240): n is a, c, g, or t
  misc_feature (249)..(249): n is a, c, g, or t
  misc_feature (254)..(254): n is a, c, g, or t
  misc_feature (258)..(258): n is a, c, g, or t
  misc_feature (260)..(262): n is a, c, g, or t
  misc_feature (271)..(271): n is a, c, g, or t
  misc_feature (282)..(282): n is a, c, g, or t
  misc_feature (284)..(284): n is a, c, g, or t
  misc_feature (289)..(289): n is a, c, g, or t
gaggaatgatcatgaaatgcccttatatatcatgctaaggagttttaacattatactctaggtgatagttttaattgtggaatctgtataatcaaattgacattttataataactgacagcaaggcagattagaagttgagttagaagagaataataccattggcaaggagtctaatcagaaagctttacaggcctggtgctgtggctcttgcctataatcccaacattttgggaggcnnaggtgggtngatcncttnannncaggagttngagaccagctngncaacntagtataacccagtctctataaaatacaaaattatttggagcccagcggcgatcacgagtca

SEQ ID NO: 592084 - DNA, 746 bp, Homo sapiens
  misc_feature (127)..(127): n is a, c, g, or t
  misc_feature (161)..(161): n is a, c, g, or t
  misc_feature (180)..(180): n is a, c, g, or t
  misc_feature (184)..(184): n is a, c, g, or t
  misc_feature (187)..(187): n is a, c, g, or t
  misc_feature (191)..(191): n is a, c, g, or t
  misc_feature (195)..(195): n is a, c, g, or t
  misc_feature (213)..(213): n is a, c, g, or t
  misc_feature (224)..(229): n is a, c, g, or t
  misc_feature (243)..(243): n is a, c, g, or t
  misc_feature (245)..(245): n is a, c, g, or t
  misc_feature (282)..(282): n is a, c, g, or t
  misc_feature (336)..(337): n is a, c, g, or t
  misc_feature (470)..(470): n is a, c, g, or t
  misc_feature (486)..(486): n is a, c, g, or t
  misc_feature (488)..(489): n is a, c, g, or t
  misc_feature (491)..(491): n is a, c, g, or t
  misc_feature (503)..(506): n is a, c, g, or t
  misc_feature (570)..(570): n is a, c, g, or t
  misc_feature (577)..(577): n is a, c, g, or t
  misc_feature (580)..(580): n is a, c, g, or t
  misc_feature (592)..(592): n is a, c, g, or t
  misc_feature (651)..(651): n is a, c, g, or t
  misc_feature (670)..(670): n is a, c, g, or t
  misc_feature (674)..(674): n is a, c, g, or t
  misc_feature (696)..(696): n is a, c, g, or t
  misc_feature (720)..(720): n is a, c, g, or t
gaatgacccgactggaatccactctaaccaatcgcacttaacgactcgggccaccactggggggggcagggggaggggtccaccatgatttctccatataattttgatcataggccggagtgagtcnttctacctgcacctttctgtacaaataataattnaattttaatgtcttaagtnattntantaanaaanatgatcttctagctactnccaaaaacaannnnnnaatactgctctccnantttcccttgctgggagtagccacatgctcttgccccnaaacccttgtatatggggacagtggggtcagtgcagctaccctttctttccaanngcggaacagcggacccagcaagagcatccacatcctcactttgttcggagtggtctttggtttgggcggtggggcagaccttgggaaggggcttaggaagggagaggcagctcttccttcagctggctctcancaggctgcagcccccncnncnctcccacctccnnnntgggaaaccacagcattatcacagcattattgtgacagccacgaacccattgcccacaaccccnccacccncgntcaccccaaccnctggctttgagccctgttttgaccaaatcattaaaaggatttttgggggtgggtgggtnaaggggggaagggaagggnaccnaaccatcttttgcttatttgtnatgtaagtttttttccaacagtanaccaatcagtatcttgtcaattatag

SEQ ID NO: 592085 - DNA, 1363 bp, Homo sapiens
tgggtgtcctcagcagccagtgttaacaccacgtgttcacgttagtgtgttacagatttcatctcttttatatgtgttattttaaagttaactccatacttagtgagttgggattttctccctgtgccaccatttaatttcgtggcactcagaactacagttttgtggtgtgtgtagaagtctcatacggtggtggttgtgacacccagagacaccacaacacctagtgagagaacccgtgaaagttaaagagaaataagaggttcacaactatacactatttattgtgaagtataacacgtgtttctccgtgtggagggcccaaatcgtggtgtttatgccttattagagaaggttcttacagagaatgtgctttttatattttgtgtgtgtcatatataacacaacacacagtctcgtggtcatttatatttctctgtgtgtgtgatataaaccacattgtgtgagacacaagacgtgtgagggacccgttttgtgcctctgtgtgtatatctctctccctatatgtgtgctataaaccatatataacactctcacagtctcatattagacgcccggcgcgcttttttacaaaaatataaaagcgcaccttcttgtgatatagactctcaaaaaaagaaaacaacacaacaaaaaaacacaaaaataataaaaacaaataaaaataacaaaaaacaaaacaaaaactaaataaaaaaaaaataataacaacatcacaaaaacaatacaacgataataatcaagctaaactaaacgactaaatactagagcagactgagaattagtggagggcggcagccaagtacggaggaaaagagaagagaggaaagcggcgaacagcgatgcggagaacgcggcagcacggcgcaggaagaaggaaagaagaaaagataaaatacaagaagaaggaggcaggtcgtggcgcgcctgtcagcagacacggagcgagcagagcgacgagaggaagagcaaggaagaggaaaatcatagataaaatgaaaggaggaagaggtagtagaaacaataaacaacataaagtaacctaaaacaagcataataaacaaaagagacaacgaaacatgacagagaggcgaagggagagggacacagaaaataaagagaagacaagaagagaaaagcaacgaacctaagagagcgaagaaaatgagaagaggagggaaggaggacagaagcagaaaagaagagagagagcgtaagagagagaagagagagggaacacgagagaggcgagaacagagcgaacacgagaataagaggaggagccgcagagtaagcaggacagacagtgaggaataagagtaggcgaagacgatctaagcgg

SEQ ID NO: 592086 - DNA, 285 bp, Homo sapiens
tagaggatccctgggatgtcgcgtgcatgtgataaagttgaggatcttgagatgggagattacctgatgtgctgatgtatcacaatggtccttataagaaggatgcaggtgagtcagagaaatagtgtagagttggaaagcagagatttggagtgatgtgactacatgtcaaagaattgcaacagtctctaaaagctaagaagaaacaagaaacaaattgtccccttggaggctccagaaagagtccatttcttggtgacacattggaatattaggccctggtga

SEQ ID NO: 592087 - DNA, 306 bp, Homo sapiens
ggaaaacctgccgcggctggagcgggggaccccagcaatcagtttcccaaacttctatggatgtagccgccaaccttcaccatgggcgcgtgacaggcaggagcctggagcgcctcaaagacggacgtggcggcatagccctggacgcaatcacgggcggtgacgatatgtagcacacggcaccacacctgctcacatcacgtagtagcacgcaatgcgacagagagctgaggactggtgccacgtaccagctgcagtccacgccagacttgtcgcacaggatgaccaacttgaggacgatgtcct

SEQ ID NO: 592088 - DNA, 356 bp, Homo sapiens
  misc_feature (42)..(42): n is a, c, g, or t
  misc_feature (73)..(73): n is a, c, g, or t
  misc_feature (75)..(75): n is a, c, g, or t
  misc_feature (79)..(79): n is a, c, g, or t
  misc_feature (85)..(85): n is a, c, g, or t
  misc_feature (106)..(106): n is a, c, g, or t
  misc_feature (112)..(112): n is a, c, g, or t
  misc_feature (129)..(129): n is a, c, g, or t
  misc_feature (135)..(135): n is a, c, g, or t
  misc_feature (143)..(143): n is a, c, g, or t
  misc_feature (145)..(146): n is a, c, g, or t
  misc_feature (151)..(151): n is a, c, g, or t
  misc_feature (157)..(159): n is a, c, g, or t
  misc_feature (161)..(161): n is a, c, g, or t
  misc_feature (179)..(179): n is a, c, g, or t
  misc_feature (207)..(207): n is a, c, g, or t
  misc_feature (219)..(219): n is a, c, g, or t
  misc_feature (223)..(223): n is a, c, g, or t
  misc_feature (225)..(225): n is a, c, g, or t
  misc_feature (255)..(256): n is a, c, g, or t
  misc_feature (260)..(260): n is a, c, g, or t
  misc_feature (291)..(291): n is a, c, g, or t
  misc_feature (293)..(293): n is a, c, g, or t
  misc_feature (300)..(300): n is a, c, g, or t
  misc_feature (306)..(306): n is a, c, g, or t
  misc_feature (309)..(309): n is a, c, g, or t
  misc_feature (313)..(313): n is a, c, g, or t
  misc_feature (316)..(316): n is a, c, g, or t
  misc_feature (323)..(323): n is a, c, g, or t
  misc_feature (331)..(331): n is a, c, g, or t
  misc_feature (334)..(335): n is a, c, g, or t
  misc_feature (344)..(344): n is a, c, g, or t
  misc_feature (349)..(349): n is a, c, g, or t
gataaataagggttgtcgcttcactgattaagggaataaacntcaataaacttaacaacaacaaaaaaaatcncncgcngccgcngtttaagttttaacagatgtntttcanatacagcatggggtacngggggncacaagcntnncatcnctgggnnngngcttgcaactgccgggcngttccgtgccgccgccggggcggaaccnggcatgactganctgngncatgtgttactttcccggggatggcgttgnnaggngggggggcgcgtggtaggggcgggtctcggntncgggggngggcgnggngggngcnttagggnggcgagtntcnntcgcggggngtggntggcgag

SEQ ID NO: 592089 - DNA, 160 bp, Homo sapiens
gcggccgcctactactactactactgctcgaattcaagcttctaacgatgtacggggacatgtaatctcagcactttggaaggctgaggcaggcacactgcttgggcccacaagtttgagaccagcctgggcaacatatcgagactctgtctctaaaaaa

SEQ ID NO: 592090 - DNA, 164 bp, Homo sapiens
ctatttctccacatcctctcagcacctgttgtttcctgacttttgaatgattgccattctaactggtgtgaaatggtatctcattgtggattttgatttgcagttctctgtatgcagcttatacgaaataattgttgttctgttaacccgagcgctaccagggt

SEQ ID NO: 592091 - DNA, 151 bp, Homo sapiens
gaggggttcctccgtggttgcgaccatgcgtgggtccacggtcctacttcaagtgttgcaggtagtctacgtgcactcgtcaagtttggggtgggaacgatggatgtgtgcgctattttcctaggcgccccactctttaagtttatggtgg

SEQ ID NO: 592092 - DNA, 254 bp, Homo sapiens
tcctgaaattctagaagtcgcatcctcttctgtaggctgattgagattagtgtaccatttcgttccttgggtccctcaaagatggtctctaaacacctgtttgcaggcggagatttataattctggtaggtctttatctcttctaaactaaactccttcttctttacacctttggggtcgagcaaggcccatgggggtaagattaggcatctggcctaggcaatggtttcccggatggggtcaccgagctcgaa

SEQ ID NO: 592093 - DNA, 108 bp, Homo sapiens
  misc_feature (68)..(68): n is a, c, g, or t
tctggtctgcatcttcccaggctggacacaagcgtcagactcgccacactagatatcctgcaccatgntctgctgccttacacaactccttggccttgccatatgcaa

SEQ ID NO: 592094 - DNA, 824 bp, Homo sapiens
actcactacagcctcgaactcctaggctcaagcgatcctcccacctcaacctctagaatagctgggactgcaggtgcataccaccacgcccagctaatttttgtattttttttgtagatacacggtctcaccatactgcctgggcaggtttccaactcctgggctcaagtgatccagcagccttagcctcccaaaatgctgggattacaggtatgagcactgcacccggccacattttttttgtttttgaaacagggtctcactctgttgcccaggctggactacagtggcacaatctcagctcactgcggccttgaactcctgggcttaagtgatcctcccacctcagtctccctagtaggtggaactacaggcatgtaccaccacacctggctatttagattaattaagagacagggcctatgctatgtggcccaaggctggatctttaattcctgggctcgagagagcccaatcatccccatatctcagagatgtcagggattacagccatgagccaaccatgcccgggcaaacttaagaccttgaatataacgcgatctggccatatagtttaccatctgtcacaagtaatcggccatcaatataatcgctttaaaattggcgctccaagtgatacagactttcaatggaaaattcatgcggcacccgcgactcataggatctcccaatttctggtacactggtgaaaaaccaggatctcactcttgccctccaataggacgcgatacgcgcgtgcacacactacgttacacgttacacgcaacctgaaagaataacaactacaacagaccaaacgcacc

SEQ ID NO: 592095 - DNA, 293 bp, Homo sapiens
gccagccgggagccccagccctgccactcccaattgggtgactggggatacatctttcaatattccaggcctcagcctccccattttggcaattggggaattatgttaagccctacctgccagtgttgtcctaaggaataagcgaaatccttcataaagggcttttaacccggggcctggcccaaagaaaaccccccccccaagttgggtgtgatttttttttttgttggatcatccagccccttcctgtttcccagaaatgtcagggtgattccccttgcggtgaaacccca

SEQ ID NO: 592096 - DNA, 153 bp, Homo sapiens
ctgatccgtagcttaagccatcctcttgtctcagccacacatgtagctgagacggcagttgtatgttactagaccgggctgttcattttaattttggtgtgtatatggtcttgctatgttgtctggtctgttctcaaactcctggtcttaagc

SEQ ID NO: 592097 - DNA, 114 bp, Homo sapiens
agactgggaagatgcacaaccaaggggttacaggcatcgcccatgtctcctcacctggtatttcgtaactcagacaactaaattgctttgtacagaaaacagaaaaagcaaaat

SEQ ID NO: 592098 - DNA, 256 bp, Homo sapiens
cgtgttatagacgatcaatcatgctgcatggactcactgcatacacagtagggttccatttcttcacgctgcatggatacactgcattcaaacacgctgcatggaatccactgcattcaatcgagatccattgggccacgctgcatggaatccactgcattcaatcgggatccatttaaccccgctgcatggaatacactgcatcaatcgggatgcattttaccatgctgcatggaatccactgcattcaatgaca

SEQ ID NO: 592099 - DNA, 285 bp, Homo sapiens
  misc_feature (220)..(220): n is a, c, g, or t
  misc_feature (230)..(230): n is a, c, g, or t
tgtttaggagtatcttgaagtcacctgggtatcaaagtattcagggggaaataaggaaccatcgcaattcctcacaagttttataaaacagtttaataaattcctagatctgtttacatgctttcattcaagcaggcactggtcactataagctaagggtggccttccttacagccatgaagacatgcttgtcctgtgtgtctgaatcacatgctcatgncacatacttntacaatcacatggggaagctttcacgggaacacacatcatggctactttcatacc

SEQ ID NO: 592100 - DNA, 790 bp, Homo sapiens
cagagtgtagcttaatacaaaggacccaagttacacttaggagattgcaacttgaacttgacctgttctgatagtaagaatctaggcccaaggacctcacttgccaagcctttactaccagataaacttaggccaagagccgatttaccgcaaagtaaaggtataggcgactaggaagggtggaacatgcctggcgcaaataggatatcgtaccgcaggggaccagatgaagacatttatatccaagcataactatagcagggactaacccctataccttctgcataatgaattaactagaaataacttgtgcaaggagagccaaagctaagaccccccgaaaccagacgagctacctaagaacagctaaaagagcacacccgtctatgtagcaaaatagtgggaagatttataggtagaggcgacaaacctaccgagcctggtgatagctggttgtccacgatagaatcttagttcaacctttaaattgtgcccacagaaccctctaaatcccctgtgtaaaatttcacctgttagtcccaaagaggaaccagctcttgtggacacctaggaaaaaaccttgtaccagagagtacaacaatttaacacccatagtaggcctaaaaagcagcaccaaattaagaaagcgttcaagctcaaacccaagtacttaaaaatccaaaatttaagtgaatcctcaacccatgtggcccatctatccctatagaagacttatgttgttacgtaccggaaaatttctcgataacctgggccgataaaacatggatgc

SEQ ID NO: 592101 - DNA, 408 bp, Homo sapiens
cgcggtggctttcatctgtaatcccagcactttggaaggccgaggtgggcggatcacctgaggtgaggagttcaagaccagcctggctaacatggtgaaaccccgtttctactaaaaatacaaacaattagccaggcatggtggcgtgcagcacctctaatcccagctactcgggaggctgaggcaggagaattgcttgagcccgggaggcagaggttgaagtgagccgagatcgcgccattacactccagcttgggcaacaagagcaaaactccatctcaaaaaataaataaataaataaatccaataaagccaagatactctccactttgggaggccgagatgggcggatcacctgaggccaggagttcaagaccagcctgaccctggagccccgtctctactatc

SEQ ID NO: 592102 - DNA, 445 bp, Homo sapiens
  misc_feature (335)..(335): n is a, c, g, or t
ctaccttccttggccagcacatcctcggggttacgcagcgggcagtcctccagtgacaggcaaccgcaaccaatgcagttgtccaggctgtcgcgcaacgcctccagcgtgcggatgcgggcattgaggtcttcgcgccaggccgtggtcatctcgccccactgcgccgccgtaagcttgctgttgggcgcataacggctgaatgcctgcttgatgttctccagcggaataccggtgcgctgtgccactttgataatcgccagtgtacgcagcaccagtgaggggtagcggcgctggttgcccgccgtacggacgctggcgatcagccccttggnttcgtagaaatgcagcgcagacaccgccacgccactgcgtttgcccactcagccactgggagcttccgcgggtggtcaacgccatgcgtgttgacctcatgtcaagtgga

SEQ ID NO: 592103 - DNA, 197 bp, Homo sapiens
gagagcgaagaaagcaaagacagccaaagaagggatagaggataacacctagagcgtaatcagaaacataatacaggtatgaagaaaaaggatcaagataagatgcaaaagagtgaagacaagtgtacacggattcgatgcaagttaaaaaggaaaggataagagcccaaacagaagatatataaagaaagaaacac

SEQ ID NO: 592104 - DNA, 771 bp, Homo sapiens
  misc_feature (29)..(29): n is a, c, g, or t
  misc_feature (38)..(38): n is a, c, g, or t
  misc_feature (104)..(104): n is a, c, g, or t
  misc_feature (123)..(123): n is a, c, g, or t
  misc_feature (127)..(127): n is a, c, g, or t
  misc_feature (142)..(142): n is a, c, g, or t
  misc_feature (167)..(167): n is a, c, g, or t
  misc_feature (172)..(172): n is a, c, g, or t
  misc_feature (177)..(177): n is a, c, g, or t
  misc_feature (211)..(211): n is a, c, g, or t
  misc_feature (213)..(213): n is a, c, g, or t
  misc_feature (216)..(216): n is a, c, g, or t
  misc_feature (218)..(218): n is a, c, g, or t
  misc_feature (231)..(231): n is a, c, g, or t
  misc_feature (243)..(243): n is a, c, g, or t
  misc_feature (247)..(247): n is a, c, g, or t
  misc_feature (251)..(253): n is a, c, g, or t
  misc_feature (257)..(257): n is a, c, g, or t
  misc_feature (278)..(278): n is a, c, g, or t
  misc_feature (286)..(286): n is a, c, g, or t
  misc_feature (288)..(289): n is a, c, g, or t
  misc_feature (321)..(321): n is a, c, g, or t
  misc_feature (325)..(325): n is a, c, g, or t
  misc_feature (327)..(328): n is a, c, g, or t
  misc_feature (334)..(337): n is a, c, g, or t
  misc_feature (346)..(346): n is a, c, g, or t
  misc_feature (349)..(350): n is a, c, g, or t
  misc_feature (353)..(353): n is a, c, g, or t
  misc_feature (355)..(355): n is a, c, g, or t
  misc_feature (358)..(358): n is a, c, g, or t
  misc_feature (362)..(362): n is a, c, g, or t
  misc_feature (379)..(379): n is a, c, g, or t
  misc_feature (392)..(392): n is a, c, g, or t
  misc_feature (395)..(395): n is a, c, g, or t
  misc_feature (403)..(403): n is a, c, g, or t
  misc_feature (452)..(452): n is a, c, g, or t
cttcgcgtctgccagcctggctggcagtnccgtctgtncatcccgccgcgccggggcagtctaggcggaggggggctcaggcggcggcggcctcgacgcgagtnagtgtcgtggttggggtgntggncccagagtgcctacnctcgccttcctgggcctcagtttcnaaatntgcanaatgggggtgaccatccctgccctgctggctgcnangancngctgtgagttttnaggcgtggatgnagcntggnnnaagnaatagggcgctttaaaaggcntggccttnannatggcgggagggagaccgcatctgaagaggantttntnnataatnnnntgctttgtnttnntgnantangtgntgctgggcattgtgatnctgcttgcttaangcntggagttnacggacaccttccctgtgcacacccagggattcttctgctatgacagtncctacgccaagccctacccagggcctgaggctgccagccgagtgcctcctgctcttgtctacgcactggtcactgccgggcccaccctcacgatcctgctgggagagctggcgcgtgcctttttccctgcaccaccttcagccgtcccagtcatcggggagagcaccatcgtgtctggggcctgctgccgcttcagccccccagtgcggaggctggtccgcttcctggggggtctactccttcggcctcttcaccacgaccatcttcgccaacgcggggcaggtggtgaccggcaatcccacgccacacttcctgtccg

SEQ ID NO: 592105 - DNA, 308 bp, Homo sapiens
gtaaggaattacacaaagttgaaggctacattcaagataagaggtaaaatttctcttttagatgttgaatagtatagattttgttcactagatgaaatgtcggtattaaaatacattgtcggctgggcacagtggctcacacctataatcccagcactttgggaggctgaggtgggcatatcacgaggtcaggttcaagaccagcctggccaacatagtaaaaccccatctctactaaaaatacaaaaaaattagccaggcatggtggtggacactgtaatcccagccattgggaggctgaggcagga

SEQ ID NO: 592106 - DNA, 699 bp, Homo sapiens
ggaagagtggtaatggcgtctgtatgatcttcgagagcctgctgcatcggacctcggccagtcatataaatgatgacaagcagcagctcaggccaacctttgaaccgtgccagaggtggaaggggaaaaggagaaggtgatttgagccaacatttcaaatgcagtattcaagcagagacctaccctctcatacagagataaatacggacagactactcaggatgcccctgaagaggttcgtaaccgtgacttcaggagagagtctggaagaacagagagagagctgctgcaagagagaaagactagggatcgtccaacccgagtaagcatacaatctcctcttcagtgtctaaaaatagccacggttagaccagattcctgccgcgcaaccttgatgcagatgaccctctgagcagatgaggaagatgacagattttgaagaagcacagtgatgatgatgatactgcggctcttcttgcagtaagctggaagacaattgagacgaagcaagagagctgacagagcaggccagggaacggaaacaagaacaataaagctgaagaagagaggattcgtatggacatacattctgagcggaaaccctctccttagtctcactggcccatcccagcctcaggacaacttcaacgttaacagaaggtgggatgatgacgttgtcttcagaactgtgcgaaggtg

SEQ ID NO: 592107 - DNA, 429 bp, Homo sapiens
gattaatcttttttggtattccattttatatatatctccctctttttagctatacttcttcttttggttttgtttttgcttatagtggtacctgtagacaatgggctgcacattttttatattgtaaaaatccagatagtaggccgggtgcagtggctcacacctgtaatcccagcactttgggaggctgaggcaggtggatcacaaggtcaggagatcgagaccatcctggctaacatggtgaaacccccgtctctactaaaaatacaaaaagaattagctgggcttggttgtgggcacctgtagtcccagctacttgggaggctgaggcaggagaatggcatgaacctgggaggtggagcttgcagtgagctgtgatcactccactgcactccagcctgggcaacagagcgagacaccgtctcaaaa

SEQ ID NO: 592108 - DNA, 901 bp, Homo sapiens
  misc_feature (663)..(663): n is a, c, g, or t
  misc_feature (828)..(828): n is a, c, g, or t
  misc_feature (901)..(901): n is a, c, g, or t
aactgattactgcaaaaattcaaaggattattagagactactatgagcacctatatgccaaaaaaattggaaaacctagaagaaatggataagttcctagacacatacaacctaccaagattgaaccatgaagaaatccaaaacatgaatagaccagtaacaagtaatgagattgaagctgtaataaaaagtctcacagcaaagaaaaccttggaatctgatggcttcactgctgaattctaccaaacatttaaagaagaactaataccaatcctactcaaactattctgaaaaatagaggagaagggactacttccaaattcattctatgaggccagtataccaaaaccagataccaaaaccagacaaagacacaaaagaaagaaggaacagaacaaaagacagaaggaaagaacagacaagaaagaaagacagaaaggaacagacagagagacagagagagagagaacgacagacagaccgcaaagacagaaagaagagaacagaaacgacagaaagaggacctacagacaatatcttgatgatattgatgcccctgaagattccaccgaaaactattagagcgataaccacttcggtacagtgcaggatacaaatcaccaagaatcagtacttcttttgccacagaccactacaggtagncagtatataactcttcgggacattataatacccgcataaccaccaggcaggggacccccgcaacattaccggccggaggaggcacccaggtagaggcagcggagataatatcagtacaccacacagtcgcaaaaatgatgctataatcatctactcatccgaaantagtaagcatcatcgtctctgcagcatcaccgctctagctaacaccacacccgacaaaggcagacaccgcagn

SEQ ID NO: 592109 - DNA, 179 bp, Homo sapiens
cgaggtacgcaaagagaagcacggtggcttcacacagaccgccacatgctgcacacgtccagtgtgccacatcgcatgtgcccacaccctgtgaaaatgctagtgtgtttgtctagccaacccactctctgtcagtgcatcttgcctgtctacccctctgtgtaaactacacgtatgta

SEQ ID NO: 592110 - DNA, 651 bp, Homo sapiens
  misc_feature (163)..(164): n is a, c, g, or t
  misc_feature (191)..(191): n is a, c, g, or t
  misc_feature (197)..(197): n is a, c, g, or t
  misc_feature (208)..(208): n is a, c, g, or t
  misc_feature (212)..(212): n is a, c, g, or t
  misc_feature (216)..(217): n is a, c, g, or t
  misc_feature (223)..(223): n is a, c, g, or t
  misc_feature (227)..(229): n is a, c, g, or t
  misc_feature (231)..(231): n is a, c, g, or t
  misc_feature (239)..(239): n is a, c, g, or t
  misc_feature (242)..(242): n is a, c, g, or t
  misc_feature (245)..(245): n is a, c, g, or t
  misc_feature (250)..(250): n is a, c, g, or t
  misc_feature (255)..(255): n is a, c, g, or t
  misc_feature (262)..(262): n is a, c, g, or t
  misc_feature (274)..(274): n is a, c, g, or t
  misc_feature (277)..(277): n is a, c, g, or t
  misc_feature (281)..(281): n is a, c, g, or t
  misc_feature (285)..(285): n is a, c, g, or t
  misc_feature (289)..(289): n is a, c, g, or t
  misc_feature (292)..(292): n is a, c, g, or t
  misc_feature (295)..(295): n is a, c, g, or t
  misc_feature (298)..(298): n is a, c, g, or t
  misc_feature (304)..(304): n is a, c, g, or t
  misc_feature (306)..(306): n is a, c, g, or t
  misc_feature (313)..(313): n is a, c, g, or t
  misc_feature (320)..(320): n is a, c, g, or t
ccgggggcgagattggcgcgggagtgtggccgcgccccatcagatgttctcccttcaccagcgggagcttgatatcccttgtctgtaacatagacccgggtactgcgggaggggagggctgctggggaggatggggggatgttatataaatatagatataatnntattttcggagctaagatggtgttatntaaggntggtatgggtnagcnctcnngcccangctnnncnagacttcngcncangcatnaacangacttgnccatctttccanccnctgnggangcanttntanctnacttgngnaggacanagcttancacagcctctactgcctgccacaccgctgggaaccatacaccagttaccggaggaagtgagaaggattcactatgtgcatgcatttgccaaaggcgaacttagctcgctgtgctaggacagacacatgttcatactgtgatattgatgtaattgagttctttaaaggctaaaatccggattattatctattgcaaattgcgttcatttttcgaccctgatggtactcgcatttggatactatagctggttgatgaccccgctgggccattgagacctttactttagtggtatatttgactttcatcaagggttggaatttgcgctttcccg

SEQ ID NO: 592111 - DNA, 768 bp, Homo sapiens
  misc_feature (599)..(599): n is a, c, g, or t
  misc_feature (759)..(759): n is a, c, g, or t
gcttgaatggaacgagcggatgaacaccttgcaggcccatctggatgatgcgtaccccaaggatgtcggtgagtaggcaacatggaggatgttcgtaccgtgtacgtcgcgcatggcatcactgagcaatgcgctccgctaacatcgcgcgtgcgaactatgagagacggatcgtcggccgcctacaacattcctgacagacagtcttctagcggtgtggccgcacgagtgagaaccagtccagtggtttgcatgtgcagaccgggcgagcttggagactcccagacgggttgcaacatggataacaagaccagtcgaaaacgtccatctaatcgctatgagacgaaggtccacagcgaacatcgcgtgcactcgataagtgtgcgtgcaggcttatcagtccggaggtttgttggctggtacaggtgtacggacgattccccatgtaaccttcaggtccgggagcctggtgacaagggagagtcgcacctcaatcaggtgaacaccttcctgagggacgtgtctaaccacgccatgacgggctgagtccaatactctcgttcactggaaccatgagtagagacacagaggatgctgangcaaagtaatgctcatgtatgttatgcaatcgattgacggggccctgcttcacaatgcgtgggagcggccaatctggtgccagccagccgagccaggaatcgaggcagggtcacagggcagggacagaatagcaggaagctgactgtgtcgcctcaacgngagaatctc

SEQ ID NO: 592112 - DNA, 597 bp, Homo sapiens
aattgcggtccagcctgggcaacaagagactccatcaggaaaaaaaaaaaagattctggtctcgaaggccacggcacctatggtcggtaggtgtaaggttcccgttcagttaatgggaggtaataaccccgggcttacagggtggtttggcagattactttaaataattaaggtataatcctgggcagggggatgggcacataaggggtatttaactataagtggactttccggggtacctaaaaaagaggagggtcagggaagatgttggtccttggcttactccttcctttcccagacttggtgtaagatacctcttacttcccaggctctttactctcccttcaaaccaagatcttgacgggtgcatctctttggtggcaggagaatgtgatccgagaatgtaccttaaaggagctataccagggggccaagaaattatcaagggcgggagacaatatccctgaggagcagcctgtggtttcaacccccaccacagtgtcggatggggaaacacgagggtaaataagatcctcactgtggagtgttcctctctgtcattcaggttcttcataacaaagctgaggtgagcgggac

SEQ ID NO: 592113 - DNA, 1045 bp, Homo sapiens
ggcaggcactgcccgggctggacgacgtctggcctggctcccgtgcgaagtgtgcagctggaggagcggcccagagcgcgcagctagtggcacatggctgaagacccctgtgtgacatgtccactctcctgatgctgtgtggtgctgtgctgcatgatgcatgtcccatcccctgtgtggtccctgggcgctggctgactgccggctggttccctgcgctgcagtagctcccctgagcctggtgctgcaccggatggctggcgagatggtcgcgcgctgtcggcctcctgctgcgcgcccttgcagctgctactgtgtgggccacctggacgcccagcccgcggagcgcggaggccagtgagctgcgcaaggaggcggaggcattcctagagaatgtactgtgatagcctcaagtgaagcatggtccccaaatgctcccacctccactcgattcagctgatgccatcagagctgtttcagtgggtgtcccagctaccctgtcagctggcgttgtttggacctgcgccaccctgcgccagatgactcgtccccgctgcggggttacagataccaacagttatgcgtgcctgggctgagaggatcagtgacttgtatgctagacaccggaccaaaatgaggcgtaacgaaacgctttgcaaagcagggtaacaaattggtacaagcaagcacctctcctaccggcgtgggtgaactggcctgagcattctgccggagccggcagttcggggcgcccgtgcgcgccggcgttccagttgttggggcaacggtctcagcgctggagttctgggaggacccagccatcaggcccgctgactccgggtcaccttctccacgggaccacacgatggctggggtaaagtccttttgattggccagggtgcgccctgtacagcgcttcttaccgaccgcggtgcatggcaattcgaccagataagccatgaccgtggacgacgcagggaacaactgttgtgagtgtggccggaaatgcacagatgtgccactgatcggcgagcgattggccaaa

SEQ ID NO: 592114 - DNA, 362 bp, Homo sapiens
  misc_feature (263)..(263): n is a, c, g, or t
  misc_feature (279)..(279): n is a, c, g, or t
cggccgatcatgctttattagttcaataacagatggggggaaaaagtaacataatcagctgggcccggtggctcgggcctataatcccagcgctttgggaggccgaagtgggtggatcatctgaggtcgggagttcgagaccagcctgaccaaacatggagaaaccccgtctctactaaaaatacaaaattagcagggcgtggtggcgcatgcctgtaatcccagctactgaggcaagagaatggcttgaatctgggaggcanaggttgtggtgatccnagatcacgccactgcactccagcctgggcaacaagagcgaaactccatagttggcgatatcaggtggtgcatagccatcattc

SEQ ID NO: 592115 - DNA, 256 bp, Homo sapiens
attcacaatcttacttgatatttatcattgagttaaattgcacataccattaaggtatggttaaaaactcatctctgctacaggcagacagactttcctgtcgcaactctccacttccggctataaacaccccctatcaaactaaacaggaagtaacttctatgtgcacaactatagcacaactactacttgaaactcaaagcctttcctccttaattataatatcttccgactgcttttctctatatagattctc

SEQ ID NO: 592116 - DNA, 470 bp, Homo sapiens
  misc_feature (358)..(358): n is a, c, g, or t
  misc_feature (443)..(443): n is a, c, g, or t
cacgaggcatacgccggccaggtcctggttgaggtaatggcttggcgtgatgtgccagcccttcatcttcttgtgatgcacgatgatccggtgccaccaaatggtggggatgatgtaggacttgtcgagcacgtactgctccagctcccgcaggatcttgtagcgctccttcttgtccagctcgcccgactgcttgtcgtagaggtagtccaccttgcggtccacgtagcccgagtagttgatggtggagcggtccgcggacaggtacttgagcagttgcaggttgggctcatccatgaaatcgcagttgaagtccagcgccgcgtcgtagttgccctcctgctgccgtgcaaggtanaggcgggtctcaagctgctcgtgctccacctgggcgcccacctgccgccactggtcgatgaggaacacgcccaccgggggtgtanggcatgggcacgttgcggttggtgagc

SEQ ID NO: 592117 - DNA, 299 bp, Homo sapiens
  misc_feature (124)..(124): n is a, c, g, or t
agttactcagggtcgagtttcatatatctcgggtatttattgttttcaaatacagtgtttgcaaaccagttggtgtaagagatctaatgtgttttaatataccgacacacattatgtatattantatacatcttaatgtacatttctctaattcttgcaacagttctgaagagtatatatagtaagcgttatctcctgtgatagagctgaagaatctaagtcttagtatagatagagtaacctgcttactcacacacacagaaggagttgcagagctaatatacacacacatatatctc

SEQ ID NO: 592118 - DNA, 317 bp, Homo sapiens
gagtgtgctgtggtgatctagaggttcccttggggctccattcaggtatggaaggcaagaccatccttccagcggaggtggaagttctgcacatggacgttcttatacggggctgtctttctcgggcaccagagaaggagcccttcctgggccgaggtctcttccacggagatgtccgggatggcgaacctaaggatgagggtccagatcattcccagggtcatcttggcgtggccgtccacaatctcttcggccccgatggagaccagctggacgccttggcgggcaataaagtccagcgcttggttcacatggtg

SEQ ID NO: 592119 - DNA, 388 bp, Homo sapiens
agcccgggccttcatgcagttgatttctagtgggagagtagcaaagcagccaagagaaataaataaaatgtcatctgttaggaagcccattctaaagagaagagagaccaggtgtggtggctcacgcatgtaatcccagcactctgggaggctgaggcgggcagatcacctgaggccaggagttcgagaccagcctgccaacatggtgaaaccctgtctctgctaaaaatacaaaaattagccaggcatggtggcaaacgcctgtaatcccaactacttgggaggctgaggcaggagaatctcttgaacccaggaggtggaggttgcagtgagtcgagatcatgccattgcattccagcctaggcaacacgagcaaaacttcctctca

SEQ ID NO: 592120 - DNA, 697 bp, Homo sapiens
cccatacattgggacagacctagttcaatgagtctgaggaggctactcagtagacagtcccaccctcacacgatacttcacctttcacttcatcttgcccttcatgatggcagaccctaggcagacatccacctcctatatcttgcacgaaaccgaggatacaaacaacgcccctagagaatcagctcccattccgatagaatcaccttccacgcccttactacaacaatcaaagacgccctcggctaagcttctcattccttctctccttaatgacattaacactattcatcaccagacctcctaggcagacccagacaattatacccatagccaaccccttaaacacccctccccaatcaagcccgaatgatattacctataacgactacacaaattctccgatccgtccctaacaaactaggaggcgatcctagccttataacctatccatacctcatcctagcaataatcccccataactccatatatccaaacaaacaaagcataaatatttcgacacacataagcaatcactttattgactcctagacgcagactcctcatactaacctgaatcgggaggacaacagaaagataacccttttacatcatgcacagtaagcatccagtactatacttacaaaacaaaacataatacataaaacaatatcacctaatagataaaaaatatcaa

SEQ ID NO: 592121 - DNA, 171 bp, Homo sapiens
attatcattacatcatgccttttttgtccagtcatatttctacacagctgtccattccgcagcgaacctaagcttaagaatatgcacttctccctgggtctctgggtcttcatttctgagcgctcccatgtgatggagaattttgatgaaaggaatgttgtcttgggggag

SEQ ID NO: 592122 - DNA, 355 bp, Homo sapiens
tccgctgggacaaggggggagggatgatgaacactgtgcttagttgggaacataaagagtttgtaggcataatccttgacattccaagtggtgcgtagaccttatatctagggcatgggatgctgaggatgtcataggggtggaggaggaaacttgggctactgggaaggttgctggagcagcacggtgcaggatgcatgaaaaggggagatgaatacttggtgtcagggtagttcagcggggttgctggtgtggtccagtagagagctagtcggaggagggcttgcggagcagtaggcctagaagggaaagggaatcatgaaaggtagaggaaagggaagtaatcatctcagtt

SEQ ID NO: 592123 - DNA, 484 bp, Homo sapiens
  misc_feature (59)..(59): n is a, c, g, or t
  misc_feature (64)..(64): n is a, c, g, or t
  misc_feature (86)..(86): n is a, c, g, or t
  misc_feature (144)..(144): n is a, c, g, or t
  misc_feature (207)..(207): n is a, c, g, or t
  misc_feature (212)..(212): n is a, c, g, or t
  misc_feature (247)..(247): n is a, c, g, or t
  misc_feature (265)..(265): n is a, c, g, or t
  misc_feature (305)..(305): n is a, c, g, or t
  misc_feature (476)..(477): n is a, c, g, or t
ggctctggagcccaaaggctaaagccatcaatatcccccctgggccctgcacggtatanacccnagatggcctggaaagcaactgnaaggatcccacaaaaagaagtgaaaaataggccaggtcctggccttaaactggatganattcccacccattggtgatttgttccctgcccccacccctaactgatcaattgaccttgtganaatanaccttccccacccttgagaaggtgctttgtaatantctccccacccaccccangcccgcacccccggacccttaagaaggtattttgtaatantctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttanngttcaaa

SEQ ID NO: 592124 - DNA, 195 bp, Homo sapiens
cttagtctccccagtaactgggattacaggggtgcatcaccgtgcctggctaattataggatccttaggagagacaggcttaaacataactgacacaacggtcttgaactcctgacctcaggggatctgcctggctcatcatgcctggcctctccctcataatagacagacatctttttggggaaataggtcctc

SEQ ID NO: 592125 - DNA, 326 bp, Homo sapiens
ggggggaggggggagggatagcattaggagatatacctaatattaaatgaagagttaatgggtgcagcacaccaacatggcacatgtatacatatgtgacaaacctgcacattgtcacatgtaccctaaacttaaaatataataataattaaaaaaaatggttagatggttgtctagtcagtttggctgccataacaatttaccatagactgggtggcttaacagcagtactcattctcacctggatctggagtccagcctttagacctgttaggaataattttgtttcttagccgctagtctatggtatttcgctatacaacctc

SEQ ID NO: 592126 - DNA, 400 bp, Homo sapiens
cttctgtctctgtagagcatggaggccacttgccgtgttcagtctcctagcgatgactgagcacgtcagcgctgctgcccaaggccactctggacgctataagctcatgaaggcaggtggtgagaagcatctacctgccacgtggttcattgctatgcgaataagctgatgagaggtgaggatttcctttggatacctgcctaagatctcaacagagatggcaacttaaaaatgaagtctgtgagttgccggaacctgtgatgggcagcctccccacactgacagcctccagtccctgctgggcacaggtctcagcatggcaaggcttgacactaaggtgctgctactgccctccagatgccagcactactcctggggcatgggagcgagggctctgggg

SEQ ID NO: 592127 - DNA, 573 bp, Homo sapiens
accagagcagagagagggcgaacaaagggcagcaaggctacggagaggctgaagaagaagctgtcggagcaggagtcactgctgctgcttatgtctcccagcatggccttcagtggtgcacatgccgcaacggcaatgagttacactgttcctgcatctcctctagactatgatgcgtgcagcagtggacgggagaacatcctgggagcagcagcaagaagtgtttcgagaagcttctccctgtacatccgtgtgagctgcagaatgctggaccaactctgtgttgtgaaactctcagactgtccacatgcattccttttgagcattcaataaggaagcatgatgagtctccggtggctctatgggggtttctggaaatgtcatcgtccactcagccactggattttaagcagaggttcaaatctgtactgcacccttggaggtggattcctttggggtatcttgtgaataaagcaaagacgcgcgtctacagggacacaggtgagccaaagtggaacgaggaatttgggatagagctggaggggctcccagaacctgaggatacacacgggt

SEQ ID NO: 592128 - DNA, 424 bp, Homo sapiens
tcattatagattagccttcctcaccaacattgttttctaaaatgttatatattactaaagggcaccagggaagaccccttccctcttccctgttgatctttattatagattaacttcctcttatctttctcacaaaaaggctttatggttatcacattgtcttcagatggaatattaaaaatactcttttaaattggaaaggacatgaaaacaagctgtatggaaaacaaaatgaactataactaattaaatgtttataactcaaaaacaagctttgtatagaaaatgttatatataatcctactctattttctgtctatataagaacctttaacttcagagccctgaccccatttctctggagtctgtgtcttttaaatagccattcccagcttttcactttaataaactctttataacttga

SEQ ID NO: 592129 - DNA, 225 bp, Homo sapiens
gtcccactaaaaatttcattagcctggtgtggtgacacgcacctattgtccaagctacttaacagcagaggcaggaagatcccttgaacctgggaggcagaggctgcagtgagccgagatcgtgccactgcactcctgtctgggtaacagagcacgactccatctcaaaaaaaaagttgtctgcttattaatagtcttactcatttggggaatactactttaaaa

SEQ ID NO: 592130 - DNA, 309 bp, Homo sapiens
cagatgaatatttcagtaaaactgagactaagttgataattttttccactgaagtctgtattccaattttttttttttggataccgggttttgccccaggctggatcacagtagccccaccacggttacaaagcctcgacctcctgggctcaagtaatcctcctacctcagtctcccaagtagctgggactataggcatgtgtcccagttatgtttggcttccagtctttttaatattaagggataatgattttggtgaattatctcctctttttacatcctctaatcagttacaattttaccgggggg

SEQ ID NO: 592131 - DNA, 406 bp, Homo sapiens
atatctacgcgcacacgcaacttgtccgcctctcggcttcaagatgattctcggtgtctcaacctcctgagtaagagaataactagtcagcgccaacaacaacagactgatgaagtatacaatagcaaagactaggtgattagagaacaaaagtaggaccatggtttggcacaagagaaagtacatggacaactccgtagtgatagagaccgacatcaagaacatagccagaagtgcttaagctccacagagcgtaagttccacgcatagagcgaaccgatctgcagagattcaacagcaagcaagtatgggatacaattaaggtagagctacatgacaaacaggggcatgcgaggacttccacgcagatgaagactgtaaggcagaaatctatcgtgagtacaga

SEQ ID NO: 592132 - DNA, 477 bp, Homo sapiens
gttttattttttctaaggtttgagggggaatgctggagatggtaatgggtatggagacctatcatataagtaatgctagggtgagtggtaggaagttttccataggaggtgtatgattgggtcgtagcggaatcgggggtatgctgtccgaattcataagaactgggaggttaacaagtagggtctggggtgaccaaaactatgtggtgtacaagcttccagggggaaagtgcgtaatatgtggtccctaggaagaattgtaggtggtggacgggtgtcatctactacagacctgttcgggggtaatcacgggattattgaaacaacaaggggccaaaggggcgcctagcaggctatattcagatcgttcgaagctcctgacaacctaagtcacgtaccctccccctcgctggcacagcgaccacagggggctccaggtaggcccctgaaacgtgtaggagaaactcatattatggc

SEQ ID NO: 592133 - DNA, 669 bp, Homo sapiens
ttgattctagcggatccttaaacaggctgatcctagaggctccgacccatccggcatggccaggaggcaggctgcgcacgatgactggtgctacatggggcttggccctatcccggtggcgtggcagcccagatgctgcagtaacactcattcccaggcttcactatgggcactggccgacatcccacaatccagaggctcaacactaaagacatcggctaatacatagcaagatgtgtgcaaagttctgggggagcccagcaggtggctccacctgactcccactctgggtggggcaggtgctgaagctgcagggctggccacgaccctttgtactgtcaactctggcttcctttacaagaaactaggagcacttctagcacattccttccttaccctgctctctcaaaaccagcctgacccccatggcccctcctggaaacatggtactcagaaaagcagggaccaccagtggctggcaaagtgtttggggaaaaaaggaggtgcaaagtcagcaagaaaacaaatgcgcgctggtcccgccaaggcagggtgtgcctagtcgcgggggatgttggggggcgggatctgcaggtcgtagggctccacaccccagatctccgtgcatactccgtgatggtccggcactgagaactgccgagagcatgt

SEQ ID NO: 592134 - DNA, 599 bp, Homo sapiens
ggtaaagtgactcatcatcttccttggcctgtgtatctagaataatcagttcaagtatatagtagagtactcttattcttgaaatctgggaaatatcatcaacagacatttttcctttgatctgcctttactgccttatcccttatgtccttatcaagcctcacaaattcttcctgttctttcttctgcagggtataagctctcttgtagtaattttaacttacaggggccctgatgttacatctgatgttatttctctttctcttcttcttcttttaactgggaagcacatttcattgacatttctatacttgtctgtttcttccaagcttcaactgccaatttctgtttctttctttgttcctctttttgcttttgattatcctcttgtctataatgaaaaagcacaggtgtgtggtctgccttttcctttaacttgaaaatttcctcccttggtggctgcttcttagtttaccaaatctgaatggactctttatttctttctactagaagcagaaagtttagataccatttatcattgctgttgaacttcatcttgtgtcaaccaggaaggtgtctagaccttctccatagatgtg

SEQ ID NO: 592135 - DNA, 248 bp, Homo sapiens
  misc_feature (86)..(86): n is a, c, g, or t
cccccccaaaaaaattttggggcccttttttttttttctcaagggggggggaggggggaccctcccccccgggttttggggttttncccccaaatggggggggttttttttttttttttcccccccccccccccggggggggggggtttggggggggggtttttttttttcccccccccccgggggggggggggggggggggggttttttttttttttcttttttttaaagggggggttttgggggga

SEQ ID NO: 592136 - DNA, 101 bp, Homo sapiens
atcctcccacctcagcttcccgaatagtaggactacgggcaacaggccaacacgcccggctgatttttctattttttatagagacaaggtttcactatgtt

SEQ ID NO: 592137 - DNA, 311 bp, Homo sapiens
agggcagtggtggggtttggagagaggagatagctccattaatacacatgtttaaaagatggaaagttcacgcctgtaatcccagcactttgggaggccgaggcgggcggatcacgaggtcaggagatcaagaccatcccggctaaaacggtgaaaccccgtctctactaaaaatacaaaaaattagccgggcgtagtgacgggcgcctgtagtcccagctacttgggaggctgaggcaggagaatggcgtgaacccgggaggcggagcttgcagtgagccgagatcccgccactgcactccagcctgggc

SEQ ID NO: 592138 - DNA, 232 bp, Homo sapiens
cgcgggttccgttggctgtggcggcagctgtacgcttgtgtgcggcggtggcttcggggtgggccgtagcatggtccacatgcgaggcgcatggtgcccccttaatgcgttgcgtgtgagggcgtggcttgtggcagcagaagctggcttctgtgctactccagagataacgtggagctagggctagatcgtggtagtgggcctggccgatcgggctaccggcttacccccg

SEQ ID NO: 592139 - DNA, 113 bp, Homo sapiens
cacgagggggagcacaatatttgaatattaggcgctgctatcaaatctgttggcttcacgccataaacatgagcttatgaatccataatggacgacattttcttcagttgttg

SEQ ID NO: 592140 - DNA, 430 bp, Homo sapiens
gtcggagttgattaatacactgacagtacaatgtatcattcatgactgatatttgactgtaacttttcccaacgtcagtgtgcatgagcatatggacttgacagacatctctcacccagacgcccagtgtgaacacacccacattcacatctctgggtggaaacagcctagagtggggacgacgctaatggtgttgctatagaaccgtctttgcttaccctattagactcgtgatttgtatgagacaccattgcacgaaaatttatccctccagaagtatttattactaaagaacacaagcaaaaaaagctaaattgcactggttaaagtacagtttccaacagctgtccttcctcagtactctaatgtccactcgaccgcgagtgcacgtcactgttgtgtgtacacaggtggtcccaatcaaaactcc

SEQ ID NO: 592141 - DNA, 320 bp, Homo sapiens
  misc_feature (53)..(53): n is a, c, g, or t
gagaaccagaacaatctaacggttacaaaacaagggcagcgggcccggcgcgntgctcacgcctgtatctcagcacgggaagccaaggcgggcgaatcacttgaggtcaggagttcgagaacagcctggcccacagggtgaaactctttctctactaaaaatacaaaaattagcggggcgtggttgcgggcacctgtaatcccagctactcgggaggctgaggcaggagaatcgcttgaacccgggaagcggaggttgtagtgagccgagatcgcgccactgcactccagcctgggcgacagggcgagactcccgtttcg

SEQ ID NO: 592142 - DNA, 349 bp, Homo sapiens
tttaaaaaattaaatttccattccccattccaaaccgtaagctgtctttccgaaaatttttggaggataaaaacctgaaggaaaaaagtggcccgtgtaggtgggattccctacccaggacttttagttggatcccccccagaggttttgaagtttgtgatcaaggtttggatattatccccaactttattaagaattgttttttaattgggtataccctttttccattaatagtttccaacccaattgtttatcccgctgtattaaatggacataattttcctcccttggttttttggtattgggccagtttttccccaccacttgttttctagagttaaaatcccca

SEQ ID NO: 592143 - DNA, 747 bp, Homo sapiens
ttttttataaaaatatatattttgtccaagaaaaaaaaaagcatacatatgtgattatggctaaatcaaaggtaactggaatgtatatacttttggctaatgttccagcaacactgctattatactatccaaatttttattggtaacaaaacctctttaagcaatgggtgattggccatgggacttttcccatgtcttctggctgtaattatcctgtgcagaactaggaagaaattttttcaggactggctctatggtttcctttaaaagaaaaaacttctggtttggtttttagcagtcattatttacaattgggcagtgattaactgggcaaggcttccttccgtgtttatccctgtagccatcatttaagtcaggaacagtcagaaaaatatttattttattttttttggggtggtctgcaaaggtaaaaatccattaaaaccttaagttaaatataaatgttacaactcaatgttgggtttaagattttatacagtatgggtgtgggggggttggagggtatataatgcagcattagcaatatggttcccaatagaggagttaaatatatttggtcacaggagacctgtagcagtcaaagatttatggatttatgacaaggaacttatgaaatgttgtgtttcttgggaatcttgataaggtaacatgacataagattctaagtggatggaaattaatgtttacctcaagtggaatttaaataatacttcttagttcaatttc

SEQ ID NO: 592144 - DNA, 310 bp, Homo sapiens
acacagtgagactcctgactcctttaaaaaaaaaaaaagaaagaaagaaaataaaataataagtgctggggaggatgtggagaaactggaagccttgcacactgctgctgggaatgtaaatggtgcagccactactgaaaacactatggtgtttcctcaaaaagctaaacagaaatatcatatgatccagctgttttccctacacataattacattcctctccctactatataaacccctgattttcagttcgtcgaaaagacagatttgagactgatctcccttctcctcacctgacatcacccgaatt

SEQ ID NO: 592145 - DNA, 873 bp, Homo sapiens
tgggcaagtggcagcaacagaggggactagcagctgaatatactttacaccaaatctcagaagattcagaacttagatgagtggggcccatggacatggaaccgatggagccttggaagtgcggggagccccatctccccagaaggagcatgtgaaccccatgcatgagagtgggccttggtgtatcactgtgagtgaaatagacctgccaagggaaatacactgtcttcagaaagaaattctagtgtggcttcaagcagactgatcaacatttgtgcagaggaaaacagcctacacctggtcctctttctcttcaatacaaaatgagataataggggtctggaacggcacaaaccttcaagacctatggaagtcagttgcagccagctcatcacatagaggtgcaggtgaggtgtatatcatcacggtggacaaatatctggctgcttcatctccatctctagagcccaatattggagctatacaatacaaccgctatggactcaaccaacaggccccaacgaaagaattgacatggagggcaagccacctgctccaaatgcctgagcctgatgacgaacccagtaagcatcaactgtggacacagcctactgccagttgagtatcaacagagttctttaaaaacccaaggccaacagcaactgaagccaggagaaattctgctggtcccagtgaacgaggctccaaagcaaatggataaggcctccggaccccaacaaaggagcgcggcgacgccctaacccagaaacagcccaccaaaagagcaaaggccacaacagaaatggcacaggatagaggacacacgcagacagcaagaagcaccatagaacaggggacaaaccaacggggaaa

SEQ ID NO: 592146 - DNA, 372 bp, Homo sapiens
  misc_feature (82)..(82): n is a, c, g, or t
  misc_feature (253)..(253): n is a, c, g, or t
  misc_feature (260)..(260): n is a, c, g, or t
  misc_feature (294)..(294): n is a, c, g, or t
aggcccaagatggggggacgtgcgttactcaccggccccccgtctgagccctaagtctggggccgaagtcgaagccggcgantgccgcggagcgccgggcgccggaacgacaggaggcgtggcgccgccctcgtagatccagtaacgacgcaattcgcggaaacgcctggaacacaccgagcgccagttccgtaaccgccggcaagatactgatccggggcctcccgggggacgtgaccaaccaggaagtacnatgaacncgtggctcgagtgactagtcgcagctcaagatancgtgttttgtggacaaatacaaagggacagccttcgtgaccctgctgaatggggagcaggccgaggccgcaatcaatc

SEQ ID NO: 592147 - DNA, 863 bp, Homo sapiens
  misc_feature (25)..(25): n is a, c, g, or t
  misc_feature (77)..(77): n is a, c, g, or t
  misc_feature (120)..(120): n is a, c, g, or t
  misc_feature (168)..(169): n is a, c, g, or t
  misc_feature (226)..(226): n is a, c, g, or t
  misc_feature (247)..(247): n is a, c, g, or t
  misc_feature (258)..(258): n is a, c, g, or t
  misc_feature (300)..(300): n is a, c, g, or t
  misc_feature (305)..(306): n is a, c, g, or t
  misc_feature (320)..(320): n is a, c, g, or t
  misc_feature (330)..(330): n is a, c, g, or t
  misc_feature (335)..(335): n is a, c, g, or t
  misc_feature (339)..(339): n is a, c, g, or t
  misc_feature (374)..(374): n is a, c, g, or t
  misc_feature (377)..(379): n is a, c, g, or t
  misc_feature (384)..(384): n is a, c, g, or t
  misc_feature (398)..(398): n is a, c, g, or t
  misc_feature (405)..(405): n is a, c, g, or t
  misc_feature (408)..(408): n is a, c, g, or t
  misc_feature (448)..(448): n is a, c, g, or t
  misc_feature (451)..(451): n is a, c, g, or t
  misc_feature (456)..(456): n is a, c, g, or t
  misc_feature (467)..(467): n is a, c, g, or t
  misc_feature (534)..(534): n is a, c, g, or t
  misc_feature (536)..(536): n is a, c, g, or t
  misc_feature (542)..(542): n is a, c, g, or t
  misc_feature (548)..(548): n is a, c, g, or t
  misc_feature (579)..(579): n is a, c, g, or t
  misc_feature (585)..(585): n is a, c, g, or t
  misc_feature (587)..(587): n is a, c, g, or t
  misc_feature (590)..(591): n is a, c, g, or t
  misc_feature (610)..(610): n is a, c, g, or t
  misc_feature (644)..(644): n is a, c, g, or t
  misc_feature (677)..(677): n is a, c, g, or t
  misc_feature (684)..(685): n is a, c, g, or t
  misc_feature (694)..(694): n is a, c, g, or t
  misc_feature (703)..(703): n is a, c, g, or t
  misc_feature (707)..(708): n is a, c, g, or t
  misc_feature (732)..(732): n is a, c, g, or t
  misc_feature (741)..(741): n is a, c, g, or t
  misc_feature (743)..(743): n is a, c, g, or t
  misc_feature (749)..(749): n is a, c, g, or t
  misc_feature (752)..(752): n is a, c, g, or t
  misc_feature (838)..(838): n is a, c, g, or t
cacattcgcccacccctgcgtcggngctccccactcagggttgggccggggggggggcagcgttggtctgggagcgnttttgcgctcgctggtgtgtgagcagttctttaggtgacatgntgtttcattggtttatctctcatttcgggcttgctgggttttcttccnntgtgtagttattggccagctgcaggtgaggcctgcttggtacgtctcatctcttaantgcttggttggccagtcattntctccgcatanggtcacctttcattgagctgggggaatcgtgtgactagttgnttctnntaggtgtggatgtntaagggcttntgttnctcntgctcctggagtagaggctgtactttgtcctcccngtnnntgttncgttggttttgctntgtttcntgnttaaatttttgggaggtggcgtttaagagctcctcattcnttnttacnagttcttcgtngctcagggtttttggttttgtgttttggtcagcggtttccctggggtttgttctttcgggttccttntnttcctntggttntagtttttcttttgttgctctctggtcttcnagggantnctnnaggtggtcctcctctgcangccgcagccactgcttagccacctccctcctctntagcttccggagagtttccaactgctccttcangtgtgtnnagtacaggnttttttttntttnnaaaggacggaccctttcgccgaanccgcctgcngncggcanggnccgcaaaggcagccaggtaccactggtggaagtcctgcagcttggcagcgcccttcctcttgcgcttctgtcccagagcctcctcnacacagggggggacagagtaaggcc

SEQ ID NO: 592148 - DNA, 1276 bp, Homo sapiens
ctggtgagatcttcccacaggagggccagcgctgtggaccttacaacgccgagtgcactgcagttcttctgtgccctagatgcacggtggggacccactgctcggtgcgcacctgtgctggtgacatcacggatggttgcatggagtgtcgccgttgttctcagacctctgccagctgcccaaaacaagccaatagagcctccacaccagtagaccggtgagagaaccagtgtcccgtaggcgaattcgttggttgcacacgccttcgccctctttctaccagctgagatcacactcctctgaagcccaacgaaggtgcaactgtgaatatggaacttgtttgacgtggtcaacagatacttgagctggtactagtggtacgtcgagtcaccacctgtgggcgcggacatgaggcatcgagctgtgtgcacccacaaaatgtaccaccccgattggcctatgaagccagagtgagtgggatcacgtgaccctaatagggtatagtctacagaggtgagctccctcagagcggagtatgcatggatggtgattcaagaaccattagactagacgaaacgagacacttacgtacaccggagagaggacccctcgtagacctgtgcatttgcctaatgctcttgtcagatctctttgtgcaatgcccttccatctttcccatatgtgacccactagggagctgtgaatccatccgcagacgaaagggttgcatcgatatcgcgaaactgcgaaactattacgaccagggctaaatcacggggacagaaccgttcattggcctggagggactaccacttggtgacattggggggggccaccaggggacggggcgaattcccttccactacccagcaagcacgggtagggcgccaaccaacattctccttggtaacacggacggaggatatgtctggggacaggacttaccaggacgcgcacgaatggcccacctttcttcaacttcaaaaacaaattaacgcaagaactaaaggcccttcaggaatagtgacccccagtaggacagtaacccttggagaagaaacccatgcggaacgggaggcgacccactttgaagactggtggaacctatagcgcctcggggggccccagtgacccaaaacccgtagtccagagcatgaaccacaacagcgtatatccaatgcgactaggggcccaacaacagctgcacgacagtgagcaaaaccatggggacacagaaacacgcttggtgctctgcgcccagtagcacacatggtgg

SEQ ID NO: 592149 - DNA, 172 bp, Homo sapiens
gtgacagtcagtagttacaccattctgccttatggtatcatcatctgctcatcttctcttcctgtcctagcattgaaactttatatgaggtcatggaaactccataattgattttacacactctttttcttgtattctccccactgtatggatgtgagtaccaccatgatgg

SEQ ID NO: 592150 - DNA, 127 bp, Homo sapiens
cctccccctccccccccccccccggccttcagcttccctgggaaggtccatgggcgttcctggggaaatcgataccccttcggctttgttagaataacgcgaaaccttaaaacccagaaagggttta

SEQ ID NO: 592151 - DNA, 315 bp, Homo sapiens
gtctgtaggacggtcgcagagtatgcagtggcggtggacctggcaggtcggctgcgaggagctcctgcggacctgccgctgagaacgggctcgctgcagtacctgctgcgtcacctacgcaggatcgtggaggtggagcaggacaacaagatgacccccgtggaaacctgggcatcgtgtacgggcctacgctgcttcggccacggcccaccgaggccaccgatgtcctctcctccctggtggattatccccatcaggcccgacgtcatcgagactctcatcgtccaaataacggactggtcttcgaggcggagc

SEQ ID NO: 592152 - DNA, 265 bp, Homo sapiens
ttgggggttccctgcccccccttcctgcagccccccttcttgaagtgtggtggcaggggacccgattcttaggggccctccaaagccaagcagcttgcgatttttggtacaaaaattagccggaggggggggggggcccatgtggtcccacctgctcgggaggttaaggggggaaagtcgtttgggcccggggggtggagcttccagtgagccaagttcatgcccctgccctttagcctgggggccaaaatgaggttttgtccca

SEQ ID NO: 592153 - DNA, 660 bp, Homo sapiens
tgactctacggatgcttatgcatacccatcactgcaatctgtatcattccgaacaagctggggatcaagccttcgtacgaccagaagaccttcggcgaacaggagaagcgcggcaagctgcgcgtggtggtcagtcccgacggcgcggaaggttcggtggcgatccagcaggacgcgcgcatgtatgccggcctgttcgatggcgaggaaaccgcggagctgtcgctgggtgacggccgactggcctatgtgcatgtcgtgcgcggcaaagtcgatgtcaatggccgccgcgtgtcggccggcgacgcgctgatgatgcaggccgagccgcaggtgcgcatcgccaacggcgacaaggccgaagtactggtgttcgacttgccggaaaccggttgggaacccaactgatcggcggacggaagacgcaaaaagccccctggaatgggggcttttttgtgtccgccttgcatcttcgcaatccgcggacacaagaaggcccgccagcctgaagtcgtaatggggaggggagcatacgtgcttcggcggctggcgggcctgcagtgaaaattaccggctcgcatgctgctttgcaacggaaaaatgcccttattcatgcaacgctgatgaccgtattcccgcattcagcgactgggtttgcga

SEQ ID NO: 592154 - DNA, 905 bp, Homo sapiens
gaactaatcatatgtgatagtctgtcttcgaaaccacaattatccccaccttggtatcatcagccgatgaggcaaccagcagaacgcctgatcgcaggcacatacttcctattctacatcctagtaggttcccgttcccctactcatcgcactggagcttacactcacgaagaccctaggctcactaaacatgctactactcaatctgccactgcccaagaacctatcgaaactcctgagccaaacaagctgaatatgactagcttacagcaaggagctggacatagtagaaggatacctctttagggactccatgaaatgactccctaaagcccgatgtcagaagcccccatcgtctgggtcgatagatacgttgacgccatgatcctcttacaacgtaggcgggtatggtactaatagcgcctcgaactcattctcaagccccgtgacggaacagcatagcctacgcccttccttgtactatcgccgtatgcggcataaattataacaggctccagtctgcgtacgacaacacagacctgaaatttgtcatcgatatcttcaatccagccgcataaacatcgtaagtaacagaccattctcgatacaagaaccccctgaagcgtcacgagcgcagtcattcggcataatcgcaggggtttgacattcttcattactattctgcttagcaaactctaactacgaagggcaccacagtcgcttataatcctctttcagacttcaacattcaatcgagtcatagtagacgaatctaagcaagcctgacattctgattaacccaacatacacacgggggaacctagggagaacccgcctcggacaactccccacacgaccaacacagacacgattcactaattcacaacgggctcccaagacaacaa

SEQ ID NO: 592155 - DNA, 336 bp, Homo sapiens
gtcaacctttagctgcaacctcctaacccccctaagccggaggggggttcagcttatcccggcctaaaatattcataatgggtggggtcttttgaatgaattcatgtccaaaatgttattcagctgggggaatttctctaaatggaccctgattctgggggtgtgatttttaaaggagaacatggttccagccagtccctgttaaggccaacttttgatttttcctttatttttaattttcttaaaatggggtttttaatttttttttaacctttgggtttagcctatttctttggggctttgtttttttcttttaaaatgaatcttgcttcccca

SEQ ID NO: 592156 - DNA, 431 bp, Homo sapiens
ggatgcgttgccgtctctctccgtcgctgttctctcccgcgtgttcgcctgtcacggctctggcttgtcctgtctcgcctgcgtgcggtgtgcatctatgggacttccactgtcgccgtggcagttctcgtctcgtgggcccatgtccgtccctgcgcgtggtatgccaatgatgctagctgctcgtcatcaatagcaccgcaatggcctatgtctcaaggcacgaacgtctaagcatctctcttgggtgcggtgccacacatcccaatagcacttgccattgttgcctggcatgaagtgcggtgcgctatccagcttcctcttgctccaatccaaacgcttgtggaatggcctttccttgcagttcctggcagcactgtggatgccttggcatgtcccaattggtcttagaccatgtgaatgcatggttg

SEQ ID NO: 592157 - DNA, 274 bp, Homo sapiens
acctgctgattagcaaagactgatgagaagtagacttttttgggggagatagagtctcactctgttgcccccgctggagtgtagtggtgtgttcttggctcactgcaccctccgcctcctgggctcaagcagtccttctgccttagcctcctaagtagctgagactacagacgtgcgccaccacacccagttcatttttgtatttttagtagaggcagtgtttaccatgttggccaggcaggtctccaactcctgacctcaagtgatatgttca

SEQ ID NO: 592158 - DNA, 1391 bp, Homo sapiens
agcgggcccgagcgagctgttctgtgacctcgcacccctgcgctgcccctgtgccgctgcctgcctgccggcttttgtttgtctcctgcctcctctgtgcctgcctgcctgcctctggacctgctgagcctgctgctgctgcctgtggacctttgtgctcttgcccttctgctgttggctgtggaacttgctgcagtgaccctggccagtgatcctgagagaggctgcgggcttgtggtggcctgtgtgtgtgctgcctcctgtgcccctgccatgtgatgtctccctggtggccctgatgtgcttgtgttgtgcattgctacttcgttgctgtgcctgccaggcaggcttgtgattcgacccttgtctggaccactgcttggtgtggatcccctgtgacacaagacaaatagagcacctgagaaggcttggcctgggcagaatgtgtccctagcaccatggagtcgtaggctgtgacggcccaaaagtgattgcctttccaggaccactttgaaaggcaggagcaggttggcccacccaaaggggcagggggaggagaaatccctctggcggggataggaagggccaagcgcgatggcgtggacttccgttgagtccgcaccctaggtggggcattagcagacaccccgttagccggtttgacagacagccaggacgtgtagggagttgagaaggcggacagaaagagcccgttggggcccaagagagcgggcacatgagcccatattggctcccggacagacgttgcggaacaggaaaacacacttgggagtggcaattccacaggtggaggcagcacagctgagccaatagacgcaggacgcgagatcagccaatttgaccaatgatgcgcgcccaaagtttgcgcagatttggcaccagaagcgcagccgtagggagcgatgggcgaggccaacggagattatctatgaacatagaacgaagccaacagcgtaatacgcacaaagaggcgcgagagccaccgttggcggatggggagagcatcgcacgtttccatggcggacagactccgtcgggagcagcggccattgggagccacagatgagcacgacagcatcgtgttattgccgcacgaccccgggggacacgagacccgcttaatcgtgcggatgagtgaaagcaccgattggtgatagccagacgtgaccgagggcacaacgcgacgcggaacgggtacggcccagttgatcgcacgtggtggcagaccgcttggagtgcagcgttgacaagccacaagtgcgatgttcgacggtcccgccgtgatctagacgcttgagccgccgtacaggtggcgtgtgtgacagaaacagagcggtgagacacaggccgtaggagacagggccagaaac

SEQ ID NO: 592159 - DNA, 840 bp, Homo sapiens
ggggaaagaggtgagagggccaaggtaggctgtgtgtttgacgtcagggaagagggcctcgtgatggaaaatgtgggcaacataagcaaaaaccagaatcaggaattgtacatcaggtggcacttgtataactttaaaaactgacataatgtgttatgttttccctttgtaggactggtataattcagaaaaaccttgtgtgtattggctgtcaggtttctttttcactcaggcctttttaactggagctatgcagaattatgccagaaaatataccacccctattgatttgctaggatatgaattcgaggtatagtaactccttaaagtcaacagtatatcattacattaagtcatgtatttaaaccgagtctatgtatgtaacccatggtaagcaagttttacttcattctttgtgtcgtacgaatattgtcttgctatcccgttagaacttgcactatattgcacactatctgatttacgcgtaactccaacggctgttcttctactttagcaaacaattatgagggtacagtacaactctggctcacctacgttcaggaacgcacgtactttgtatacctcgttacaacactaacggctgaacacaatgtatagccttaacaagctcattatacaatagagtatccctgcaccgtggtctcgaatctaccggctcatggtgctccctactgcaccatcaagtcaggtccgcaaaacggctcccggccaactgtgtgccacatccccttcacgcgtaatccaccatccgactacatgcgacacagcatccccagaaacatggcgctaatatcccacggcaccggtatctccgacgaa

SEQ ID NO: 592160 - DNA, 164 bp, Homo sapiens
acatcatcaccataatctgacaggtcaacatgtcctaccatactgtctactccacctcaaaggctgtgcaaaactctacagagtataacgtaataaatagctatgcagaaaattctccacaagaaaacagggggtaccagaagcatcagaaattcagtaaatcc

SEQ ID NO: 592161 - DNA, 730 bp, Homo sapiens
  misc_feature (682)..(682): n is a, c, g, or t
acgccaccagggaggcgcggtccttctccgtatagtggagctggtattgatgctgctgctccccacattaattcttggcatcttcttacatctgcccatgaactctcgcaagggcctgctggctggagatgctctacgactctgcccttgattggcgcgtacgagacttacgaccatacttgagacactgtcagcctgcgcagccacctcaagagcacagactctgatggccatattctctaatccaaataggatgcttccacggggaaatgtgcctctacacactgaagattatgacacgtttcacatgagtcaagcgagacccgcaacatgtctgagacccgaccaactacagttgatatacatgatacacctagaggaggcgaattatctcgactagatagcacaagtttcgtctctctctgcattgaaagacgatatgcgacgcctataagacctttgagagaatatacgcgacgagatgagatacatcaagaacttagaagagtagatgcgtgctgcctacctgataacaaacacatctgtactatacttgaggatcttacgaatgttgctgttccttgcactagatacctgcgaggagttctacctgctgagcttcttctagccaacaaattgattgtgtatcaacgatggatattctctcacagcgtgtccacgngaccgcgtagtctattgtccatattttttcggggggggacgaggtggc

SEQ ID NO: 592162 - DNA, 428 bp, Homo sapiens
ggtcctattttcacggggtcttcatctctctctttctcggggatccctattccctaagacacaacaatattgaaagtaggccagttaataaccctacaatggcctctaagtgttcatgtgaaagaaagagtcacaggtctctcactagaaatcaaaagctagaaatgattaggcctactgaggaagtcgtgttgaaagctgagataggcccaaagctaggcctcttgtaccagttagccaagctgtgaatcaaggaaaatgttcttgaaggaaattaaaagtgctactccagttaacacacaaatgataaaaaagcaaaacagctttatttgctgacaggaaggaagttcaagtggtctgattagaagatcaaaccagccacaacattcccttaacttcggggggggggggggggggggggggggggg

SEQ ID NO: 592163 - DNA, 141 bp, Homo sapiens
gggggggggtctccgtggtggtggtggtgatgggtgtcatggttggggtctgtgtgccggtgggtgtaggggtaggggtcactgtagtggtggtggccatgggtgtcgggataggggtctgtgtgccgtaccggggtgttg

SEQ ID NO: 592164 - DNA, 112 bp, Homo sapiens
tagttcttccaccactgtcctttttctgtatcaggatcttggtgaaggccaccagaaatgaagacttgttccaccagatgctccagacagataattaagcttcagtagttag

SEQ ID NO: 592165 - DNA, 133 bp, Homo sapiens
taaacgggaggggcgagacgagacttaacatccggggctgtacccaggcagaggagcgtagacccccaccctgtttggaagggagaacccatcagaatcgcctggggtgtagatgaaacagaaataaaagaat

SEQ ID NO: 592166 - DNA, 243 bp, Homo sapiens
  misc_feature (33)..(33): n is a, c, g, or t
tcaggctcggcccgctctggtggtctctcctangaagtgcacttacatataaataacttgcatctaggctgggcgtggcggctcacgcctgtaatcccagcactttgggaggccgaagtgggtggatcacttgaggccaggagtttgagaccagcctggccaacatggtgaaaccccatctctatcagaaatacaaaaaattagctgggcgtggtggtgggcgcctgtaatcccagttactcg

SEQ ID NO: 592167 - DNA, 568 bp, Homo sapiens
  misc_feature (455)..(455): n is a, c, g, or t
cctgaggacgccatccctgttggagagtggcgatgaggacgatatacgaccctgacgaagcgcatctcgatctgctcctctgtacaaacgcaattgcgctgtgaggcaagagttctccgagttctgaacgaggagggagaggggggccggcaagaactcttccaacgttcaaaaaaagccaagacgagtcaaagacagaaggatgaaaacagagagagacccagagcgagaagaacagaagtcaccgaacgaggagaaaaccaaggaggagaagccagaagccaaaggggtcaaggaggaggtcaagttggcctgaatggacctctccagctctggcttcctgctgagtccctcacgtttcttccccaacccctcagattttatattttctattactctgtgtatttatatcacaatttattaaatataaatattcccaggcacagaaaccaagngcccgaagctcagggcagctgtgctgggtgagctctttcaggagccaacttgtcacccattctttccgcacttaactatgaaccggcgatgcggcatggggtaccgagctcgc

SEQ ID NO: 592168 - DNA, 969 bp, Homo sapiens
  misc_feature (1)..(1): n is a, c, g, or t
  misc_feature (473)..(473): n is a, c, g, or t
ncaggaagaggtagagagcagcaagagaaggggcaaacaagagacgtgagcagactacgctgacacacgttgagatgtgcgcagccagccggaagtcatagcggcaatgttgcacccagcataggtggaccacaagagaagatagcgcttcgcggatgccccgggtgtgaacctgtcctcgggcggcaaaatggcacacattgccaaccagggggccacacacggctcgaagacctcgcatatgttccgcccaattgtcgttggcctccaggcgccacgaagggatggcgcccccacgcggccagggcccgtctatcgcacgctgagagggggttcttttgttgtaaattaccgcctgccggcccacggttttcaagcactcctcgagtttgtgagagtgttcatacaacccaaggggtcagtacacaactgtggtgggttttttccggaaccgtccacgcatccctgagctnccgatgccgcatttgtgtggcttggccaccacccacaaggagaaccccttggtggggggaccacccgtcttccatcccccggtggtgtaattacatggcacccccaccagtgagtgcccttgccccttcgatttaagcgtcactcagtgacacatctgcggggcacttctaggcttcacaccacggtcttataagggggattctttttcacggcgcgccgcgagtgcccccaaatttgatggaggcttattctggaccctccatagaaagaaggcgcccgaaagagcccctggcttggattaatgcaccacaaccacagtcacgaggacccgttttgaacgttctgattatggcccggaagcattagtatttgtccgccgggatcccgttgtccgaagttcacaccctcaacgcccggctacatcactcataacccagtaaaagacagatttttcacggggttccccaaagaattttgggcacccacaaaaaaaca

SEQ ID NO: 592169 - DNA, 144 bp, Homo sapiens
  misc_feature (46)..(46): n is a, c, g, or t
cacgagggcggggaaaggacggcttaatgccagaccgggagttggnggtgtccgatctcgagttgggatccaacaaggccttctcaaccagtcaacacgcacaaccaccttccaacaaagatttgatgcccggcaaaagattgg

SEQ ID NO: 592170 - DNA, 125 bp, Homo sapiens
cctgggctatgcactctactagtacccacagctgggggccaggcgtgccccctactactccctacccagcacctcatccctactccacgtacacaacagatacccccaagtatagctgtgtgagg

SEQ ID NO: 592171 - DNA, 857 bp, Homo sapiens
ctagattttaagtcccattgaattctctcacttttgcttatgttatggatcaggtcttttggggaccagctccttgattccaatctctctcttaccagcacatggaaaatgctggggccttctagctgcagtgatgttcttgtgcctgtgcattccacaggaaggctttgtgctaaccatccataatggggagatagatgcacattcaattggtctctttcttactgttttaataagcaggcaacaatttgtgaccaaaattcagcagtttaaataattaatattctggctgggcgcagtggctcatgcctgtaatcccagcactttgggaggccgaggcaggcagatcacctgaggtcaggagttcgagaccagcccggccaacatggtgaaagcctgtctctactaaaaatacaaaaatcagccaggcatggcggcacgcacctgtaatcccagctgctcgggaggctaagacaggagaatcgcttgaacccgggaggcggaggttgcagtgagccgagattgcgccattgcactctagcctgggtgacaagagtgagactgtcaaaaaaaaacaaaaaagattctagatatcctttcccacctgcatcctctgggaaagtccactgtccccaatggggtaccaggactctccagtccggcacgatgaagcacacattccggcacggtgatcagcgtacccaaacagtacatggtgctacggccactgaaacgttccttcaacaatggccgtcccggcgcttggcgcatcaaggccggaaaccacagacattggcaaggcccagtgcgcggatcaccgatccggacttcaaccagcggcacccgcgcagagcccc

SEQ ID NO: 592172 - DNA, 118 bp, Homo sapiens
taccagcgtcttgcatatctctggcatctacacttacacgctctgtagctttgccatgttctccctctacttctgtgtgtgtgccttttacctttcttgactggatgtcttttgcacg

SEQ ID NO: 592173 - DNA, 394 bp, Homo sapiens
catttgatgccccttgatgctgtgtaatggcctttctttgctctgactttctggagactgctgtggctcagtggctgctagctcagttctggagctgggccgaactctggtttaaggccttctttgcctctcatgagttgtgtggctctgggctgtttccttggttgtcgtgggactaatattgccgatctcacagtcctacggagaagataaaacaggacaacccattagctattcccagcacagtgtgtggcatgcaggaagcgggagtatcactaaatggttcatagaaatatgaggccatgccttgctattcctttaaagaagttcaaagatttacaatcacatctcaggaagggccttatgaacaaaaaagggaaccttggggattctg

SEQ ID NO: 592174 - DNA, 228 bp, Homo sapiens
gcaggtgcctacaggactcacgtatatgtacagtctaaataggaataaggcatctggaaagacgaggagcgcatgattgaagcaatatacatataggaaaatagcgagaaatgaagtcagtgaggtacagtgttagcaaattacaaggttaaagaatttggattttatcctgctatagtaggattttatttatggaggttcatgaacggtgttgacaacgatagtgag

SEQ ID NO: 592175 - DNA, 1290 bp, Homo sapiens
gtggcccagcctctcctcacgctcgctgcagtctccgcgcgcgagatctcagtctgcagctgcaggactgagccagtgcaccctggaggagacccctctgtgaggatggctgacaaacttctgcatgtgcctgctgaccctaacctccgagcccttgtgcactgcatgcaatgtgaccagactgttccttgccccctgactggctagcccatggtcctgtgcccgagtgctccttgcagcgtttacgcatgatgttctcgtgaacggagacatgactcagacggaccgcagcttttcagcagtgctgcatctgcggtgcgacgctgccactgcagtggctgtgctcggcagtgcgccctcaccatcccttgccactgtccacgtaccatgctggccaaccagccgacgcctgccgtgtgctagtgcctaggtgcatcatcctgactggagtcaaaagtggacctttccatgatccctgggggccaggagaggcacgaggtgcttggtggactgctggtgggcagtcgctagcgtcaagggtgaacctgaggacctacccggttaccgcgtgggcacatgcctggcagtacccagctgtcgactcaccgaacgtcattccctgagcgctagagacgaagctgaatgccccaaacgactcagggtatctattctggctgttgcggtccagcacggcattcggcttgaaccagcaggcgacggcatgtggacacggtcaacggtcaacaggggtcgactatctcttaccccgaacagggctcattgcacctgctaatgcctttacgtccattatactggtggagaccaacagacaggaccttgttccctcgactttagagaagccccacaattcacgccacacccggacagaagacatataatgcacgacttacactataggagagctatcaaccacctgtaaattctaggctcggcagtatcagagcacaaaccgggcgctcaggcatccccaatccaagaacccccagccacaagacccgtttaccgcagaacacggcattgcaccacccgagcagccggacacaatacgtactggaaccataagcaccacaccatcagccaggacgagaggacaatcggcgacagcagggagtacaccgaaaagagtaggacacagaggacacaacacagagaaaaggcaagccaccataatcgagagcacactcaaccggcgaaaagccgcagaaaaagtgaactcggcgagccaactcaagcaacgaacataaacagcaagagctgcgaaccaaaaag

SEQ ID NO: 592176 - DNA, 697 bp, Homo sapiens
  misc_feature (644)..(645): n is a, c, g, or t
  misc_feature (697)..(697): n is a, c, g, or t
gttttctgttcctgcgttagtttgctgaagataatggcttctagcttcatccatctccatgcaaaggacataatcttattccttttttggctgcatagcattccatggtgcatatgtaccacattttctttattcagtccatcattgatgggcatttgggctgattccatgtctttgctattgtgaatagtgctacagtaaacatacatgtgcatgtatcaataatagaattatttatattcccttgggtatatacccagtaatgggattgctgggtcaaatggtatttcggttctagatccttgaggaatcaccacactgtgtttcacaatggttgaactaatttatatttccactaacagtgtgaaaaagttcctatttctttgcagcctcgccagcatctgttgtttcttgactttttaataatcgccattctgactagcatgagatggtatctcattgtggctttgatttgcatttctctaataatcagtgatgttgaacttgtttttatatgtttgtgggtcacataaatgtcttctcttgagaagtgtctggtcatcggctctgcccattttttgatggggttgtttggttttttcttttaagtttgttaagtattctcttccctctatacttagaanntctttctcaccagggctctcatcaccccctctgatctggctgttttctgctn

SEQ ID NO: 592177 - DNA, 201 bp, Homo sapiens
  misc_feature (103)..(103): n is a, c, g, or t
  misc_feature (137)..(137): n is a, c, g, or t
  misc_feature (139)..(139): n is a, c, g, or t
gctcttgggaaagacctctgtccgccaggccttggcagacagtctaccacctctcccagtcctgggccccgaagcccaaaggccccgccagcagccgcctggnaggaacaaaggcttctcccggggccctgggcagncncttcaccctcagcttcccacccccagggcctagacacgacccccaagtcacactgaggtgcc

SEQ ID NO: 592178 - DNA, 216 bp, Homo sapiens
  misc_feature (22)..(22): n is a, c, g, or t
  misc_feature (139)..(139): n is a, c, g, or t
  misc_feature (149)..(149): n is a, c, g, or t
  misc_feature (157)..(158): n is a, c, g, or t
  misc_feature (182)..(182): n is a, c, g, or t
  misc_feature (208)..(208): n is a, c, g, or t
gattaggaaagcaatgtctcanccaatacagaatatcaataaagagattgaaattgtagaaaagaaccaaatagaaattctggagttgaaaagtattataactaaaactgaaaattcactagaggtattcagcagcagnctggagaagncagaaganngaatcaacaggcttcaagataggncaattaagattatacaggctgaggancagaaagg

SEQ ID NO: 592179 - DNA, 126 bp, Homo sapiens
aattcacagacggttagaagatacgctgttctagaaagaatacatttagaatcttacctttaacaaaaaaaaaagtccatacgtcgtccgtgcacgccaggaggggtctcaggagagatcgtccgg

SEQ ID NO: 592180 - DNA, 479 bp, Homo sapiens
aaacacatcataatgaaatcaacaccatattattacaaacttctctttcatatttatctggggtcacaggtttctcaaaggactgtgggcttgaaaatatagtgtcaatggagcttcaatgccagtctaatggtgatggcaatgacccataagattctggagttgggactgggtgtggtggctcatgcctgtaataccagcactttgagaggccaagctaggcgggagtttgagacctgaggtcaggagttcgagaccagcctggccaacatggtgaaaccctgtctctgctgagaatgcaaaaattagccaggcatgatggcccatgcctgtagtcccagctattcaggaggctgaggcaggagagtcacttgagcctgggaggcagaggttgcagtgggctgaaatcaggccaatgccctccagtctgggcagcagagcaagactctgtctcaaaaaaaaaaagaaagaaagaaaga

SEQ ID NO: 592181 - DNA, 111 bp, Homo sapiens
cgtatatgtaaccaagttggatttttgtgaatattgctttgcatcagctaggttcttatttgattttatttgctctgcagctgtgtgtctgtctcatgtgacatagtacgg

SEQ ID NO: 592182 - DNA, 313 bp, Homo sapiens
  misc_feature (165)..(165): n is a, c, g, or t
ggggggaaaggcccccccccctcttccccccagggggggggtttaggggcccccccccccctttgagggggccctctcccccctcgggggggggggggggggggccctccccaaaccccttaagggaccccgtttttggcccttcccccccagttttaacccccntttttgcccccggccctgggggttccccccgtctttttggggggtaaaaaaaggccttttttagcctgggcctaagtgaaatcccccaaccccctgggggggtgtgttgaaggcccttcacaaatgcctaaccccgttcccttgttta

SEQ ID NO: 592183 - DNA, 329 bp, Homo sapiens
  misc_feature (224)..(224): n is a, c, g, or t
ttgctctgtctccccagctggagtgcagtggtgtgatcttggctcactgtaacctcttcctctagggttcaagcaattctcctgcctcagcctccaagtagctgggattacaggcatgcgccatcatgcccagctaatttttgtgtttttgtagagatgaggtttcaccatgttggccaggctggtctcaaactcctgacctcaggtgatccgtccacctcggnctcccaaagggcttgggattacaggcatgagccaccgtgcccggcatgaaaagtattttcttttgtttgacagatcaacttttgggcaaggtgccgggattgcaa

SEQ ID NO: 592184 - DNA, 146 bp, Homo sapiens
tgagataagacaaatggcccggcgatgagatcgggtaaagatgaggggaggggagcgcgagcggccggggagggcggagaccccaataagagcaggccacgccccctcccctcctcccgttcgctgccagcggtcggtggcggccg

SEQ ID NO: 592185 - DNA, 554 bp, Homo sapiens
  misc_feature (82)..(82): n is a, c, g, or t
  misc_feature (87)..(87): n is a, c, g, or t
tcgacctgcatgtccgcaaatggctgcaaaagcccagcaagtactgatactggagttagaaataaattttagcaagaggtanattcncacatacggagtctgcaaaaaatgagaattgactattatgtgtgtgtatattatatatatgataaaaaacaaaagaatgataaaaattcccaataatgtttactttggtggtgagaagaggatggcaagtaaaataagtctgtattgttatcagcaattatctagtttgaggttggacagtggtttcatcataggtattgattatattataaatagcccaacctgaactcatgaccatagtgtggtgttattacttagcgttattctagacttattagccattgtatttaaacaagaggaaatagagacattgaagataaagtggagccaggcacagtggctcatgcctgtaatcccagcactttggcaggctgagatgggttaatcaagaccagaagttcaagaccagcgtggccaacatggcgaaaccccgtctctactaaaaaaaagtcgacgcggccgcgaat

SEQ ID NO: 592186 - DNA, 232 bp, Homo sapiens
aagggtctccaatttaatccttgggttgttttaccacttctttcgtaaatttatcaagatttctttcgcacaaatactctagcgcctcacaacaaacctgaccttgcgcaggaagtcgaccatcagcaccccctttacaacatcgttcatatcacaattgagaagatgatgaatgaagattcgcttccaagttccaagggcagatttattcctttaactgacatttccatga

SEQ ID NO: 592187 - DNA, 302 bp, Homo sapiens
tgactcattgattgttttaggaacgtattgtttatccaggtgtggtggctcatgcttgtaatggtttacagtgtaatcccagcattttgggaggctgcggtggggggattgcttgaggtcaggagtttgagatcatttcaggcaacaaagcaaaacttcacctctaccaaaaaataaaaataaaaagttagctggctgtggtggcttgagcctgtggtcctagctactcgggaggctgaggtgggaggatcacttgatcccaggagttcagggtgcagtgagctatggttatgctaccacac

SEQ ID NO: 592188 - DNA, 859 bp, Homo sapiens
  misc_feature (384)..(384): n is a, c, g, or t
gaaatggattttgaattatatcaaaattctttttgacatctctcagggttgtatttttttcctttaactcatatgtcaccattaggtttttaaaatccttttaaatattttatttctagtgtaccttggagttccctttttcctcctttttggggaaagttttgaaaatgttttgtttttgtgtatgaaaagaatagctcaccaaggaagaaggggagtgtttttggtgaaataggaaagaagtctgaaactgtaggagaggaggggaatatggccgctgataaaaagcactagaggaggggggaaatactcttccataggaaggcttccagctacaaagatttgaagacatttttctggggaagtaaaacactaaatcagcantattttccaaagcccagaaaataacttaatagattgtttttaaattactgttttaattcagcttgtgaagatattctgaatagttcatgtagaatatcttactattttgcagatacttttgtataaatagttgccagtgagaaatgttgcaactgtgtcttttcaaatgaagtaaataggagagctagtatagcgcctgaaagaagtaagtgagttatattgtaacttcttgctctacctcagggtaagcactccttttagcatttattaaactctcattatttgtagagaaattatttagatgtaggttgagtattcctaatctgaaaatctgaaacacaagatgctctaaaattcaaaacaggatgctcaaaggagatacttgtttgagcatttcagacttcagattttcagattagggatgctgaactggtaagtataatgcagatattccaaaatctggaagaaaaaaaaa

SEQ ID NO: 592189 - DNA, 103 bp, Homo sapiens
agcggggtcgccgcctcctcccttccccgcctccgccggcgctgcctcctccctccgcccagaatccttgactccaacatgaaacgcaaaaacatacagcacc

SEQ ID NO: 592190 - DNA, 193 bp, Homo sapiens
cttgtcgcgctggggctcgaggcctacggtacctaagttggcgcaaaaagaccccgcgaccctcgaccctccctaaaatcaccctatccagccaaacggtgtgtgtcgactcccgaccgccctgtataagcaaaggcaaaggggacaagcatgcgaattttgatagccgaagacgccacatcgcgacatgggt

SEQ ID NO: 592191 - DNA, 233 bp, Homo sapiens
cgcacagtgtgctcgggatgtggaacacagagtcaaaggggataatttaaaagctttaagattaaatgactgcccggtagggtttcagggaccggtaacccctttctttaagccaattcctcccttcgggaaggggaatgcttacccaaagcctgtaccctcactgctatctggaagctcactacctggtctgccttcccgggctcaggggtggaaggagctgagtctcagat

SEQ ID NO: 592192 - DNA, 361 bp, Homo sapiens
gggggggcggatcgggtggctaacatctgcaatcccagcaacctgggaggtcgaggcaggcggatcacgaggtcaagcaatcgagaccatccgggccaacatggtgaaacctcatctccactaaaaatacaaaaattagctgagtgtggtagcacgtgcctgcagtcccagccactcgggaggccgaggcaggagaatcacttgaacccaggaggcggaggttggagtgagctgagatcgcgccaccgcactccagccggggcaacagagcgagactccatctcaaacaaaaacaagaacaaaaacaaacataaagttggcacagaaaagggaccaagttaaaaaaagggcgggcgctggg

SEQ ID NO: 592193 - DNA, 328 bp, Homo sapiens
caggactgacacatgacatgtgtcctccagtggaggggagacacacaggcagatgaggattgccatgcagtagctgctcagatgtgccagcttggctgtgtgggggagtgggatcgatggtgggagcagagtggtcccccttagcctgacctggaccccgtggagggggcatcagagtgaagctgtctctcccgtctctgtctgaccacctgcctgtttctgggtctggcctccttctgtctctagccttttgtgggcctgttccaacttccttccttgccttcttctctttttccatctctctatctactccaaccttctctctgct

SEQ ID NO: 592194 - DNA, 1099 bp, Homo sapiens
gtggcgaatcagcggacgtgcacatctcacggtctacaggcacgactctcgcctgctacctgtctggacgcacacatggtacatgtcagagcactatgcacaattattcgatgatgccataggggtcgagggcgcagcacctcgtgtgcatgaagaggtccagctgtcgtccgccacactgtgcacagaggcgataatggcactgcaaggttgccaagagtctcgctagctcaaaccggatgattccagtaggaagctggagggccagcagcagcttggtgccaagtcatggaacgaaaggtcgtgtgaaagccaggcatgtttattatggagatccgttgcaagatacttacaagcttcaagattgatgagtcatgttgtttgtagtggacgccatctcgccagaggaacctacgttccatgcaccgtgtgagacttgcgcttcagatcgatcgactggcgtcagactgagagtgcggaaccctgtcagggattgcgttatcgatgtggtaccatgtggaaagatgaggacgtaaacttccgcatagaggatccagtactattcacagccgacaggttggtctctggcatatcatgttttcagagccgtctgatgatagcgtcctgatcgatcaacaattactcacagcaggcctgggtgtgctagaaggactcagtgaccaagattaggggtggttggcttttgcaagggggttgcaaggttaacgtgcggtctacctcgtagcatgaaggaaatgggtacgagaggtggtagagactaactcgtgtggaatagctcaggccggggattgccatgtgactccggtcgagaccaatctagtctaatgaaggaaattggcaccttgccattcgatgatgaacaagcgtggtcccagaaccgatggtgcacctctgaaagttcgttgtacacaaggaactctcgccgcttgaaggggcctcgaatggactgtcgttcaaagacacaatttcgagagtggggaacaacaacgttcccaggggttctccagttggggggaaaccatttttaaatttcgcgagtggaacacagtttttcctcggacggttgagaacagattac

SEQ ID NO: 592195 - DNA, 269 bp, Homo sapiens
  misc_feature (36)..(36): n is a, c, g, or t
  misc_feature (88)..(88): n is a, c, g, or t
  misc_feature (111)..(111): n is a, c, g, or t
  misc_feature (159)..(159): n is a, c, g, or t
  misc_feature (183)..(183): n is a, c, g, or t
  misc_feature (192)..(192): n is a, c, g, or t
  misc_feature (206)..(206): n is a, c, g, or t
  misc_feature (218)..(218): n is a, c, g, or t
gcccccccccaggatgccgccaggtgtccctctccntcccctggggcacagagatatattatatataaagtcttgaaatttggtgtgncttggggtggggagggcaccaangccttgccctggggccttttttttattttctgaaaatcactctcgggntccgtcctcgcttgttggcatatncccagcccnttgtccaccccttnttgttcctgggnagggggaaggggggcacgggtccttgtaattattaaacatgaattcaatta

SEQ ID NO: 592196 - DNA, 888 bp, Homo sapiens
agcgtggttccctccgtttaggtcggctgccaaattatgtcctccgtcggttttccgcagtttttccacacaacatactagcagagggaaacatcctgatatctagctcggactttatgaaacgtttcctgcgcactggctcgcacagggggctggtccgttccgctaagacctactacaggtatctgtgtccctgcccggcctattgccggtggataacctagaagctggtggagcatactgaaccaaggggcaacgtggttcattgacaaacactgtgcaactacacagacccggcttggacgtaagtactcgcggtacgcctggtcaatttgcgcaccagaagacagggtgaagctctcagctgaggatgcctgactgtaggtaagtagacaaactagccttgctgacaaatgcgtgacttaaagagagcaagtgcggtgattccacattgtgcaaggcatacaaacacgtagcatgatacacttaatttcaacgcgcagatggactgcccctagaaaccatcattatgcaattaccagcgaattaatataaaagtggaacgcaatacacatcctacgtattccccaaaatgggagacacacttacgaacagcgggtcaattcacccacacgagatgtgcgatcggcccggtcatggtatgagctagattccatttcaagataacccgcaagggttcacagcggatttttccctgaacttaaggaccatcagggcccttaaatcgattcaggaattggaaaacgcagccatggagaccatgtaaagcaatgtgaacccatgaatgattccgaggctaataattagcgcattacttaagttatacatggccttttccgtccatcggaagccttgtgtttgtgggcc

SEQ ID NO: 592197 - DNA, 248 bp, Homo sapiens
cccaactccaaatcttttcagactttctggatcatactttaaatccctctattcctttcatccctttagcttcctgatctcactcttattaaacagcaaatgttccaccttcatatttgcatcattcacctctcagtggggtctttggaccttctctctctggccacaccacctattctgaccgttttaattgctatgagacacaggtcttaggaacctgagggacagacacctaaaacctgcagtgt

SEQ ID NO: 592198 - DNA, 369 bp, Homo sapiens
ttccttacagtagtgtttgcaaactggtgttctcctcaggatcacctagaaagcttatgataacagactgctggacactacccgtagagtttctgattttagtaagcctgggatgggcttgagaatttgcctttctaataggttcccagatgacactgatgctgctctccagggagcacacattaagagcctctgctctacaccagtggcataccacccttttcaagttaaggcaacatataaaatgataatttgtgtatgataccctggactaaactgcagagctcattcttagcttgaggtaaatagcccaaaacaatagaccttgtaactgaggaatcagtattagtccatgaggggaacctcaac

SEQ ID NO: 592199 - DNA, 177 bp, Homo sapiens
cgatctacggatcttagctcccactggtttgcatatctggggtgtgacataattcaacccataatatgcaacaacgtggataagggcgtatgctgagtgaaaaaaaagccaattccaaaaggtttcatattatacaattccatttatgtaacatacaccattgggtggtggccgggg

SEQ ID NO: 592200 - DNA, 821 bp, Homo sapiens
aaaccgggttcaacaatggccaagccacagatgttttcttgggagactgttgaaggggaaagagttggatttcgcccgcttttttggggtaaaaaagagcttgggaagatggcccccctgaatattctctgtaaaaattctggggtggatagctcgcccccctggtggataataggggtttccctcggggcacagacccccactagtggtgctttgtgaggagagctcttctctcacgagagctcatacgcacccccctttttgggggtctgcgcttttgtcctgtttctgtgagataatggaggagcacagacccacaggttttccgcgtgtggtggtctactcccaaagcacagtggaggcacacagaaaaggcgttgtcgctgggagagactgggcaaaaggttgctacacccacagtctttgcccacaggagataaagcctcactagagaaggcgttaaaatggaagatatttaatcccctctatacctcgccaccccccacctctttaaatcaacagctggtgtgagagagagcggctctcacgagactgtgttgtgtttccaattggcccacatttatagtttatgtagtataaagaactgggttgtaatgagtaaccacaaagcactcgtgtaaccttctcacgaaaggagaaaggagaaatgttttgttggagaccacaccttggtgttttttttttgggtgtggcagattttaagattattagttttttaaatcagtgactttttaaagggaaccaattgacccaaaaattgtcaccaggattttgagaccccatttaaaaagtttaatgga

SEQ ID NO: 592201 - DNA, 468 bp, Homo sapiens
  misc_feature (21)..(21): n is a, c, g, or t
  misc_feature (23)..(23): n is a, c, g, or t
  misc_feature (53)..(53): n is a, c, g, or t
  misc_feature (120)..(120): n is a, c, g, or t
  misc_feature (155)..(155): n is a, c, g, or t
  misc_feature (160)..(160): n is a, c, g, or t
  misc_feature (164)..(164): n is a, c, g, or t
  misc_feature (171)..(171): n is a, c, g, or t
  misc_feature (173)..(173): n is a, c, g, or t
  misc_feature (177)..(177): n is a, c, g, or t
  misc_feature (224)..(224): n is a, c, g, or t
  misc_feature (229)..(229): n is a, c, g, or t
  misc_feature (270)..(270): n is a, c, g, or t
  misc_feature (279)..(279): n is a, c, g, or t
  misc_feature (292)..(292): n is a, c, g, or t
  misc_feature (317)..(317): n is a, c, g, or t
  misc_feature (337)..(337): n is a, c, g, or t
  misc_feature (344)..(344): n is a, c, g, or t
  misc_feature (466)..(466): n is a, c, g, or t
cgggcactcagacatcatgantnggtccttagcaccccgcggaatttaaatcnctacttctatgctacttttatttctctcttcaacatgtgtagcacaagttgctaccagagacaactnctgcatcttagatgaaagattcgtaagtggatttntaagnttcnccctttntntgtnaactggagaggggcagaggaaaagaaaaaattccctcaaaaaaatanatctngcacttgtaactttttaaaaacaaagaacaaggtttaaccnatttttcanaaaagaatttaanagtagcatcagtctacatttttaancactgtaaaattaacagggnagttatngtccaacaacctgtggcattgcagatttcctgtctacttatcaaaccaaagtagacaaggatcaacagactttggaagacaacaaacaacaagaagaaaacaaaacatcagaagtcaaacanct

SEQ ID NO: 592202 - DNA, 566 bp, Homo sapiens
tcacacgcttagcagttctcaatttcccctccacctagctcctggacaattctagctttctagattctatgagtttgactactttagttacttgatataagtagaattaagcagtatttgtccttctgtgaccgatgtatgtcacttaacataatgtcctcaagggtcatctaaattgtcccatactgcaggattttcttttttttttttttttgggggctgaataatatcccatggctggtatgtcccacattttctccatccttctgtcagtgaacgttaagtggtctctacatctgggctatggtgaataacttcgatgaccatgggagtgctaatatctcttggccaacgggactttttaaaatattaaggggaatagggtgaagaatattattttatcaccccatagtaggatttttttgtaaaccttcggagttatcttcggggggggtgtgtgaggggtaggctggtgcatgggatggccgtgtaattatttcttactagggtccccagttgaagagtttgaagggcacagtctcagatttatttatcccaggaggtga

SEQ ID NO: 592203 - DNA, 751 bp, Homo sapiens
  misc_feature (9)..(9): n is a, c, g, or t
  misc_feature (172)..(172): n is a, c, g, or t
  misc_feature (208)..(208): n is a, c, g, or t
  misc_feature (271)..(271): n is a, c, g, or t
  misc_feature (322)..(322): n is a, c, g, or t
  misc_feature (338)..(338): n is a, c, g, or t
  misc_feature (367)..(367): n is a, c, g, or t
  misc_feature (371)..(371): n is a, c, g, or t
  misc_feature (376)..(376): n is a, c, g, or t
  misc_feature (380)..(380): n is a, c, g, or t
  misc_feature (387)..(387): n is a, c, g, or t
  misc_feature (390)..(390): n is a, c, g, or t
  misc_feature (401)..(401): n is a, c, g, or t
  misc_feature (404)..(404): n is a, c, g, or t
  misc_feature (407)..(407): n is a, c, g, or t
  misc_feature (412)..(412): n is a, c, g, or t
  misc_feature (424)..(424): n is a, c, g, or t
  misc_feature (427)..(427): n is a, c, g, or t
  misc_feature (429)..(429): n is a, c, g, or t
  misc_feature (439)..(439): n is a, c, g, or t
  misc_feature (480)..(480): n is a, c, g, or t
  misc_feature (488)..(488): n is a, c, g, or t
  misc_feature (505)..(505): n is a, c, g, or t
  misc_feature (509)..(509): n is a, c, g, or t
  misc_feature (524)..(524): n is a, c, g, or t
  misc_feature (528)..(528): n is a, c, g, or t
  misc_feature (578)..(578): n is a, c, g, or t
  misc_feature (586)..(586): n is a, c, g, or t
  misc_feature (589)..(589): n is a, c, g, or t
  misc_feature (595)..(595): n is a, c, g, or t
  misc_feature (603)..(603): n is a, c, g, or t
  misc_feature (682)..(682): n is a, c, g, or t
  misc_feature (742)..(742): n is a, c, g, or t
tggcgtgtnttggggggtgggtgtacttgctagtgctatcttcgctcttttttttttcagaagccaatgttctctaaatctgcagcttcattccacagctttacagaatcataatctcttgaatatttttccaatgttattaaaaaataaaaaatcatacaagatatatttngcacattaaaacttaagaggttacagtttaactgtnccgccctccaggtacccctgaatacttttccagtacaaagaggccaatttgttagaataattnattctctgtttttgcttttattaaaaaggggtttttggtggtgggagcaantaatctctcatttgtngcctgggatcctaaaatagggtcgttggnttcngggcntgcnacctgcngcntggccgcctgnccnacntgccngccttcctttcngtngngaggtacggngggcgtgggagccggctgacgatagatgaatactcggcggnggcactcncaaagggctgcctacgngtantttggggcacaggcnaaanattttttgtctctccttgatgcttggccctagcctaaagccttgggggtngcgcgtgngcncccgcntgtcatcntgtttgctggagtgtggttgccagagtagggcatcaacatcatggcgcaaacagaagcagggcatttctttaggatccnctatgacagagaaaaggttctgggttgcttccaagattcaccacatgagtagtttttaangtactgccg

SEQ ID NO: 592204 - DNA, 414 bp, Homo sapiens
cgtctattctcatgaaggaaaaatcctgtagttttctcgtaatgtccttgtctacctttgttatcagggtaatgcagagctcataaaacaagctggtcaatgttctttactcactattttctaaaagaggttgtgaagaattggtattatttcttccttaaaacgttggatagaattcaccagtgggaatcaggtgggcctggacttttcatgggagaacttatacatgactaattcaatttctttcctttatacagatctattcaggttttccatttcttccagaaacttttgataatttgtctttcaaggaatgtgtcattttatgtaaattgtcacatttatttgcataaatgtattcatatttccttattatcatttaaatttatgggatatgtattcatgtcaccgctt

SEQ ID NO: 592205 - DNA, 234 bp, Homo sapiens
tctgccttagcgctcatatagtcctctgttgccctctgctgagataacgaattcccttaacatgtatataatccacgccttgcaaatagctactggccgtcgtatcacaaaccatttgcctacagaatttcattcagtctacactttggcattctctctggcgatggagtgtggctgggctgaccgcaaaaggtgccttacacactgcccccaccctcagccgttgcccctaga

SEQ ID NO: 592206 - DNA, 943 bp, Homo sapiens
  misc_feature (24)..(24): n is a, c, g, or t
  misc_feature (33)..(33): n is a, c, g, or t
  misc_feature (43)..(47): n is a, c, g, or t
  misc_feature (52)..(52): n is a, c, g, or t
  misc_feature (61)..(61): n is a, c, g, or t
  misc_feature (63)..(63): n is a, c, g, or t
  misc_feature (73)..(73): n is a, c, g, or t
  misc_feature (88)..(88): n is a, c, g, or t
  misc_feature (95)..(95): n is a, c, g, or t
  misc_feature (98)..(98): n is a, c, g, or t
  misc_feature (101)..(101): n is a, c, g, or t
  misc_feature (104)..(104): n is a, c, g, or t
  misc_feature (109)..(109): n is a, c, g, or t
  misc_feature (120)..(120): n is a, c, g, or t
  misc_feature (134)..(134): n is a, c, g, or t
  misc_feature (138)..(138): n is a, c, g, or t
  misc_feature (142)..(142): n is a, c, g, or t
  misc_feature (146)..(146): n is a, c, g, or t
  misc_feature (152)..(152): n is a, c, g, or t
  misc_feature (168)..(168): n is a, c, g, or t
  misc_feature (182)..(182): n is a, c, g, or t
  misc_feature (203)..(203): n is a, c, g, or t
  misc_feature (205)..(205): n is a, c, g, or t
  misc_feature (247)..(247): n is a, c, g, or t
  misc_feature (251)..(251): n is a, c, g, or t
  misc_feature (263)..(263): n is a, c, g, or t
  misc_feature (267)..(267): n is a, c, g, or t
  misc_feature (281)..(281): n is a, c, g, or t
  misc_feature (288)..(288): n is a, c, g, or t
  misc_feature (290)..(290): n is a, c, g, or t
  misc_feature (295)..(295): n is a, c, g, or t
  misc_feature (341)..(341): n is a, c, g, or t
  misc_feature (391)..(391): n is a, c, g, or t
  misc_feature (400)..(400): n is a, c, g, or t
  misc_feature (429)..(429): n is a, c, g, or t
  misc_feature (434)..(434): n is a, c, g, or t
  misc_feature (449)..(449): n is a, c, g, or t
  misc_feature (458)..(458): n is a, c, g, or t
  misc_feature (461)..(461): n is a, c, g, or t
  misc_feature (468)..(469): n is a, c, g, or t
  misc_feature (471)..(471): n is a, c, g, or t
  misc_feature (474)..(475): n is a, c, g, or t
  misc_feature (492)..(492): n is a, c, g, or t
  misc_feature (500)..(500): n is a, c, g, or t
  misc_feature (504)..(504): n is a, c, g, or t
  misc_feature (508)..(508): n is a, c, g, or t
  misc_feature (520)..(520): n is a, c, g, or t
  misc_feature (523)..(523): n is a, c, g, or t
  misc_feature (527)..(527): n is a, c, g, or t
  misc_feature (553)..(553): n is a, c, g, or t
  misc_feature (625)..(625): n is a, c, g, or t
  misc_feature (821)..(821): n is a, c, g, or t
  misc_feature (876)..(876): n is a, c, g, or t
  misc_feature (931)..(931): n is a, c, g, or t
ttctcaaaccccataatgctggtntccagtgcntccgttctcnnnnnctgangctgatggncnccagattgcntgtgaaggtgaaggntattatngcnganggnaaccnaaataaaaganaaacagctcctggnagtnaccnatgngaaggncagataagagtttgangactgtggatgtgnctgcttgttccctggttgacncnctgaagaagaaatcatgttgattcagagttggcttggaggcnaganataatggcggcngctncgggggatcctggnctctctnanctgcngtttgccccttttagtagtgccatatagagatgttgggttttggcntgagttgaccccgaagaagctgaacgagtatcggctggatgaagctcccnaggacattnagggttattactaccatggagtgctcccnccccngcccgttgctgcccngctattggnacnctgtatnncnccnnccccctcgagtctttcnagactgcngatnagangctccttttggnacnagcngccaatgagatatgggaatccctaanatcaggcactgctcttgaaaaccctgtactcctcaacaagttcctcctcttgacatttgcagatctaaagangtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaanatggtgctggtttccttgcttaaacactacagtgatttcttccaaggtcaaaggncgaagataacaattggtgtatatgatcctgtaacttagccagtacctggatggcnttgaggattttt

SEQ ID NO: 592207 - DNA, 149 bp, Homo sapiens
tccgcgccgcttcctgcttctgccaccagaccctgcttcctgcttcgcttcctgcttctgctgcttcctgcttctgctgcttcctgcttctgcctgcttcctgcttctgccctaagcaaagagaacaaagctgacttcaaactatacta

SEQ ID NO: 592208 - DNA, 338 bp, Homo sapiens
ccccctccccggttacaaaagcctttcaatggaggaagattagccttttcaacaaagggggctgctggagcattttcataaacataagcaaaaaaaaaatgaccctcattttaaacttcacacctttggccaaaataaattaatcttagttttaaaggtaaaacaaaaccctgaaaccttttaaaaacaggggccccaaacccacaggccaggggccagtcccggcccatagcctgttaggacctgggcgcggggcaggacatgaccggccgcccggtgagcattaccacctgatttccgcctcctgtcagatcatggcagcattagattctcacagg

SEQ ID NO: 592209 - DNA, 115 bp, Homo sapiens
  misc_feature (85)..(85): n is a, c, g, or t
ggccggaaccacactggctggctactccatcagtacactgctcttgaaatcatccatgtctgtgtgttcagtagttgcttctttncttactgctgaataatatggcattatgtgc

SEQ ID NO: 592210 - DNA, 353 bp, Homo sapiens
ggggtccccgttatcactagacactgtaagcatccagtaggcaggaagatggctttgcgcagtgtctggatcgagagcagatatgagatacccagctccggaccgaggtcatcttctacaggttcttccttcactgagacaatgaattcaggctgatcatactctgaggggctgagaggtgcttcctcgattttcactaccacattagcttggctctctgtctcacagggtatctctcagactaggggcttggtatatattctaagtcaaaacgaattagttcattaattcgcttccagcattggctgaatgacgtccctcactgtacaagagaaacgggagcgctggataag

SEQ ID NO: 592211 - DNA, 335 bp, Homo sapiens
  misc_feature (9)..(9): n is a, c, g, or t
  misc_feature (55)..(55): n is a, c, g, or t
  misc_feature (163)..(163): n is a, c, g, or t
  misc_feature (178)..(178): n is a, c, g, or t
  misc_feature (219)..(219): n is a, c, g, or t
  misc_feature (254)..(254): n is a, c, g, or t
  misc_feature (261)..(261): n is a, c, g, or t
  misc_feature (286)..(286): n is a, c, g, or t
ttggcctcnttccgtgtgaccagaaagttagatgagtagttttaagattgagtgncctaactccgggagtattcttacctccactgtcataggtgttcatgtactaatgtggaatatcaaggtggttttttttttgtttgtttgtttgttttttttaagtttncagaggaaatagaanccacatacctctaaactcaaattgccccaaagatcaattcncagggaaatgagtggagcatcacgaagacatcaancttcctncctagttaccactgacttgctagtncctgctctagctgaataatgaggttaccaactcacggcagcaattttat

SEQ ID NO: 592212 - DNA, 917 bp, Homo sapiens
  misc_feature (722)..(722): n is a, c, g, or t
  misc_feature (795)..(795): n is a, c, g, or t
ccgcgccagtgtcccgccgcctcccgcaagcggaaatagttcccggaacgcctgcggtcccgggccgcctcccagactccaggggagccgtccctccaactcccgggagctgccgagggaggggcggatccgggccagctcctctgccagagcccagcccagagagggtgaccgggggacgcagggccgggtttccagccccacgagagggatggtgtagggaccggggcgtcgcggcgagacgcctttcctcgggggggggtgcgggggggcgcccacctcctccgtgtcggccggagggtctgcaacagcgggtggaatttttagcacaagcgagggaggaggttggagcgacgagaggcgggagcggaaagggcgcggaggccggggctgcagcgcgctccaccgcccagctgcaggtggcgcctctcgccacccgcaccccgctgcgcccagggaagggccgatggcgcgccgtcctccctcctcccttcgggaagcctgcgacgtcccatcccctccgacgcaggcccgggaaaggctcaaaaggttcgaggtcgcgttcctgctatcccgcgggcttctctcactcttagatcccgcaccagaggaagcggatctccttgagtgggcaaagcaggggtgaggggctgggggcagttccactgacaacgggacgggggcgagaggggtttacccagtacatacagaaacagcacganaagaaatctatttttaatggcttaggctttatagcacgaaggcaggcaccctctcgttacaaggacacagtcntctctatctgcccacctcctggggtccttaaaatcgagtcctgagttccagaggggtcacgtgccagggcagcagtgaagggagaagggtcacagttcacttctgtgacgtatcggacaccc

SEQ ID NO: 592213 - DNA, 393 bp, Homo sapiens
  misc_feature (135)..(135): n is a, c, g, or t
  misc_feature (171)..(171): n is a, c, g, or t
  misc_feature (304)..(304): n is a, c, g, or t
  misc_feature (317)..(317): n is a, c, g, or t
  misc_feature (374)..(374): n is a, c, g, or t
gtgtagtgcattgaacccaatgaacaaaaagtagccacttttactatacaaggcccgctggtgcagaaaaaaacctatatatttttggaaatcccagcattttatactttcaccgtgttataaaaaaaaaagccnaagaacaaagaaaccctctatttcattaaatgattncttctggtggttgtcaagacacaaaagaccaaaagagcctttttgtctttcttttttattttttaagtattggaataagtctaaagaaaagaaagtgccttattttccttcatggttcattcagtcaagtgtnctcctgaaagatnagctcctcccttcagaatacaagttaatgcatgttactcagtcgcccagttatgtgnaaagaaggtatgtgggagt

SEQ ID NO: 592214 - DNA, 802 bp, Homo sapiens
accttgtcaagaattcaataagaattctcaggctgtctgtattttcttttaggaccttggagatctctcaagttgtactgttttctaagtattcctgagtatattcctttggtaacgtgaaacgtaaatagtttatattgatgattttttgtttttttggaaacggatcttgcctgtcacccagggttggagtacagtggtgaaatcccggctcattgaagttctgcctccggggttcaccgccattctcctgcctaaccctcctgagtgctgggactacaggagcccgccaccaaaccgcgggaactttttggtattctacgtagagatggggtacccgggtgttaagtccagggtggttccatctcctgaaaccttgtgatccacccaccttgggccttcccacaaggtgctgggattcacagggcgtgagcacacagtgtcccgggcctgtattgggcgagatatttgtaccgaatgtttctacttggaccatcgagtgcttcaggaatggatgtcaaccgatctgtacatccgttgtgtacgaccttcttctgcatatgctatcttggctctggacgtaatccctagtcgtgttgtcttacatacccgttttcagttgggtctttcaccgcgttgctggttctgggctcccgtttagcacctgtggtttgctcatcattatttcgagacggctgtgttcgcctgtccgtcgtttcctgtgtttgccatgcgtactcccgtttgttgtcgccctgacacccttgagtttccgtttcgttcttcccaccccttacgttct

SEQ ID NO: 592215 - DNA, 885 bp, Homo sapiens
gatgcgctccccggcgccagcagcagagggcaccgtcccagaaatgcatgcgacgatccccttctcccggacccaggagccgggcccccgccctgtagggttacgatcactgattaaaaagagggactttttcaaatacttgtgcactttggatggtgtatatggataccaaggaagagaagaaggaacggaaacaaagttatttggtcgatgaaaaagaaaaaacaagccaaacaaaatgcagagacagcctcagcgtgtaggtacaaggactcatacctggaaggaagataataatacagtagttttagagccagacaagtgcaacattgtgtggaagaggaatatatgacttgatgagaaaccaaacgagaaaacgtaatcagttaaggagatcaggcgtacagaactaaaagagatattatagtattgatggacactcaaaaaaaaaaaaaaaaaaaaaaaacaaaaaaaaaactttttgggggggctgggctgaaaagatttttaaaccaacttttgggggggcggggcccagtgttataggtacaccgtggcccaccggggctccaagggaaacccgggcaatgcgactcgtcgctgggcttctccccccaattaaaaaaagcgcgggcggacccgggcgccgtttggaccaactcagagggcttcgggggtccatcgggctctacacagagggcccagcgaccgatactagccccgcgcggcgtgatggaaaaaacaggaaaagaacaacctgagacgagaagaggagagcagcagggagagacgagcgagagaacaagaacgcgaggagagagacgcgagaacggaggacgataagagagagaacgcagaaccaaagagagagagagcgacgcacac

SEQ ID NO: 592216 - DNA, 963 bp, Homo sapiens
  misc_feature (697)..(697): n is a, c, g, or t
gagagctgccgtggactcgttaatagtctgaggcctatagagcatggatgctgatgtggatgcctaccatggtccggtggtctcagctgtccctgctaggtctctgtgtcctggcctgtccatgacacctgaccatgtgccatggttgctggacatcactgtcctggagtgttgagccgtgtgggtggggcctggcacggggcttcttgtttgagagggcttcatcctatgtcttctcgaggtgcttgctccgcgttcctgtgcgcgagcggggccccggggtgccggttcgcgtgaggcgaggtttgtcacttgtgacagaagaggagatacgctggcgtctccccgtaggaggcgcacctgggaggagggctaggagccgacgggggggagcccagacatgggaggacgcgcactgagcagcaccagaggtgattgcggtagcgacgaacgagagggggccctgctctgggcaaggtactacaggctgcggtcgtggcgggacgggggaccttagtagttggccaacgagaactcatcgcgtgagtacgcgggggggttgcttttcccctgggatgcgtgctgtgagcggaacaatcccaattctcatcaccatgggctcgcggcattgtgtgttcagttcccttctccttgtaaggtagtcgcccttgccttggttgtgatcattgggacccancgagaaccgttgcacgttggggtgtgcctttggtggacctccggtggatctgttggcatgttgctaagttggcctggggcctggggcctttctgtgggttggcttacccttgtccttaggtttcgccgagagcctggggggcccccggcgttaacgcaaggagcggacggttgctttccgttggcgatgggttcccccgcctgggggcgctagagtttccttggacttgggggggaacttggaccctttttccacacgcccctggg

SEQ ID NO: 592217 - DNA, 282 bp, Homo sapiens
ggtgtggagcaggctggggctggcccctcattagtttcccacctgattacttaggtggttggcatctttatcaaatttggacttgcactgatttgcccaacgtttcccctttctacgtcgggggcatatagaagggggttcttttgctgagttaccttggtctctactagtggggcactgcctcttcttatgacctggctctccacacagaaaccaatttggggttttctcccttttcacttcaggagactttattgccatggccaatattttggctttgtg

SEQ ID NO: 592218 - DNA, 873 bp, Homo sapiens
  misc_feature (3)..(3): n is a, c, g, or t
  misc_feature (5)..(5): n is a, c, g, or t
  misc_feature (41)..(41): n is a, c, g, or t
  misc_feature (58)..(58): n is a, c, g, or t
  misc_feature (82)..(82): n is a, c, g, or t
  misc_feature (104)..(104): n is a, c, g, or t
  misc_feature (108)..(108): n is a, c, g, or t
  misc_feature (115)..(115): n is a, c, g, or t
  misc_feature (132)..(132): n is a, c, g, or t
  misc_feature (139)..(139): n is a, c, g, or t
  misc_feature (152)..(153): n is a, c, g, or t
  misc_feature (155)..(155): n is a, c, g, or t
  misc_feature (167)..(167): n is a, c, g, or t
  misc_feature (182)..(182): n is a, c, g, or t
  misc_feature (194)..(194): n is a, c, g, or t
  misc_feature (198)..(198): n is a, c, g, or t
  misc_feature (202)..(202): n is a, c, g, or t
  misc_feature (204)..(204): n is a, c, g, or t
  misc_feature (207)..(208): n is a, c, g, or t
  misc_feature (234)..(234): n is a, c, g, or t
  misc_feature (249)..(250): n is a, c, g, or t
  misc_feature (252)..(252): n is a, c, g, or t
  misc_feature (288)..(288): n is a, c, g, or t
  misc_feature (335)..(335): n is a, c, g, or t
  misc_feature (359)..(359): n is a, c, g, or t
  misc_feature (377)..(377): n is a, c, g, or t
  misc_feature (379)..(379): n is a, c, g, or t
  misc_feature (456)..(456): n is a, c, g, or t
  misc_feature (480)..(480): n is a, c, g, or t
  misc_feature (484)..(485): n is a, c, g, or t
  misc_feature (504)..(504): n is a, c, g, or t
  misc_feature (517)..(517): n is a, c, g, or t
  misc_feature (523)..(523): n is a, c, g, or t
  misc_feature (572)..(572): n is a, c, g, or t
  misc_feature (654)..(654): n is a, c, g, or t
  misc_feature (668)..(668): n is a, c, g, or t
  misc_feature (670)..(670): n is a, c, g, or t
  misc_feature (699)..(699): n is a, c, g, or t
  misc_feature (714)..(714): n is a, c, g, or t
  misc_feature (741)..(741): n is a, c, g, or t
  misc_feature (777)..(777): n is a, c, g, or t
  misc_feature (787)..(787): n is a, c, g, or t
  misc_feature (802)..(802): n is a, c, g, or t
  misc_feature (810)..(810): n is a, c, g, or t
  misc_feature (824)..(824): n is a, c, g, or t
tcngnggggtgtacattttattggaaaccttaaatactgtncagaatcaatcaaggcncttgtgcagcctacacagaaaaangaagctttttgggttaggggcnaggngagaganagtccagaggacaaagnccccccncgatgaatgcccnncngccagcttatcngcttttgccacagcntcttcaatgggncccnccananagnnggcctgtcctgggagagggtcatatncccccccccccatcnncnggaatcctttgatggtctccttcaggggtaccagcntccccatatgacctgtgaagacctcagcaacctggaatggctgaganaagaaacgctgttttttccgtgcncgggacagggtcaacttntnttcctcagaaagttcatccatacccaggatggcaatgatatcctggagggatttgtagtcctgcaggatcttttgcnccccacgggcaacatcgtaatgcncccnnccaacaatgttgggatccntgacacgagaggnggagtntagaggatccacagctggatagatgcccagctcagcaatggcacgcganagttcagtggtagcatccaaatgggcaaacgtatagcaggggcagggtcagttaagttatcagcaggcacatagatagcctnttcagaggtgatanancccttcttggtagtggtaattctttcctncatagtacccatgtnagtggccagggtaggctgatagcccanagcagaagggatttggcccaataatgcagaaacctntgaaccagcntgggtgaagcgaaanatgttatnaataaatagcagtncatcttgaccttcttggtctctgaagttttcagccacagttagcccagt

SEQ ID NO: 592219 - DNA, 233 bp, Homo sapiens
aatgtacatttgaatcatttataacagtaggccagtgaagagccagcagatggtgctacccacattgacatgctatgatcagagaccaagtggattatgtaaggaaaagtactgctcaactacagagggtagccttaaaacaaaagcaacgcttatttaaaataggaaagactgcagcttttacaaattggtcttttcagtcctatccaggtcagtaagaagtaatatcattg

SEQ ID NO: 592220 - DNA, 128 bp, Homo sapiens
tgatgctgaggtagacgtctagagatccccgtggtcggctctggtctttatatgctctctcatattccaggaattgacgttatttatttatccatctacctctcatagcagatatttgagaaaactaa

SEQ ID NO: 592221 - DNA, 148 bp, Homo sapiens
gactgtgatttatttggagtggaggccttgttttttagaaaaacatgtcatgtttgttgtctataaaattaaatgcgtttaaactctaaaaaaaactttcttctctcctttttcttctttccttccttttctcttctttctcctagaa

SEQ ID NO: 592222 - DNA, 218 bp, Homo sapiens
  misc_feature (211)..(211): n is a, c, g, or t
cagcttatagaggcacaaggaggggcatgatattgttgcactgaacctccacctcctgggttcaagtgattctcgtgcctcagcctcccgagtagctgggactatgggcgtgcaccaccacacctggctaatttttgtatttacgtagacgatggagtttcatctatgttgcccatggctgctctctgaactccctgagctcaagcaatcntacccac

SEQ ID NO: 592223 - DNA, 791 bp, Homo sapiens
  misc_feature (451)..(451): n is a, c, g, or t
  misc_feature (480)..(480): n is a, c, g, or t
  misc_feature (502)..(502): n is a, c, g, or t
  misc_feature (522)..(522): n is a, c, g, or t
  misc_feature (533)..(534): n is a, c, g, or t
  misc_feature (537)..(537): n is a, c, g, or t
  misc_feature (551)..(551): n is a, c, g, or t
  misc_feature (554)..(554): n is a, c, g, or t
  misc_feature (567)..(569): n is a, c, g, or t
gctgtggtagtctcggagctcttgcttttcgtgcctggcgcgtctgcggcttattccagtcttccttgcctcacgtggatgcgtgatcaggtgactgtcggataccgtggggtttccctttcactctcattctagtggacatgtcctctctgccttggtgtaaaccattcttgggaggacactttttgccaatgcagactctttcccctagctgagttagtgtctaatggatatgatcctatatggttgcccttttcctttgactagtacactgcctggtatggatagtcagagaagtcctgtctgtacttcatgcgaacaagccaatatagagagctatacagtcctagtagtattcctctatttgttcagatctcatagatgacccccaggtatggtctttcgacatccagcagtccaaggtattgagacatattactggaagtaaganatattactataattgagaactacagcttntaagattgtacttttatcttanaagggtggtattttccctanatacttattanngtnagggtcattagacnatntcttgaatagacnnngaatttatgaatggttctttatcagtttcctcttcccccttctttggcatccgtggcgggcctccagttcttaggtccatgctagtttgcttctgtaagcatacgggaacacctgtctgagggggctctcttccactcatgtatacttcaagtaagatcaagaatctctcttgtgaaattatagaaatttactatgtaaatgcttcgatggaatttcgttcc

SEQ ID NO: 592224 - DNA, 188 bp, Homo sapiens
ctgtgcctctgctatgatgcccaccccatcatcgcccacagtctcctgtgctggccagactcccagaaaatgctctattttcttacgtaacgacttccccctattgggggacccctcaatctggaggccccattctaggactctggcgatcccaaaccctagagcacacacgtccgcttgtactcttt

SEQ ID NO: 592225 - DNA, 81 bp, Homo sapiens
  misc_feature (51)..(52): n is a, c, g, or t
catggatttgctggtgcagtacaactaggcttaataagggacatgaggtgnngcaagaaatgggctacattttctacccca

SEQ ID NO: 592226 - DNA, 427 bp, Homo sapiens
  misc_feature (147)..(147): n is a, c, g, or t
  misc_feature (284)..(284): n is a, c, g, or t
  misc_feature (330)..(330): n is a, c, g, or t
  misc_feature (355)..(355): n is a, c, g, or t
  misc_feature (365)..(365): n is a, c, g, or t
  misc_feature (373)..(373): n is a, c, g, or t
  misc_feature (381)..(381): n is a, c, g, or t
  misc_feature (398)..(398): n is a, c, g, or t
  misc_feature (423)..(423): n is a, c, g, or t
taaatcgtctggatgcgggttctgtcgttctgtattgtggtcagccggtcgccgtcccagccgtaccaggtcacttgcggtttccgtgacagcgacatccagcccgtcaggtcccgttcacgccgccacacccgttttgccaccctncggcccagcgggtcgtaaagatagcgactttcgaccagcggctcttcatattgtgtccgcgtgtagtgcaccagccggtgctgactgtcgtaatggtaccggtgagtccgctcatcatccgtgcggataaccccttncgggatgaggtcggttttctctgtcagcctgccgtgacggtcatancggtaaagatagtgcgcgtcaaggngcgatacggntatccggncacattgntgagggttgctgtcccnggtgcaagttccgggtcgtgcagtnggtt

SEQ ID NO: 592227 - DNA, 307 bp, Homo sapiens
  misc_feature (10)..(10): n is a, c, g, or t
  misc_feature (225)..(225): n is a, c, g, or t
  misc_feature (239)..(239): n is a, c, g, or t
  misc_feature (262)..(262): n is a, c, g, or t
tagtggctcncagagggtggtttcaactgggaagtgtactcccccttgtgattcggtaatgcaaaccaaggttcctttcggcccggttccagtgatgagccaattctctcaccaacgcactgggcatttggttgggcttcaggtaacaagggcctttaaaacatcggtcgtaagaactgatatcgagcgcccaactacactaacttacggcttattagccagatngtgtctccatcacngcttgccggagatttgatggagnctgaaatgttgacctgacagaattccagaccacctggtgccctac

SEQ ID NO: 592228 - DNA, 487 bp, Homo sapiens
tactgaggaacagatgctatagatggcatacggtttaccgtggcgtatctctttctccgggtccccctttccctcctggctctcctgtctgaccaaggtccctcttgagcctctggtcctgctggtccccgaggcccccctggctctgctgttgctcctggcaaagatggactcaacaggtctcccatagccccaattgggccccctggtcctcagcggtcgcacattggtgattgctggtcctgttggtccccccggacctcctggacctcctgaaccccctggtccatcccagcgctggtttcgaattcagcttcctgccccagacacctcaagagaagtgctcacgatggtggccgctactacctgtggctgatgatgccaatgtggttcgtgaccgtgacctcgagtgtggacaccaccctcaagagcctgagccagcagatcgagaacatccggagcccagagggcagccgcaagacacctg

SEQ ID NO: 592229 - DNA, 319 bp, Homo sapiens
atacggccacacattatatgttcccaccagggagtgtgtaagtgtctcaagtttactccacgttccttggagaacacgttgttattgtctgtctttctagatagccatcttagcatgtgtgaagtgatattccacggaactattggtccaggtgaccaatgatggtaactatgttaccagtgaccggagatggtgagtatcttatcatcaacttattgagcatttgtatatctcttctggagaaccaatatctcccctcaagcctcacaaatcgcagcttgactataaatcccttgtactgcttgtatgtggaatcaag

SEQ ID NO: 592230 - DNA, 866 bp, Homo sapiens
  misc_feature (63)..(63): n is a, c, g, or t
ggagaggacgggcagaaggaacgtgacttccacgaggcagccgctgggtggggggccccacgntcagggttgtgtctcggtgaaaaaaaggcacgcccgaacgctgggcagggattacccgtgcggacccgggaatggaagggggctcgaagacgccttagccccccggtgaagaaaaggcttccctccctcccagtccaaatacggtccctgtgatctgagaacattacgggggcatagagtcgtcttttctttaatggcgtgtagtcgcggacagccagagggttactggaatggccttaaacgtatgcgttgaaagagcgtaccctttgtgtaccggagcaagtcacctgtggagggaccacgcaggtatggcaagcccggttccagcatgttagggcgagggtgtgctccatggggaccttgccttctgatccgtttaaccaggcatatatttcacaaacgctgtgtctttcctttccaagtattcacatcttgtctatgaccacaaatcagatttaattcaactcaccatttatggaacaagctagccgtgttgtttaacatttattcctgaaacagccgagtgatagaagggattactaatccagtttcacaaacgataaaattggaggtgcactgatgtaatgagtcttcaccaactattcgtacttgaaagcgttactacggtgggaagaataagtagcaagaatttgctttgaggggggaattaaggcacaggtaatatcaggatgaaccagagtttgggtgaaagaaaggggagatcagcagtaggaaaagtggccggaaaaagacacaggtggggggagattagaggggaaaaaaaagggggggaaatggggaaa

SEQ ID NO: 592231 - DNA, 396 bp, Homo sapiens
gtctacctagaggatcctcgcttagtggagatatggacactgcaggttctggggagacccacagacagatgttcgctggatgtcagagactggcatcattgacgtcttcctgctgctggggcctccatctctgatgttttcccagcaatatgctagtctcacaggaacccaggcgttgcgcccactcttctccctcggctaccaccagagccgtttgaactaccgggacgaggctgatgtgctggaagtggatcaggggctttgatgatcacaaccttgcctgtgatgtcatctggctagacattgaacatgcttgatggcaagcggtatttcacctgggaccccagtcgctttcctcagccccggaccatgcttaaggggatcaggggggaccgg

SEQ ID NO: 592232 - DNA, 151 bp, Homo sapiens
agcctccgtggcctccagcagttccccgccttgacctaccaaatgtgctgggattacaggcttgagccatcatggccagcctagatatttttttggtcagagaaaaagtgagaaggaggaaataaccataaagaatgcactacgttgacta

SEQ ID NO: 592233 - DNA, 560 bp, Homo sapiens
  misc_feature (13)..(13): n is a, c, g, or t
  misc_feature (40)..(40): n is a, c, g, or t
  misc_feature (58)..(58): n is a, c, g, or t
  misc_feature (81)..(81): n is a, c, g, or t
  misc_feature (91)..(91): n is a, c, g, or t
  misc_feature (124)..(124): n is a, c, g, or t
  misc_feature (139)..(139): n is a, c, g, or t
  misc_feature (204)..(204): n is a, c, g, or t
  misc_feature (254)..(254): n is a, c, g, or t
  misc_feature (257)..(257): n is a, c, g, or t
  misc_feature (267)..(267): n is a, c, g, or t
  misc_feature (270)..(270): n is a, c, g, or t
  misc_feature (348)..(348): n is a, c, g, or t
  misc_feature (449)..(449): n is a, c, g, or t
  misc_feature (526)..(526): n is a, c, g, or t
ataaaaccttccnaaggccccttggagtttcaatttcttngggttcttcctggctaangaggggtcacggtggaggagacnaccattgtcntggatggtcccaagctggagggaatccgtcttnttggtctcccagccntatcacaggaatcattcctgggtttctgtccctctgaggctcaccaggtgtagttggccttgttntttgggggtattagcccttttactttctttctcacccaccctgtaccctnttntgtgtgtttntgntatccccctttcctcccaccacccatgtgcatgagcaaatgtgcaacaaaaccctgggactttgcagtcaaatgaagntgagcttcccacatcccgtttttcggtttgccatgagacgatgtggggtttccactgtgtgtctgtcatcacctctttgtctttttttcctaaccctgatntcatacttgtatagagtaataacaacagttgtacttccaccaaaggcatgtggcatatttaccaatgtcatgtattntgaacaaaggcaaaaaatacaaattcctaccatt

SEQ ID NO: 592234 - DNA, 246 bp, Homo sapiens
cccctgtccaccctggtctcttgccagggcaggcatagaggtgcttcagatgtctcttgcccgccactctaggcctcgacgcttatacagtgagcagcggtctctaccttccaacaggaagtgcaaactaattcgaagtcacacttcaccaggagggagagatggtcttggctgactgcactttaatcagggcgcaaacccagggccggagtttgtcttctcgttactctgataaatctagacacc

SEQ ID NO: 592235 - DNA, 127 bp, Homo sapiens
ttaccagagtagctgtgagtacttgtgtaatgtgaaaaagggcttgtatatcagaaactcctgtggtttcctgttaaaaaatcttaaagccccaactttggcatatatgtgccccaaaaggcggatg

SEQ ID NO: 592236 - DNA, 875 bp, Homo sapiens
  misc_feature (370)..(370): n is a, c, g, or t
tagtaaagttcccatctttccacaggacactcgtcctccaaacaattccgccagcgtttgccacagaccacatgttaggcccactactggtctcgcaaatatccccccgggttccaactccaacccagatgtttcaatcttcatcggagtaaataaacagcaagacactcttacaacgccgtattttcaaagcctctgccacaaattactaagagtcgcttcatccccatcggaagtttgttaaccccgccccgtcgtcgccccaaaaagccgccgcttttatacccccctggcacaaaacgcttttcctctcacccccattaaaaaggttccgaatattatcaaccaagtaataattgtttcgttaacnatcccccggcaaacccccacgtataatatttgacatgctccacaccccaaaagttctcttatccaaagccacccggaccacttttccagcatacttttccagatctcaggtctctcgtcattttacaatatagtacagccctatacggttctttaatccaaatggaatgttccccgcctagtgtggcctaacaaagctgtaatccccccccattgtgaggacgccctgtgtggaggagatgtcttgtcgtgcccccgggggttccatgcccccccgttggccaacacacaaactgggaggtaccttgttttttgcaacgacacacctatactattatcgtgtgagcccctgcgcaggaccaccctcttttatcaacccctacatgggccgactcagttgggaggctaactcctgcgacgtcggtcagcggcggcgcgtcagtgagcccccgtgttgcggcccccccccctttccccgggggccaaagcaattcgcccccatgaca

SEQ ID NO: 592237 - DNA, 231 bp, Homo sapiens
ttgctgctgcaggtcgtctagagatcccccacgtcctgaatcctccatgactagcacggtgtatcatgcgccggtattcttaatagaccacctgcaccaacagcaactgtacctgcccctacagtctccagttactaaccctcttttcccccgtgctggacaggctcaggcagctgtcctcggacctgttggtacatatttcaaacccttaaatagtacccatcggcgtgg

SEQ ID NO: 592238 - DNA, 297 bp, Homo sapiens
  misc_feature (167)..(167): n is a, c, g, or t
  misc_feature (196)..(196): n is a, c, g, or t
  misc_feature (225)..(225): n is a, c, g, or t
  misc_feature (236)..(236): n is a, c, g, or t
  misc_feature (275)..(275): n is a, c, g, or t
ttaggagacccttcttagttacgatacgatgctaacgtttctaggtaagtatggataagatgttttgatctgggaacttttcgggttgcttaggtttttttgggggttagaagactttgtttctgtttgcccttccgtttttatgtgtcgggtttccgttatcgttnggggctatgtcttagggctttataggctngcttactatgtttacgctttagactcttngggtgggtatngtttttatatagttgtctaatttccgattttgggcgttngctatcgccttttgttcttggg

SEQ ID NO: 592239 - DNA, 285 bp, Homo sapiens
acgcaaatatgatcacaggatcaggaccacagcaattatgtggctaaaaaatactccaggaagcagaatgtaattttaatgtaactaattttgtttttattttggagacaagttatttccaaggaaccagacaatgtggcaagttacaggcatgtgttacatcattggagattaatatacttgctaatctcagttgtggaaattctcaaaaagtcgtcggggttatggtcttgaatatgtgtctgcatgtgttgcggtcttggatgtctatatagatgtctatat

SEQ ID NO: 592240 - DNA, 809 bp, Homo sapiens
  misc_feature (332)..(332): n is a, c, g, or t
  misc_feature (807)..(807): n is a, c, g, or t
gttaatgatgttgagcatctcgtcatgtgtttaaaagacaaagccatttatgtaccttctttgttgagatgtctaataaaatttttgccttctttttttacttgggttgtcttattttttaaaatatatttattattaattgtaaaatatacgtaacaaaaaacttttattttctttttctttcttttttttggagacagagtttcactcttgttgcccaggctggagtgcaatggcacgatctcggctcactgcagcctccgcctcccaggttcaagcgattctcctgcctcagtctccccagtagctgggtttataggcagatgccacanagcccagctaattttcgtatttttagtagagacggggtttcactatgtcggtcaggctggtttcgaactcctgaccttgggtggatcttggccacctgggcctcccaaagttgctgggattaccaggggtgattttttacatttctattttgcctgtgaaatcaggtctccttttgttcccagggctggtctcacatttggcgggtcgggataatcctgggtcggacctctatgtgtccgggtcccgggtttagccctgttgccagcccattttgtgcctcaggacgtcgttgagggacccctttcgctttgtgcacatcacacttttctctttgtcccagagaggctgggtggcgcaaaaatggtccacggcgagaaatccccggggtaacaaagtgtctgctgagacaacagggagggaggctctataatgagaaaacctcttgtttttgttttgctatttttttatttatantc

SEQ ID NO: 592241 - DNA, 367 bp, Homo sapiens
cagagcaaaacataaccaatacacagggagcagagactctatagctaaagacaagattcgcaatgaaagaatcagtgccacattgcatcagtaaagtgtcccatctccctgtaagtggttatgtgtccagcggttgtaactctcgacgataatggtgtaggtgtatcaccccactcttcatgtcgacatcctgcaggattccagctgtccaatcagtccgtcataggctgggcgcgtttaaaaaagactccttgttcaccaaatgcaccatttcctgagacttgctggcctctccgttgagtccacttggctttctgtcctccacagctccattgcaacacggtctctcagggtaccgagcacgaat

SEQ ID NO: 592242 - DNA, 271 bp, Homo sapiens
  misc_feature (97)..(98): n is a, c, g, or t
actccatcctcacttattctaaaactgtgcctccaacagaggggcagggctcttgtagagagcactccctggcccagcgacagcgcagcatgccaannatcgtaatttatctcactgagggcctttgagaaaaacgcttctgggccaggctcagtggctcatgcctatataatcccagtactttgagaagctgaggcggcagatcacttgaggccaggagttcgagaccagtctcgtcaacatggcgaaaccctgtctctacaaaaaaaaa

SEQ ID NO: 592243 - DNA, 286 bp, Homo sapiens
  misc_feature (31)..(31): n is a, c, g, or t
  misc_feature (33)..(33): n is a, c, g, or t
  misc_feature (65)..(65): n is a, c, g, or t
  misc_feature (96)..(96): n is a, c, g, or t
tacccgttaatgtctgacatcagttagttangncataaagcaagcatgtgaaagtgtgctttggnggcattacgaggaagcccttctctgcttggnaagatcagggagactgaaagatgcttagaagtcatccaccaggcgggctgtgtttgagttcctgagctctcctaccccatccatctgaaggcctgcgggatgccggacaggatgtcacttaggagggagacggaggctgggcgcggtggctcccgcctgtaatccgagcactttgggagcccgaggcggg

SEQ ID NO: 592244 - DNA, 144 bp, Homo sapiens
gtccctttggttttttttcccaaaagggttaaacagggacccagtggggaagctttccagcttccaccccttgaatgtgaagggtcattggcatgtttggcagaagtttttcattccccccccaataaacccccttggatccca

SEQ ID NO: 592245 - DNA, 120 bp, Homo sapiens
catggagaggcacagatgttgtaccaggtacacggcccacgttggccaggccccagttcatggaagaggaaaaatgtgcttggtggtagctgtcagctcgcccgcatgagttagtcagct

SEQ ID NO: 592246 - DNA, 408 bp, Homo sapiens
gatgaataaggaccagaaatcgtgagatgtggattttgaacccaactctaccttttattttgttaagaccaatcacagattgtgcctcagatcatccacctgtgtgagtccatcactgtgaaattgactgtgtccatgtgatgatgccctttgtcccattatttggagcagaaaattcgtcatttggaagtaatacaactcattgctggaattgtgaaattatttaaggcgggatctctggtcctttattttaatgtaggaaaccctatggggtttatgaaaaaaacttggggaacattctttgaatgggctaaggaagagggaggccctgccatgccatgatggtggggttattttattggtaaagcaataaacctggggggactctaggaggtgttctatttatgc

SEQ ID NO: 592247 - DNA, 299 bp, Homo sapiens
  misc_feature (83)..(83): n is a, c, g, or t
  misc_feature (154)..(154): n is a, c, g, or t
ggcgggtggatcacttgaggtcaggagttggagaccagtctggccaacatggcaaaatcccatctctactaaaaatacaaaanttagccaggcatggtgacaggcacctgtaatcccagctacttgggaggctgaggcaggagaatcgcttgantctgggaggtggaggttggagtgagccaagattgtgccactgcatttcaacctgagctacagagagagactctgtctcaaaaattaataataataactaaaaactcacattcttactaactttgatgtgtagaaacagcacaacc

SEQ ID NO: 592248 - DNA, 275 bp, Homo sapiens
catacgggccagactggagctgtagtggtgtgattcttggctcatgtaatctctgccgcctcaagacaatcctcctgcctcagcctaccaggtagttgggactgcaggtgcacaccacaatccctagctaattgttgtatattttgtagacatggagttttgccatgttgtccaggctggtcttgaactattagactcaagcaatcctcccaccttggcctctcaaagtgcttggattacagggagaacgtgtgcagtgggcacacattatggag

SEQ ID NO: 592249 - DNA, 195 bp, Homo sapiens
ctaattctaacaagctccatctgctacgacacacagacctaagaatcgctcattgcatactcttcaatcagccacatagccctcgtagtaccagccattctcatccaaacccccataagcttcaccggcgcagtcgtcctcatagtcatcctcggaggtacgtccacgttatgattctggctagcagactcagac

SEQ ID NO: 592250 - DNA, 1014 bp, Homo sapiens
cgggtcggccgggcttcggggtgcccagggcgccgctgctgccaccgccatctaacgctgcgcccttgaggcccggcgcgcggattgtgccggtgcggctcgggtgttgaaacgggtgtcccctccccctcctcctcacccacagatggatgaatctacccataacaaaactagatcaggaaagagcacaatgctactacaaagaaagaaatcaatacacaaaacaagaatcagaaaacatgacaagatgtgatacaatactgaaatgaatgaaacaaaaaagctatagaaaaaaaacgatacactaaaagaaataaaaaaattactcacaaaagaactaataagtcgatagactaaccacaatccaaacaacttgcagcaaatagtattagagatacgacgaaacgtaccagaggacatggacaagaagaaatgagacgagatagaaataacaataaatactacaataggtctcacgagcaacgaacaattaagaaacgcagaaacagttaaagcaacaattaacgcaaattaagacaagaaaaagacgaatgacaagaggaaacaagagagatagttagaatataggagtagagagggtagaaaaagaaagcgagaagagaagataatagataaggagaggagaaagagaaaagagtaggagacgatatgaataggagaataaggataagatacaaagggaaacgcaaaattaataagaaacgagaaagaaaagaagggaataaatagaatagaaagacatgtaagttgagataatatgaatataagagagaatagaacgaaaataagagatgaaaataaagcaaaaagaaaataaagtgagaatataaaaattaaataatatactgataatatagagattaaataataaaagaggatagaaaaataagagagaagatagagaaagagacgaagagaagagagaaaaagaaagagaaagtataagcaataagatagatcagaacgaaaaagtaaatagaaaaatagagagag

SEQ ID NO: 592251 - DNA, 344 bp, Homo sapiens
cggcactgttcggatgcggctggtatgcccgtaggattcattcgtgccaggagacggggagcactgtgctgttagaaaaattgcagcacgtgtctgcagcccatcccggtgtgatcagccgtcggaattggggatgcaagtcgtgttcgggtctctggtcagtgccttccacgaggccacacctttgagccttgcagagtttatcattgatacccgcgatgcaggctatggtgggctcacgctgtcccattgaggggcccagcaaggtggacatcaacacagagtgccttgaggacgggacgtgcaggggtcacctactgccccacagagccagggaactacat

SEQ ID NO: 592252 - DNA, 138 bp, Homo sapiens
caacgctgataacatagtaataccagatccatattagataacgataggtatagaataatactaaacctaggtaacactataacagacatacacaaatacccttaataataatagtacaacaaacataacttataccct

SEQ ID NO: 592253 - DNA, 301 bp, Homo sapiens
ttcacagatctcaagcttaccgcatctgggcattatagtgagatccatttcttaaaaaaaaaaaaataattatccaggctagggggtgcactcatgtagtcccagctgcttgggagttaaagtggggaggatcgcttgagcttgatagatcgaggctgcggtgagctgtgatggtgccacttcactccagttggggtgacagagactctgtctcaaaaaataaacaagaaaaggagagaagagtgggactcaacttaaactttgggggtccctacgtttcagcggggtacggagctcgaat

SEQ ID NO: 592254 - DNA, 361 bp, Homo sapiens
  misc_feature (43)..(43): n is a, c, g, or t
agatcacactagtaagtagtagagataggagtccagccagacntactgatcctttacattatatcaacagtgtatccatggtaatacatggtaaggtatattggaaggtaccatggtaacggtgtattgaattcctaattttttttatcaggtccttataaatttgggaaatgagggtataatacccattattctcccttagtcttatcaagtcaattgattgattaagaccaccacacatccagtttaatgacaaatttgggggtgactggatggggagtggaactttaattaatggaaaataattgtaattgacacccaactccaggaagcaatgaaataatgtgcttatttgacattt

SEQ ID NO: 592255 - DNA, 232 bp, Homo sapiens
actgaccaaccaagacatgagaatttgcaacagtgtgagaaaaaaagaaccaaaacttccaatgccctgctattttttcttaaaagtactttaaaaaggaaatttgttttgtattttttatttacattttatattttttgtacatattgttagggtcagccatttttaatgatctcgtgatgaccaaaccagccttcaggagcgttctctgtcctacttcttgactttactt

SEQ ID NO: 592256 - DNA, 382 bp, Homo sapiens
cttttataaatctctctgtcctggcagatatcctattcatggtacagttaaataagatggtaatgtatttttttccagattgtgttccagtgtacatatatgactccatcagttacaaatcactaaatctattatatcctacatatattgtaataaaatatgtattgccatttgcagaagcatactcaaaatcatattcagaatccaagaaggaacagaaagccataggaaattgctatttaaaaggaagtgtgctttctttccagacatatttcatgtcattagggagactatcctgcacatacaggcacagtaatctttttcttccttgccaactgttagtgcacatgtgctgcgtcagaaatggcacctggatgacaga

SEQ ID NO: 592257 - DNA, 104 bp, Homo sapiens
atcactgagtgtgataacgtcaagtactcacctgtccacgggcacactctccaacctgacatgcaaaacagcaagaacaagaccctggcacactgggaccaggc

SEQ ID NO: 592258 - DNA, 916 bp, Homo sapiens
  misc_feature (279)..(279): n is a, c, g, or t
  misc_feature (916)..(916): n is a, c, g, or t
gctccgagtgtgcttagcgatggcctggaaatccggcggcgcagccactcggagctaatccacaatctccgcaaaaatggaatcatcaagacagataaagtattgaagtgatgctgctacagaccgtcccattatgcaaaatgtaaacccatacatggattctccaaatcaataggtttccaagcaaaaatcagtgctccacacatgcatgcatatgcgcaagaattctatttgatcagttgcatgaaggagctaaagctctgtgatgtaggatcctgnaaagtgaatccttactgcatgttttgcaccgtattggttggatgtacttgaaaagtcataggaatggatcacattaaagagctagtagatgatcaataaataatgtcaggaagggacgatccaacactttctgtccttcagggagagtacagcttgttggtgggggatgaaagaaatgggatatgctgaagaaagcccctttatgatgccattcatgttgggaagctgcagcccctgttgtacccccaggcgctaataagatcagttaaagcccggaggaaagattgatcatgctgttggcctgcaggcggaaaccaaatgttggagcaggtatgacaagctacaagatgggagatcaaaatgaagctctgatggggtgaataacgtgcttaacagataagaaaagcagtgtcagggtgaatggaaagcacatctgctgccagttaaatcaggggtggccatcagctacagttttgaacaaacacacaagtgttggattggaccggattcacaaagaggtgcaggtgattacagacacgaagtgaaggagaaattagttataagatgagaaaaggagagaaaagaaggaggctcttattcatctaatggtcgtataaggttattttgtgtttggagn

SEQ ID NO: 592259 - DNA, 122 bp, Homo sapiens
tgctccgtgacatggaacgggagcgactttttgagatactacgagatctactgcggctgctcctgcgactcctactaacgtgaccgtcttctagatcaaagagcaaatctaagcccaagtct

SEQ ID NO: 592260 - DNA, 159 bp, Homo sapiens
cgttggaaatatgacatatgggcggctgcccgcgtaacgacgacgagcgcaggaggtagtgagcgaggaagccggcgatacttcgtatgcatacatatacgaagtatagtcgacggtacggacattgccggaatcggctccgagaagcttctaacatcg

SEQ ID NO: 592261 - DNA, 685 bp, Homo sapiens
gcgggagcttgcgtgctgctgggcctgagctgtctgtctcgtttcttgtccgcgcgccctgcatcccggccccgggctgcccgctggaggtcgcctgaggagccacagggctgactggttccttgtggccccggaagctcgctggctgggccctgcgtggagtgcgtgcatgctcccgctggaggctgctggcctgctggctggctggggacgctggggcggggtgcctgctggcgcttctggccaatcagtgccgcttctgtcacgtggcctgcgctgtgctggctgcgcgcatgcagatcgctgcagctctacggcctgcctctactccgagatgctcactgcctgctgttctcctcgtgcctgcctctggctgcctgtgcttgcaactggcctgtcctttgccatagcctctgccttgatgtgctggctgttatgcacggctgtctatctgttttgtggacgatggatgatggatccagtgatggacgtgacgtttgcagaagatctattagatgacgatgaacgcgcgtgtgggaagaagctgtcgaaagtagtgtgtcagggagctctgggagtcacaggaacagcccttcgcagaaccaaacaagcccaactcagaacgggcaattgaacgattcgaggagggcaagagagcaaacttggggaaatggtgatggataag

SEQ ID NO: 592262 - DNA, 228 bp, Homo sapiens
gctcgacccattacattccattccactccacccggttttattccattccattccattccattccattccattacatttgatcctattttattaaattgcattctattcgagtgatttccattcgagtcctttccattcgattccattcctttggattccactccattccgctccattcacatcaattccttgcgattccattacattcgatttcttgccgtcgacgcg

SEQ ID NO: 592263 - DNA, 488 bp, Homo sapiens
gcgggcgggcggtgggtgggggggtggtgggggggccagagccacaggatggcttcccctctgagtggacgaggaggaggaggaggaggagattggtggtgtcggaggaggaagaagaggaggaagaagagggcgacgaggaggaggaggaggaggtggaggcggcgacgaggacgatgagggaggacgacgacgagggagtactcgggcgcggtgccgggccacgacccggggccgccgaccgcctacagtcgccccgcctggcttgctcaccttcttccccgcccggtgcgcgtctgcctgtctgccgcttcgcctgccgccgctggcctggggtgtgctcccccgcgtcccgcctactcttccccctctcgccccactccgtctcgccccgctccggtcgtgtctcccctctgctgggccgctcccgacgcgtccacggcccgcctgtgtcgctccctgcccccccttcgccgccccccccctcc

SEQ ID NO: 592264 - DNA, 622 bp, Homo sapiens
ggtgtagaaaagcaggaaaggggttactggggctcagtccttctccagctggaagagccaagcccagctctggagagcccagcaaaagcccggtgtccagagaggcagtgagaagtgtaaggcagagaaaaacgttttctggtaacagcgaggccgataggcccgtgaggggggggctgaaaggaggtgggggagagcatgcttgatgggtggctccaacatctctctccagggggcttcaattggccccctgatgccaggaggaagagtccaaacccgggctaccaagagaaggggcttggtggcgcaggagccaggtccagagcccgctggggtccgggcttggaaacagccccctttgattgatccagaaaggacttggtaacaggtgtagatggggattaatggccttaagggtgatggccgcattcttggcccacaaaggtaagggccagaaaacaacagccaggtaagtgtgggtcatcttgtcctggtcactggtgtgcagaaatctggacccaggaaacgcagtcaggaaagaagcaactggtaaactcctcggaagcgttggagacctgcagtgtcgtgcacctctgcttactcatgtgaggaagccaccaat

SEQ ID NO: 592265 - DNA, 422 bp, Homo sapiens
ctatatgaacccggctgcggcgaagaatggcaggcactcaaggtgacggttgcagtgcagtgagatcgtgccactggactccagcctgggcaacagagcgaactccatctcaacaataaatacatattggggcctggcatggtggctcacacctgtaatcccaacactttggcggccaaggtgcgagcattgcttgagaccaggcatttgacgactcacgcctgggcagcatacgcgagacaccatctctactaaacaataccaaaaacttggctgggcgtgactggcactgtgcctactactcccacgctacttgggacggctgacggcccggacgaactctcttgaacccgggagggggcggttgcagtgagccacgatcacatcacctgcactccagcttacggcatagcgcaagactc

SEQ ID NO: 592266 - DNA, 166 bp, Homo sapiens
taccctttccatcgtttcatcgactttacgtttgtctttcctgccctgtgccctgttttcattttctctaaggatatccttaggtacctcaatgaccgctgaacagctccagacatttcgtgatatttccagacatataaacacctctcgtcaaattctcgtacag

SEQ ID NO: 592267 - DNA, 281 bp, Homo sapiens
cctccctggttcaagggattctcctgcctcagcctcccaagtagctgggactacaggtgtgggcgccaccatgcccagctaatttttgtatttttagtagagatggggtttcaccacgttggccaggatggtctcgatctctcgatctcgtgatctgcccgccttggcctcccaaagtgctgagattacaggcgtgagccaccatgcgcagcccaagcagggttcatttctaatatctgtcatattgcagtacacaagaaatggtcccaggggccacttcc

SEQ ID NO: 592268 - DNA, 553 bp, Homo sapiens
cctgactcccttaggctctactttccttcgatgatggcttctgcactaaatggctgatcgcagttaggtgaaagccctgtcatgttcagcctccaactggttacgtcgagataacaggtctaaggaattacaaaagggaacattaatttgtgcaagaatatttaaaacatctattgagtatcaggcatgggcttcagagagcctaaagagtctgtagcataaaagagaaatgaagacaagcacaaacaggatacatgtgatagctgaggatggataacatactatagagcagtggttctcaaactttctatgcccctcatcctcctggagagcttgctgtcaggatttgaaacctatgtgctactgagtggcgttcttcatgactggatctggtcagcacacccctcccccagcttccaaattcaactcaaaccaagacagactatctgcagggatggcctgttcaactctgcaacaaggcctgtgggcggagcaaacaagataatagcctacagtcccagctacttgggaggctgaggtgggaggattgctg

SEQ ID NO: 592269 - DNA, 210 bp, Homo sapiens
ttagaggatcttgtactaatataggccgggatatgcagtacttcgtcagctacctgctcaggaggtgaggggtgatcagagctgtccagagtgagctagctgaatagagagctgaaaatatctgtcttatcatttcctggcagaggaagtggttgaccttctagttattggacctggtaatcttcattttgggtagcgagtaattcggaa

SEQ ID NO: 592270 - DNA, 120 bp, Homo sapiens
tccatgaaatgatcaccgggattgcaaatctaattgggaaacgagttgagcaaacagcttggactgtatggagttgttgccttactttttaatatgtatttataaagtattgccagcgct

SEQ ID NO: 592271 - DNA, 134 bp, Homo sapiens
gtcaaggctcccgtttgcccatcatcgatgtggcccccttggacgttggtgccccagtaccaggaattcggcttcgacgttggccctgtctgcttcctgttaactccctccatcccaacctggctcctcccacg

SEQ ID NO: 592272 - DNA, 102 bp, Homo sapiens
tgggaagagaaaagaggtcggctgctctaacccgcaccaggcaggtacaggtgcacagtgattcatgcggagataaaccagtgcgctggtctgtaaccgtga

SEQ ID NO: 592273 - DNA, 212 bp, Homo sapiens
atcagtgctactgtgtgtacctctattcattaatttctatgggtcacccctttactagggaatgacagcttcaaggtaatggataagtgacagagcttgaagggtcagcaattcagtcatgccactggtggtagttttcacattgaagtgagaagaaaagctgtgacggatgttggtagggcagccgagagttcagacctgaatagattaga

SEQ ID NO: 592274 - DNA, 313 bp, Homo sapiens
ccaagaattcggcacgaggatgagatgcagaccgaggctgatactatgctgggggactggagggagaaatgttccacatgggagacggtgttcgcagcacgaacgtcctggtggcaaggctcacatgcagcatgccctgtgggcaacgcatgacggtaacctttgttcccccatctgaaaaaaatcacaaatgagagtgaccccagagcacagtggctcagggcccaagttcttttaacacagaacctgacccaggatttctattcataaaatattcactattaaagaaataaaataaggcagagacataaga

SEQ ID NO: 592275 - DNA, 349 bp, Homo sapiens
agctcaccggctccttacagaagtggcagatatgcaggtgctactgggaaagcaagatataagataatcctagataacacatctgtagtatctgagaataagaaagtgcgcaccacaggtgatgcaggttgaaagggcgcagatgccatcttgtgagagtcccaagggtcaaagcggaagactgatagctagggatagtatgggattataaatcatggaataaaataaacatctatgagtccatatcgatataaataattgaataaatagaggagagacagggagtcagtccttcttaccagagaggaatcccacgcctaatgggccaggagcgggggagcaagcatgt

SEQ ID NO: 592276 - DNA, 958 bp, Homo sapiens
  misc_feature (363)..(363): n is a, c, g, or t
  misc_feature (377)..(377): n is a, c, g, or t
  misc_feature (431)..(431): n is a, c, g, or t
  misc_feature (442)..(442): n is a, c, g, or t
  misc_feature (457)..(457): n is a, c, g, or t
  misc_feature (464)..(466): n is a, c, g, or t
  misc_feature (470)..(470): n is a, c, g, or t
  misc_feature (488)..(488): n is a, c, g, or t
agcggacggctgcgatccgggtgtctggaggctgtggccgtttggtgttcttgggctaaacagtcggcgggagtgaggcgggccggcgcggagcgacgaccgggctccggaaccactgtgacgacggggctggatctgacctgaaaaaaatgtctggatttcgtagagggcttgagatgctcagcaatgcacttgacgtggggggaaaagcgcaatactagttgcttgccagtgtgctggcatgggatgtagctatcgtgtatgtacacggctggtggattcatcagtagatgcagctgttcatttatcccaccatgaaagattgcgaacgcactcataccatgcctgtggtgttatagcaancatagccttcctantgattaatgcagtatcgaatggacaagtccgaggtgatagttacagtgaaggtngtctgggtcanacaggtgctcgcatntggcttnnncgtnggtttcatgttggccttnggatctctgattgcatctatgtggattcttttaggaggttatgttagctgaagagaaaaagacatagtataccctgtgaattgcatgtatttttccagaatgccttcatcattttttggagggctggtttttaagtttgggcgcactgtagagacttatggcagtgaacacatctgatttcccacagcacaacgaggcctgcatgggtttgtgatgtattttttactgcgtcactcccaacctttggtaatgccattattctaaacttatttctgagtgtagtctcagcttaaagtggtgctaaatactaagaatcacgagaacacctaatacaagaattcaagaaatcgtattgtggtatgcactttgattaagcttagtaaaatgttaggaggaaacttttcacattgaataattgtcgtcaaatttttatcatgggtataattgtgtggaacaagtgtaacagatac

SEQ ID NO: 592277 - DNA, 585 bp, Homo sapiens
  misc_feature (12)..(12): n is a, c, g, or t
ctaacccttttnaaaaagaggaggtagttttttttttttatttataaaaaaaaaaaaaaaaacactctccgtcggcggccgccaataaaagaaaaaaaaaaaacccccccctttttttttaaaagggggggggggtttttttttttttttttttaataaaaaaaaaaaaaaaaaattgtgggggggggcccccccccgggggggggggtgtttttttttttataaaaaaaaaaaaaaacaccccttttttttttttttttgaaaaaaaaaaaaattttctccccccccggggttttttggggggtttttttaataaaaaaaaaacccccccccccccccctctttctttttgggcgccaccccctttttgggaaaaattttggcgccaatttttaaaaaaaaaaaaaaagacccccctttttttttttttttttgttttccaaaaagtttttggagagtgtttctaaaaaaaccccaaaaacccttttaaatattctttgggcccccctgggccatttaaaatggggccttaaaccccacccagtttctttaggggagcccatattgaccatgcttcctgatagg

SEQ ID NO: 592278 - DNA, 257 bp, Homo sapiens
ccttcagtgggatcctaaagtctagagatcaggactctggcagttgagagactgttggagcctcttgttacacaggttacaacccttgtaaacaccaatagtaaagggcctctaataagaagagaggtcgttctaagaaggcctgttttggctgctctgttgacaagcaactgagattttttggagaaggggttaaattgcgggaggccgtttcacaggagggctgtgctgctgtgagttcgaacagtattatgagc

SEQ ID NO: 592279 - DNA, 296 bp, Homo sapiens
atctgatagaattcagcacagggcacatctcatcagttcctggttttcatgcagcacacacttttcaattcattgcattccagccttctatactcactcatttggcacttgtctttttcacttcattttcatttgttccatttgcttcaatttatttatcagatttatccaaacatcatcccctgcaagcattgttaggttgggtgggcatcctctagcagtctgcacctgccagtgccatgcacagctatgtgccacttggcctgtctgttattcacaactgtctgaaaaaattg

SEQ ID NO: 592280 - DNA, 162 bp, Homo sapiens
ccttacttgcttatataacccctgtcactcttgctccgggataggactgatactcttatccatcggattgggagacatacgcacatataggcaagggagctgggccaagtcacacagccactaagtggctgatgggagccaagatctgaacccacagctaac

SEQ ID NO: 592281 - DNA, 308 bp, Homo sapiens
caagagctcttggtaagcaattggctccacaaagtcaacctgaaagccatctggtcatagctgattctatgtgcatcatcctcaaacaggacattccagtccaaaccttggtaatagaaccagtgtttccaattgtgtcctgttacaaggagaacagattcttatggaagttattcaataactatatggccatgaaaatagaatactcaataatagtttctgattttgggaggggtcaggccggaagaaaaagataatggcttcaatttggtttagagaagtatcatttactataatattacgagtca

SEQ ID NO: 592282 - DNA, 313 bp, Homo sapiens
  misc_feature (250)..(250): n is a, c, g, or t
  misc_feature (253)..(253): n is a, c, g, or t
gcctggttatggccgcactctcgctggtggcggcctgttggggtagagcggccgttgacgatccagtccattttccggcggctccaggtagcagcgccagggccagtgagacgatggtctccgtgactatggccacttccgagtggatccagccctttaaggaagccggcattcctccaggacctgccgtcaattatgccgtgatgtttgtggataataggattcagcagagcatgctgctggatctcantanggcgataatgaatgacctgcgcgtgtccgttccgcggggctcggtggggttcctccgccc

SEQ ID NO: 592283 - DNA, 197 bp, Homo sapiens
atgctatccgtgtgtcgagtacactgccccttccttaatcactctgctgtttacaggacctgggtgtgctgacaccctcaggcagtcagcgattgagctcatcaaagctctagtctgtaacctgctgagccctattcgctgccagggttgcagcacgacgtaggttgagtgcaggggtgagatagcatgcttggaca

SEQ ID NO: 592284 - DNA, 133 bp, Homo sapiens
  misc_feature (18)..(18): n is a, c, g, or t
taattataattatcctgnaacagctctttggtgctgctggtgtcatggctattgagcatgcagattctgcaggtgtggaagcctaactcttgttaaaggtggtgaaatcgcctctacctttgatcacccagaa

SEQ ID NO: 592285 - DNA, 174 bp, Homo sapiens
  misc_feature (88)..(88): n is a, c, g, or t
  misc_feature (154)..(154): n is a, c, g, or t
gaaatgctttgaatacttacgacatggccgctcacactgattgccaagattgacagcactaaccatcgccttcacttgttccagggtnaagcccctagtcaccccgctccggggcacctcctggaaccccggcggcaaacttctgccgctctgnctgcccccacccgggcggga

SEQ ID NO: 592286 - DNA, 111 bp, Homo sapiens
ctaattggttcttcgatgacgcttccttccgggagaacaggacctctgctctgaggagatgggaactgcctgctccggtacgatgacacccgtcatcgaagaaccaattag

SEQ ID NO: 592287 - DNA, 1365 bp, Homo sapiens
  misc_feature (319)..(319): n is a, c, g, or t
  misc_feature (522)..(522): n is a, c, g, or t
  misc_feature (524)..(524): n is a, c, g, or t
  misc_feature (843)..(843): n is a, c, g, or t
  misc_feature (1213)..(1213): n is a, c, g, or t
cgtaaacagcttgaccttatattggtcccaatctcctgcaaaatcgaggtgatctcactattggtactgaacttcttgcccggacatccctcaagctgtgccccttatcatcacgtggagtaactagctccaccttggaggcaggaccagagctctcctatacttatgttagatagaacaccacctgtgatggtgatgtgtgcccggtgcgcggctggctgtcactgccgtgatataatcttcctatattatccattagtgagtatccgagtgatgtggtggagtcagccgtatgggtcaggatgaatccaaggtccantctcatgtgaactacagcgatgcgtgaagaccaccgagtcgtttaccgtacagacaattacacaaaacatttaagcgctgtgcttcgtcgtgcttgtaacacccgtcgccttatgtttacgcttcactacgcctgacctcgcggtacgtgcgttgattagcgtaggggaaggagcattcgaagcatgtcgaagagcacatcgngngttatggcagccgaggtttggccaccgttcgcacgcttaaagggatgcggacagccctaactttcgcccatcccccatgcgcctggccggccaccgattgaagcaccacatggaacttctactatttctcccttccccctctaaagcaaacaacattaacgacgagcatgttagtgcattgcgtctgacatataattaccctatggagaggggaccgaattcaccaaaaatttttacaaatactaaccaaaaaccatgagtttcactaacctaggtggaataacaattaaaggcacacacccactttagaaccgattcnacaatctacccaagattgaacgcacaagaaagtagcgcacgcgtaccatttcgggtcatagagcgatcccccggaaacgcgtatgaatatgatacaaggcttgtggccattattcccttgaggcttcacaatcgcggtatattacatctgtcctccctcacggttctctccctgaagagcaattgtggggtcgaggggagaatttaacattaaaatggtcttgagtcgtcaacttcaacgacatggcctggaaatatacacattctcactggatgccaattgcctagttcagtcccggaaaaacttcaccgagcgaagcaagggaaagggaaatggaattccacgagatatatacttattttaccgccanaaaagggcctaagtggtcgtcggacttgtaagttgccgaggtaccattcaacattagaacacgcgcttatggacccacatttccatagaggatagggggtcaattgcatatggccacattgtcagggtaaatttctgcaattgtacggccac

SEQ ID NO: 592288 - DNA, 353 bp, Homo sapiens
  misc_feature (12)..(12): n is a, c, g, or t
  misc_feature (62)..(62): n is a, c, g, or t
  misc_feature (104)..(104): n is a, c, g, or t
  misc_feature (163)..(163): n is a, c, g, or t
  misc_feature (269)..(269): n is a, c, g, or t
  misc_feature (319)..(319): n is a, c, g, or t
agcgggcaaggntgaaaaaccccccagtgcaaaatcctccttccttccccaaatgcccagcnccccaccctctcctggtctcccaccctgcccctttggttacncccctagtgtccttccaggtagttccttgtatttttgtcccacagtttacacatgttancaatgggaggactgggccccacagtagctactcaggtattaattgttgtagctggacatggtggtgtgcacctacagtcccagctacttaggaggttgaggtgggnggactgcttgagcccaggaatcctaggctgcagtgagctaggagtgcacnactgcactccagccagggcaacagactctgtccc

SEQ ID NO: 592289 - DNA, 241 bp, Homo sapiens
ctaggagtatcccggcacagcacgcgctaacaaacgattaaaacaaaaatatagcaccaggattctgagcagttctatggtgagtatatcagcagaaataggtgtaaatgctcttgacctggttgctatgcaacacatgctcaatgagtgactacgctccagtgtcttatacatttttctcttttatacattgtttcctcttggaaagtatggcagatattgtagtggaagacgaacgctg

SEQ ID NO: 592290 - DNA, 697 bp, Homo sapiens
cattaagcacataaatattgttgggtgaccatcaccactatatagctctagaacgttttaatgttttccaactgaaatgttttgtccattaaacaataactatcccctccccctagctcctggcaaccaccattcgactttctgtctctatgtatttgtttaagtacttcacaaaagtagaatcatatatagtctttgtcctctcaggactggcttatatcactcaatgtcttcaaatttctttcatgttgtagcttatgtcagaatttcctttctctttaaggtggaatcatgtgtgtttgcatgtatatatatgatgtgtatatatatgatatatatgatatatatcatgtgtatgtatgatatatatcatgtgtatatatgatgtatatatcatgtgtatatatgatatatgtatcatgtgtatatatgatatatatatcatgtgtatatatgatatatatatcatgtgtatatatggtgcgtatatcatgtgtatatatgatatatatatctcatgtgtctatatcatgtatatatatgtacacataaaatagcatgcgtatatcactttcatccatctcgtgatatgacacttgttcgcttccacattctggctattgggaatagtactgctgtgaacaagcttgcactatttgcttgagttgctgatttaacccttttgcgtttatgcccc

SEQ ID NO: 592291 - DNA, 445 bp, Homo sapiens
gggggggggtaaaaaaaaaaaaatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaactttttggcccctttggcccaagcgatttttaacttgggcaatttttttcttggggcccaattttgggcctctttggccaattcccccttttggggggcgttttaaaattcaatggcccgttttttaaaacggttgaattgggaaaaccctggggttccccaatttaaaccccttggaaaaaatcccctttttccccgttggggtaaatccaaaaaggccccccccaatggccttttccaaaatttggccacccttaatggcaaatggaaatttgaaggcgtattttgtgttccgggttttttt

SEQ ID NO: 592292 - DNA, 1039 bp, Homo sapiens
ggcaacgcgtgggtgtgtacctcttgtgttgggagcagccaccggacttcttcaagccagaggtatagacgatcctaaatgtgtcatccatccgaatcgccgaggtgtcttgctgactgtgcatccatcgcctcgaacatgttgacaggctccctggaaactgggccaattgcagtcaccagaggccactcgctaagcactccgctgactcgatgtgcacgctgcatgctgttggggagatcgagcgctgtcgggaactcgtggatcgtgcagcatcgcaggtattgcctgccctagtgtaggtgtgttgcagacaaagaaaggctatggcggtgatgccgggggagctttgacgctccgaggggctcgaccgcttgtgtgcctctgagggccgttacctacctaggggagagtctcggagaatgtccggaccggtgaggtgaggtaatacgtgtaggaccctgggattttagcccaaccgatttgtagaacgacagagcttttgggcgagcattcgcttgtgagaactttgcgcgatcttgaaggctctgggtatttgccacgcaattgtaggaccccccgttatataagctttcattccaagtgaacagcttagattcgacgacggattgggcccttatttggttcgcttaggggcgttctccaaccgcaggggacaacggtggcaagtaccatttcttaatactgagcaaagagtttacgccgctgaggcctttttggtaagacagccgttgaggttccccctgtggcgactcccctttccatagtggtcccgcggacgaagattcttcgcttgaagcacattttgcaacgcgggtggggacacttaaacgcgaatcaggggcacggcaatgcaatccaggtttcaggtagacacccattgaccagatcgatcctcgaataggccccttggctgtacaccataggtggcacgaaaaacgtggtttgggatgatatctggcggagcatcccattccggactatgtatcccgtttaggcccgtcacttcacgagggcc

SEQ ID NO: 592293 - DNA, 182 bp, Homo sapiens
  misc_feature (1)..(1): n is a, c, g, or t
ntgataatagtaccagagcttgaatgaacaggattccacccaggcaaccacacaacaatgcccagcttgctggcatgttgttgaaatcgatgaagaaccagtcagtaaagcaaaacagagtcggagtgaaaatgaaggcacggaagcgtatgtccaaatgtgggtcttcggcaggttacatg

SEQ ID NO: 592294 - DNA, 909 bp, Homo sapiens
gtcgtgcgtgggtctgcggcggagcctccttaaggaaggtgcgagaggttggcagcttcgattgaagcacatcggtaccggcgacagctagccaggagctcatgcagcgacagccgtgcgagacagaactacggccgagcgggaatcccgttctgcttccaggaagtggaagtgctcacggatcggtggaaatctgcaaggcatacccctgcaaggtctctggctctcggtaagggaagaattccatgggccgttaccaagagtcgaataggtccatgcgttcccagactcgtagacactctcagggatctatggatcctaagaaggaagcgtcccgagaagggcacttatgacccgggtcgagccaggatcttcgcgtacccgtctctccagttagcaccgggatcacggtaagcaggtgcttacgagtctgaggatttatctggtagactggcacatgggcacaggcgcattctcccaatgtcttactcagcaggcgtcatgctctgggaatcgggcaaactcctgagtcctaacatgttgatcctttgggacgttacttcttgggctgatgcttgtagcagccatcacgaaatgagatctaaagagtaacgtgttctctaaagtactggtcccaattgccgactgttgtctattgtactatgaccagcagtctaggcgttcaagaggatttgccgtttggtatccttttgcaaatgtagatgactgccagggaagctaacagaacgtgccactggagtggagcttgatgggccgtagactccgcaggtagatctctcgtatgaccccaaagagcgcataagcctacaccagaactttacactgggggagacgtaactatgggagatcttgccgtccggattctatgacggaggatttgaaccgggc

SEQ ID NO: 592295 - DNA, 336 bp, Homo sapiens
  misc_feature (195)..(195): n is a, c, g, or t
ctgcctccctcttcatccatctaaaacacttacctttgtgtgtttattacatgtatattgggggtgagtgactggagttttgttaggtgcgtgatcaaaagtttggcgactggtcggacttggtggcttatgcctgtaatcccagcactttgggaggctgagacaagtggatcacctgaggtcaggagttagagnacagcctggtcaacatggtgaaaccctgtctctactaaaaatacaaaaattggccgggtgcgatggtgcatgcctgtaatcccagctactcgggaggctgaggcaggagaatcgcttgaacctgggaggtggaggcagcag

SEQ ID NO: 592296 - DNA, 202 bp, Homo sapiens
  misc_feature (22)..(22): n is a, c, g, or t
  misc_feature (182)..(182): n is a, c, g, or t
atagacggggttttgcatgttnggcaggctgtctcgaactcttgacttcagatgatccatctgccttggcctcccacagtgctgggattacaggcgtgagccaccatgcccggcctctttctctacctttacaccgtgtcttcttatccgtcacatcgtgttttcacaccattcagcctctngtggggatcctctacgagtc

SEQ ID NO: 592297 - DNA, 161 bp, Homo sapiens
tggagggggggtatttatagcacttcatatttttttttgtctctcccaataaaatctcccccacttcccccgaggggttcatttggtggggaaccctctaaaagtcgccctgcgggcttgcaggttggacatgggcggtggttaaccaaggtggtgctggg

SEQ ID NO: 592298 - DNA, 186 bp, Homo sapiens
atcctacctctataactctaattcattaatcttatcttagatactttatgtgtttacccatctcgactttgtaggcttagtcgtcgctcatgcctgtgtgtcactgtctgcatgcttcctttgtcgccactctgaggcgcctgcctcagctttgtgccccagcctattccccttttcccgagcctt

SEQ ID NO: 592299 - DNA, 455 bp, Homo sapiens
  misc_feature (412)..(412): n is a, c, g, or t
  misc_feature (420)..(420): n is a, c, g, or t
  misc_feature (448)..(448): n is a, c, g, or t
atgttcttgctgctgtggggaagaagaagaaagatgtgatcctggctgacttactgccttccttggctgtttatcttcgaactctggctcctgggctcttcttcagcctcatggcctccagggccagaaaagagcggaaatccaagaactcctagtactctgaccagccagggccagggcagagaagcagcactcttaggcttgcttactctacaagggacagttgcatttgttgagaagtttaatggagactttgtctcacaacgtgggaaagtactgaagaaacagcatctcggtgcagatcatgctggcagagggacaaatcaaaacacgagcaacaacgcttctatcccaggagtgaggaggaaagcaccttaaggacataaactatggatgctgggcgtttaacacntaaaaacntagaaataaacactcttcaaacagtganaaaaaaa

SEQ ID NO: 592300 - DNA, 342 bp, Homo sapiens
gggagtccctcatgactggagcagggtttttctttctctctgggtctttttctttagctgggggagtttggctgtgatcgaccacgctggactgcacacgactacatctaagatctcaccggaacctgcgtatcctgggttcaagcgattctcctgcctcagcctcctaagtatctgggattacaggcatgtgccaccacacctgggcgattttcggatttttagtgaacacggggtttcaccatgttggtcaggctggtctcaaactcctgacctacagatccaccctcctgggcctcccaaagtgctgggattacaggcatgagcgcatcaccgggcggc

SEQ ID NO: 592301 - DNA, 868 bp, Homo sapiens
  misc_feature (141)..(141): n is a, c, g, or t
  misc_feature (160)..(160): n is a, c, g, or t
  misc_feature (166)..(166): n is a, c, g, or t
  misc_feature (175)..(175): n is a, c, g, or t
  misc_feature (177)..(177): n is a, c, g, or t
  misc_feature (180)..(180): n is a, c, g, or t
  misc_feature (190)..(190): n is a, c, g, or t
  misc_feature (193)..(193): n is a, c, g, or t
  misc_feature (227)..(227): n is a, c, g, or t
  misc_feature (325)..(325): n is a, c, g, or t
  misc_feature (354)..(354): n is a, c, g, or t
  misc_feature (359)..(359): n is a, c, g, or t
  misc_feature (377)..(377): n is a, c, g, or t
  misc_feature (411)..(411): n is a, c, g, or t
  misc_feature (428)..(428): n is a, c, g, or t
  misc_feature (516)..(516): n is a, c, g, or t
  misc_feature (537)..(537): n is a, c, g, or t
  misc_feature (553)..(553): n is a, c, g, or t
  misc_feature (566)..(566): n is a, c, g, or t
  misc_feature (594)..(594): n is a, c, g, or t
  misc_feature (606)..(606): n is a, c, g, or t
  misc_feature (608)..(608): n is a, c, g, or t
  misc_feature (624)..(624): n is a, c, g, or t
  misc_feature (678)..(678): n is a, c, g, or t
  misc_feature (681)..(681): n is a, c, g, or t
  misc_feature (689)..(689): n is a, c, g, or t
  misc_feature (736)..(736): n is a, c, g, or t
  misc_feature (801)..(801): n is a, c, g, or t
  misc_feature (860)..(860): n is a, c, g, or t
ggcgggatagcgcgccgccgagccgagaaagaggtcacgaactctgaccccccagaaatacccaaacacagaaagctctctccgccgtgaatctcgatcccacatcccgtcgggtttcttcaacctctcttcccggagggncccccaatccacgagtggnagccgngggactgtngngtngggggccgangcnggggtcagcagggggcaaaagcgccgggtagatnatgggaaccatagaagaaattgcacatcaaattattgaacaacagatgggggagattgttacagagcagcaaactggggagaaaatccagattgtganagcacttgatcataatacccaagggaagnagttnattctgacaaatcacgangggtctactccaagcaaagtcattctgggcaggnaagattccactccgggnaaagttttccttacaactccagatggaggaggtgtcaaccagttattttttaccactcctgatctgtctgcacaacacctgcagctcntaaaagataatttttcagagnaagaaccaaataaggnttttgatctttgngtagtatgtgggagacaaagcatcaggnggtcattatggngnagtaacttgtgaaggntgcaaaggattttttaaaagaagcatccgaaaaaatttagtatattcatgtcgnggntcaaaggnttgtattattaataagcaccaccgaaaccgctgtcaatactgcaggntacagagatgtattgcgtttggaatgaagcaagactctgtccaatgtgaaagaaaacccattgangtatcacgagaaaaatcttccaactgtgccgcttcaacaggaaaaaatctatatccganaggagctt

SEQ ID NO: 592302 - DNA, 227 bp, Homo sapiens
gtctcttagagtatccccggcgcaggggaagtatgtatggatttgaagattcgtccgccgtattcggtgtactcgtaggttcagtaccattggtggcctaattgatttgatggtaacgggagggatcgttgacctgcgactccttcacgttaacgatcgagtagtactcccgatcgaaacccctacgagccacccgtatgagccacgcgtatgagccaccctacgag

SEQ ID NO: 592303 - DNA, 964 bp, Homo sapiens
agcgggtgtgcgcccgggacgcggacgcaagccgccgacggaggaggccttgttaactaacggcctcatccactcgaagaaacacaaatgaacaatgatgaaaagtcagttaggcagggtgcctctcgacaggtagtgaagacaaggatgaaaatagtaagtgaaggaatgtgatattgatagaataagactgaagtgaaagaagaaccggagcttcaaacaaaaagggacatggacgacagaatcagtaacgtctagaatatccgctgtaagttgctgaagaggctagctggaggatgatatgttagtaacattaattcggatggtaaacggttatgtgcaaacttaccatggcaacaaccaacatcataacgatgatggaagtcctatggtgaaggcatttggctatcagtgcagtcttttcaggtcaattgagaggcctcgttgcagcacactcacgcgtatgcttcacatgctcatgcatgaatcgtgccttatatctcctagtcgagaagagagaagtattgaccttggtaaggagactggtggatggattaaggaataacctttgatgacactctcccgtaggttgaacgtactatcccgtatgaacgagcatcagtataacaagggtgatctagcatctaaggttgtctcttgcaagtttgaggcaagtgcctacgaagatactaataggagtccaggagaagctctctcccagcttacgtgtgttgaatccatccaaggccgcaagtctacagaggagtcagtccgaccagaggtgaatgcaagcaccccctaaaaagggcagagccgaaccgcaagcagggcagtctctgagggcggtctcgcccacaccggcaaactgggacagggtttctaagaagcagaacttaacctcaggccaagcgctggcagcaggacatgtcaccagtgggcccaagtggtctgacctggagaaaaa

SEQ ID NO: 592304 - DNA, 169 bp, Homo sapiens
gggggggcccccccccctttttttttttccccccccccctttttggggggggggtttttttttgggccccctttttccccctttccccttttacccggggggggggggtttttttttttttttttggggcggggccccccctttttttttgggggttttttttttttta

SEQ ID NO: 592305 - DNA, 425 bp, Homo sapiens
  misc_feature (261)..(261): n is a, c, g, or t
  misc_feature (328)..(328): n is a, c, g, or t
  misc_feature (335)..(335): n is a, c, g, or t
  misc_feature (341)..(341): n is a, c, g, or t
gcttctttctccagcatacttattttgaaagtcatccatgttgttgtatgcatcagtggcccatttctttttactgctgagtactgttccattaaatgaatgtaccagtttttgtttttccattctcctgttgatggacatttgagttgtttccaggtttgggtaatgataaataaagctgctatgaacattcatgtgcaagtctatctatggactatagggctttcatatcttttaaggtaattacccgggggataggangggctaggctcatatgggtaggttggaatatttttacttttttattaaaactggacaaactgttttncccaagngtttcntatccactttggcataccctacccaggcaggcattggaggaggttttcaatttcttcccatattcttccatcccacattttggt

SEQ ID NO: 592306 - DNA, 361 bp, Homo sapiens
ctgcaagattgctgcatctgctgtatagctgtctttggcctcccccatggcagtgcatgcagactcgcttgattgttgttgaagaccagagggggtgtttccgctctgccctactaccagtacttggctccagaacctactgagcagtcagcacagtcagagaatattggtgtgcgtgggtaatgctggactcccaagcgctgtgccagatcatttgatggagccgggaccaactgtagatttcctgcccatcgttggatttcggcaaaccgctcggcgctggccacgttaaccacaaggcccactgcctgcagttgctgtaactgatcgcggcgctgtgataaccactttctgaagcttt

SEQ ID NO: 592307 - DNA, 132 bp, Homo sapiens
cctatatcagagcccagaaagagtgtggaagatgcatatccctcccttgtagataccgctcagggaattatccagcatacttccaattatttgccattggccacagcttagttacttggctacgtctaacca

SEQ ID NO: 592308 - DNA, 1644 bp, Homo sapiens
  misc_feature (515)..(515): n is a, c, g, or t
ttaaacacgcttaattcatctttatttttctggtttaaaaaccctttgtgtgtagcccccagtgtggacccgtgagtctccggcgtgccagggagaactcgtgggtggtgggtctgtggacgaagcggtggctcaggtgaaacctccgtgatgagggagacactggggtgatatcacggtctctttccagagaggtcgggggtctcagggataccgtgttgggtctctttaaaagatgtggctctcaaagggtggccttggggcgaaatgtgtgccccgagggtgtggcgagtgtgcaccccgcgggcctgtgggtggtgtttcccgagtctctctgcgctctccacgagccacactacagaggagcgcaggtctgttcttgaggcgcaacagagtggcgcgcggagacaacgaagtgccacagtgtggcccccgtagggtgtgccgagcggaagtggagaggcgttaccacagcacacagagagagccgccccaggagcgcctgtgtatcacanctgtgtgtgccaaagggggacacagagagtgtgtggggcgctattgtgcgcgaaaactctgtgtgtgtatcccccgccagagagtaaaccctctctgtgggggcacacagaggtgggacaagaatagtgggagagaaagacttgtggggcccctgagggacagtggacagagcggccccccagcagaggacaatgtgggcgcgcggtggggcccccaccccctccccgtggggggagaaacccacctttatacacacacccgcaagaaaaccccggaagctgctgttgcgccccatgtgtggtataaagttccccccggaaatatgacgcccacacccaaaaaaggaggctcctttatagaaacacccccgtgggagatgagcccgactggtagatcccgcgtagcacgcgggacgctcatgtcggccgctactcccgacgcacgcagcggggggaacaactcaaccaccgctcttatcaacacgacaacaccgtcctcaccaagtcccccgttgtcggcaacacaagaagagggcggcacccccccaaggggagacaagcaacaacactctccaacggaggccaccccccctgcgaggagtacccctcgatcaaacagggggggcagcccagcggcagcaacaacacaggcaagcaaatgacacaactcactcctccccacccaggaggggcacccgtagaacaccaccctctacgacaggagctcccgtgtgatgaccacccatagagagcgcggctccccacaactatttgtgtatgcaatcagcgggagtcaaatcacacacctccagtattataacttcccttagagcgggcatgtatgccgcactccgaggaaaagacatccgcggggaggccgatggtggacccagcaggcacccacggcacaacagcgggacgggccaaccgcccggcgcccccgagagtcacgaacagcgagcgacaaaacccctctggagggtaaacacacccacagagcagctcccccaaccacccaggcgtcccaaagggagccccggggagcccacccgagaggaacaggaggacagcacgcagactaatgctacgaatcaatagacagggcgcggctacataacactccactggg

SEQ ID NO: 592309 - DNA, 108 bp, Homo sapiens
tgctggtcgatctctgcaggatcccctggagttcgccggatcatacgacagaggggcgtttggtattgcgttatggcacgtggtttcatcttgattattgttgtgatg

SEQ ID NO: 592310 - DNA, 703 bp, Homo sapiens
  misc_feature (453)..(453): n is a, c, g, or t
  misc_feature (703)..(703): n is a, c, g, or t
tcatggcggccgggaagatgggggacattcaaactgagcgtgcctaccaaaagcagccgaccatctttcaaaacaaaaaaaggtgtcctgctgggaaaaacgggccaaggagaaagcctcccggcggatacctacaagaaacatcggactcgtgggctctcaagaaaacccaagggaggctatgagagggccaccttacatgtgaacaaggaaagtgccccatctcacgtggataagtggtgctccatctcgaagaggcggaactccttcttcgtggcgcggtggtgtgacacaaagaagtgaaagaagtgcaaaggcaccatgtgtggtcaactcgcgcgcgaaaagacaatacaacgtgacaacaaaacattcccgcacaagtataacaacccggcctcccgaaaaaaaagacgccaccagaagaaaaccagtgctccgggagtaaccacnctgtgtgtcccccgcgtggcatatacaaaggggagaccagactcaacaagaactcaggggtgacccaactcgggtacaccaaagagggggacagaaagtgtgcacgagagcccccacagtgaaaagcaacacagaaccggggcgcgcgcatactcacacgagggcgcacctcaaaggggcgccacacaaaagggggaagaagcacagggaaacccaaagaaaaacgcaagtctcacaaaaaaagatcccn

SEQ ID NO: 592311 - DNA, 167 bp, Homo sapiens
cccggccaaaaaggggggcccccaggggccaaagggggcaaagggggggcttttgcttgggtttttcccccccccgtcccccgggggaaggggggggttgggggggggggcccccccccccccccccccccgggtttttttaaagggttttttttttttccccccca

SEQ ID NO: 592312 - DNA, 775 bp, Homo sapiens
  misc_feature (561)..(561): n is a, c, g, or t
gctggtacaggcccgggagttagggatgtttgtagttctccttggaagaggtccttcacatcccttgtaagttgtattcctaggtatttcattatcttagtagcaatgtgaatgggagttcactcatcatttggctctctgttgtctgttattggtgtataagaatgcttgtgatttttgcacattgattttgtatcctgaaactttgccgaagttgcttatcagagtaaggagatttgggctgagatgatggggttttctaaatatacaatcatgtcatctgcaaacagagacaatttgacttcctcttttcctatttgaatatgctttgtttctttctcttgcctgtttgccctgaccagaacttccaatactatgttgagtaggagtggtgagaacgagcatccttgtcttgtgccggttttcaaagggaatccttcctagtttttgcccattcagtatgatactggctgtgggtttgtcataaatagctcttattattttgagatatggtccaccaatacctagtttattgacaggttttagcttttaataactaanagtttataactgtaaacaacataacaaacattttctagagaaaacaaaagaacaaattacaaacaatgacacacagaccagcacgacacgacaaacgaacaccaacacaaacaaaagaggggggggggccaccaaaaaaattccccccggggggcgccccaatctcgccccccccttttctttcacggagggggcccccaaggggggcgcccca

SEQ ID NO: 592313 - DNA, 473 bp, Homo sapiens
gtgaaccccgggaattcaagccaccctcccatttcagcctcccaagtagcggggaaaacaggcacaagccaccaaaccgggttaattttaaaaatatttggtagcgatgggggcctccttgtgttccccaggctgatctcgacctcggaggctcaatcgatacccccacctcggtctcccaaatgtgtggggataacagggcttgacgatggtgccgggctggggcttttggagaaggagtcttcggggtcccgaaagttctccggcatgtccttgtgggtgggccagtctctgtcccttgatgacaaatttggttccggagtagagtcgggccaccgggaccgggttggggggaactacagggacacagggggtccaaggatgtaccggggagatccacgcggggagtactctaataaggagatacgtgttcttatgcaggcccaagtgggccctgaaagtccttcctcaaa

SEQ ID NO: 592314 - DNA, 405 bp, Homo sapiens
  misc_feature (359)..(359): n is a, c, g, or t
  misc_feature (381)..(381): n is a, c, g, or t
  misc_feature (396)..(396): n is a, c, g, or t
gccgttagcccttaaccatggcctccagattcacatgtaatccccgccagcacgctgctgatactaagggtggaaggcgactccatactccttcagactggtgagacatgccggaggagaaaagaatcatctgcgctgcaccactgtgcccattgccttccaagacccaaacttttgggggatctttcttaaggcaaaagaaagagactttgtgaaaagcaaatgctccgcccccctttaccttgcataaaacttcgctcaagtcgaagatggcggcagacacgagggcggtggtcatcctgtgcgttcgcgcgagccaggggcgaggatctggtgtgtcgcgaaggtcccggtgcggngaaggcgcagcctctcctaggngttaaggctcccggnggtaccgag

SEQ ID NO: 592315 - DNA, 202 bp, Homo sapiens
agctgggcaatatggtgaaaccgtctctactaaaaaggaaaatacaagaatttcctcagcgtggttgggaggaacctgtaatcccagattctcgggaggctgaggcaggaaaatcgcttgaacccgggaggtggaggttgcagtgagctgagattgcaccactgcacttcagcctgggcaagaagagcaagactctgtctca

SEQ ID NO: 592316 - DNA, 446 bp, Homo sapiens
ggccccccgggttttccctttttggtttcgggtttttttttttggggaaattttaagggaaaaaaatttttcccaaggaaaaattttttccctttttttcccaaagttgaaatttaccccccctaaaagggaaaaaaaatgggggttccccccgggggggggcctttttaaaaaaatggattcccccgggtgcaggaattttggccgaggttttttttggggaaattcccttttttttttaaaaaaagggaattttaactttttcccttcaaaaaaacccccccacttccttttttaaagggaaaaatcaaatttttaaaaaatgggggccccccccttttttggggtttttttaaaatcgggcccccgggttgggaaccccaaaagggggaaaagggaagggcaaaggggcccctttaaaaattttattttttgggtaaaattta

SEQ ID NO: 592317 - DNA, 195 bp, Homo sapiens
  misc_feature (102)..(102): n is a, c, g, or t
cgtcctgagagcattatcaggcgatgcagagtgcgaatatattttcagaaagattataagtgtgtccagttttgcctgtctataaatgatagtagttaccangttacatttgcagaatgaaaccaggtgtacagttatcgttgtactttgtacatgtgatttgttataattataggttctttattttatatatcc

SEQ ID NO: 592318 - DNA, 108 bp, Homo sapiens
agcagatcggagagaataaataccggtttggggattctcagcagttgcggctggtccgtattctgcgcagaaccgtgatggtacgagataccgaactcaaattcgtaa

SEQ ID NO: 592319 - DNA, 341 bp, Homo sapiens
  misc_feature (169)..(169): n is a, c, g, or t
  misc_feature (179)..(179): n is a, c, g, or t
  misc_feature (181)..(181): n is a, c, g, or t
  misc_feature (188)..(188): n is a, c, g, or t
  misc_feature (201)..(201): n is a, c, g, or t
  misc_feature (254)..(254): n is a, c, g, or t
  misc_feature (258)..(258): n is a, c, g, or t
  misc_feature (266)..(266): n is a, c, g, or t
  misc_feature (316)..(316): n is a, c, g, or t
  misc_feature (325)..(325): n is a, c, g, or t
cccgggctgggtcccccccctgggcaggtaggggggagcttccctgggtgggcctcattttttgctgcaaagaattttttgccctaagtcatgctgtttcctcaaaaaagctttgttttttgttaacgtattactcaaagtcccccaagccttttggctaagggtaaangtgggacggnangcggganggggctggtggtncccctcgtgcggggtcaaccctgcagggagttgtggccccttggggccctttnagcncctggccncctgctgtccccggggcctgtgaaatttgtcatgccatgacccccccgcnttaaacctntttttttaatgtgtta

SEQ ID NO: 592320 - DNA, 109 bp, Homo sapiens
gtcaataaattcttagctctagcctatatcctgaatggtataagtctaggtaactatctagggtttttatagttttgaggtctaacgtggaagttaataactccatcta

SEQ ID NO: 592321 - DNA, 366 bp, Homo sapiens
gcagtcttacatcttacaagggattaaattaaaacataagtagtcaagtaatacatccctgtacagtaattttttatcacattatagtttgaagcagctgtacagatgtctcggtgttcaaatcattctcccttcaggtaattatcaaagctgtacagtgaacaggagataaatagagaattctgaaatgttcccgcttgcctgcaaggtttaccctattctgtttttattatcaaatctttataatctggtacctgttcttgatgctggttagttgctgttgtgaggggtagataaaataacatatttgaaagcatctattacagagcaatacacaataaatggctgcaatgagaatgaaaactt

SEQ ID NO: 592322 - DNA, 383 bp, Homo sapiens
cacgaggcctgttcttccgcccggtgggcttcaagtaccgcagcctgatccaggacctgcgctggcgctacgcctgggactgggcgctctttgccggcgccgtggtgccggccttcatcttcggggcagccttcggcaacctgctccagggggtgccgttccacttcgaccgggatctgcgggtgttctacaccggcagctttttcgcccagctcaaccctttcggcctgttctgcggcctcctgagcgtggccctgctggtgatgcacgggacccattacctgcagatcaagaccgcgggtgcgatctacgaacgagcgcgccgcgccggctggatcgccgccgtcctcatgatggccttgttcccggcgggcggattctgg

SEQ ID NO: 592323 - DNA, 154 bp, Homo sapiens
acagacacttacggcttcaaggacagcactctgggtccgcgtggtacgcagagccgcggttttgaccggagcggtaaccagggcactgtcgctgaatcggacaacgacccgctggcattcggtggtaacgtgctgatcccaggctggtgccgga

SEQ ID NO: 592324 - DNA, 219 bp, Homo sapiens
aaatatactttacttcaagtctaatacagtaacgcttcatatcttcatggagaaaactaagagcaatagataggctaagcgcattacaaatttgtacctaaaaatttcagatacactatttcgcctttgctttctctagacaaatctctagcccgactttgtctaggccctaggggcctgactctgctcttagacaagtcactgtgcgtttaacaattt

SEQ ID NO: 592325 - DNA, 606 bp, Homo sapiens
aataataaatgctgcaaataagcatctcactttgtaaaaataaaatattgtggttttgttttaaaaaaaaaaaaaaaaaaaaaaaaacaaaaaaaaaaacaaaaccaaaaaaaaaaaaaaacaaacactcaaaacccaccagccccaacaaaattcaaaccaaaaccagcccaaatcatccggccaacctacgatctaactggccccattgcccctctgctaaacgagtatccccatccatcagccacaggcttacaatgcccgaacctggcccctgccgatacccaccttagccacctatgcgaacatcccaatatcccatactggaatctcaccttttacccccccaccagccgaccttccgaccatttgcacatccctactatgagtggaccaatctaagcctacccagcccctaaatcatggaacccccatcacttgcaccttacccacccgtgctacgcataactcaacaccaagcctgaaacaaaccccccttttcaaccggaccccccaccgccaacgtgggaccaacccgactctcagccccagcacccctttccatggcccctgcccttccccaatcctctttccctcagccccccc

SEQ ID NO: 592326 - DNA, 206 bp, Homo sapiens
actacgcccagctaatttttgtatttttagtagagacagggtttcaccatattggccaggctggtctggaactcctgtcctcaagagatctgccaaccttgctatttctaatatttaaaaggaaaataaatatctatgctgaaaataggaaggttaaaacccagacaacttatttaaattgaataattttcgctaatatggttttc

SEQ ID NO: 592327 - DNA, 327 bp, Homo sapiens
  misc_feature (13)..(13): n is a, c, g, or t
  misc_feature (279)..(279): n is a, c, g, or t
  misc_feature (322)..(322): n is a, c, g, or t
gagacagagtctnaactctgtcgccccaggctggagtgcagtggcgccactttggctcactggcaacttctgcctcccgggttcgagcaattctcctgcctcggcctcctgcgtggctgggatttcaggcacacaccaccacacctagctaatttttgtgtttttggtagagacggggtttcaccatgttaggctggtcttgagctcctgacctcgggtggttccgccgcctgggcctcccaaggtgctgggattacaggcatcaaccaccgtgcttgnctatggctgagtgatttcaaacagaattccatctagcttttanaatgg

SEQ ID NO: 592328 - DNA, 168 bp, Homo sapiens
gtgatctttactatgtggctattggcacaacaagaggtcgggagcgtcttctcttgagggagcaatttggagaagaagtggaacccaagactcgtgccctggattgccttctttatcatcccacaagcattccatctggttgggagcactggtcctggccttcagata

SEQ ID NO: 592329 - DNA, 1444 bp, Homo sapiens
ccagcggggtccgggcactcgtccaggaccgcggaggtgtagcggggcgcggcccgggaggccatagtgggctctgggcatggggagcacacgcgtcgcgctgggatattacaccggggacggttgtcggcgcgagagttgaattgcggaggcagatgacggggaccgttagaccggggcgcgaggtccggggccgctgaacgcattcggcagggagaggtggggcctcaaggcactacaagagacgatggaatgacccgtgtagcctagagatgtgtcgatcgacttaggatcagggcacatgatagatcaaattccctgtgatgggatcctactctctttttgctcgttgcctaattatggggaagtcatgatgatcaattggaattatcatgtcctttgaggtgcgacgtcgtcgtcaatcggaattgggagtttttatgcgtcgcactttatggccttgttgcaaagaaagggcgagaaacgctcagttgcacatggcctatggcgggcaacactaggggctttctaagggcaattattgaaacgcgtagtcgggggaggagctgatgacacgatgggttcaaaccgttgggggataactggaggatagttatataggggttgacttaggcatatggaagaaggggttgagaaagaaccctggcgcaaaataggaggttgtggagtgcccaatttatagtcccatggggcttctagatgactttctttgcacgaggtcggggtacgctccgggtttggggaccgattaatgggcggttgggattggagaggggagtacattcgacaggaagtaccgggaaggagaagacgcactatagacgaagggtaggatttccacttttgggcgcaagtggaggatttgaaccaatggaggtcgggcttgggtggagaaattccggttgataggcggtggtgattagcgggccaatcatagtagcagcagttgggcataactccaaggtggggacagacggttgggcaacattcgcggatacatgcggggtacctcattgaatggggcagtaaaaggaaatgcgtttggagtacacatatggaagttggcgccatggggtctaagtgccgagaatgggaagatggtttggacagcagacgtgttcgatagcaacacaggaggtcgtggttgaataattgggcgtataacattgtgattggttggaaaagtatgtggggccaaatggaccggacggcctattttgggaaatggaccaagtgattgtacttaaaagtaagccataacagaggtgtttacccattgaaagcggccgcgagaacactattgttgtgtaacgggggacggaaagtgtggttagtttgcgaaacggagagaatattgtcagcacgtatattaagagggaagggttacaagttggattgcaagcggtggtgatagaaatgagag

SEQ ID NO: 592330 - DNA, 568 bp, Homo sapiens
ccctcagattactcaatgttaacccagaatcaaagtatagaagtgtataggatgacattggaacacagtggagaacaggatatgtcttagggccatacagttctgggtttccgatcctggtccccgatcacttggtagcttataacctggatcaatgtgttgtagttaaatctgtacagttacctcacctgtaaaatggtagactatgatttctactttacaggtgatccggagagaaaaaaatacctcagagacagtgggctctttgacagtgaatatagccctgatgctcgttaagtgtttatgaacactgtccatctgtgataagtaattggtgagcttgggaactaataagtgcataagagagtgctacctggcgtttataagaatgtgtaagtacaaggtatggatgagagataggtgatctgatctgtgagaatgtacttggagtactgccagagaatcatatggcaggtgtgcagatggagcttactttccatttgggcttactacagtatgtgtattccagttggaaaggaatatctggagatttgtctgtaatgcattc

SEQ ID NO: 592331 - DNA, 1179 bp, Homo sapiens
gcctcgtgccgggaccacgtctgcagagggatcctgtggctggaagctgaggaggctccacacggtcgtatagcagtctaccgcagccaggatctgggcatccaggcaccggcatgaaccctccgaggctcttctgggtgtggctgcttggttgcgaggaacccaaggcgtgaacgatggtgacatgaacggtgtggccgatgggggcgcgccatccaaaccagggcctgcgtggatatcttctaccgagcgccagtggggcactgtggtgtgagaacctgtgggacctgacatgatgcctaggtctgtcagtcatgccaggagtcccctgcgggactactgcagaacgccaccacaggctctgcgtgcacagagcctggcttcaggtgcaacggatcgaggtcccacatcatgtcgtgagatgaggtccaagctgcatctgggaaagcgatgacctcactgggcgctgaacttgcacaagcgtccctggcgtctggccctgatagcagccaacttgtccagggccactgacgacgagacgcctagtgcagtagcgctctggcaccgcacagtgcacataccccagagtagactacccaacatgccctggaagactctccagggcagcctctacgcgagcgcctcgttgcgcccagaattctcttgcccaaggcccatgcggcgagtctgcggacacatggaccaatctaagcggtgaaattgtagcaagggctcgaacggagacgcccttaggacttatcttggtgggaccacgccgcgatccagtccctagaacctggtcgaccactagtgagggcccaaggcccctgccgacgcaagcggagcccgtgggcaggcaactgctcagccactgaggtcgagcgattgctgcaagagatggatgccccactggtacacgggaccctgacatacagacgtaactgtctactaccggtacggagtggaacacatttatccccgtgtctgtgccagccagaagatggccctgccacgaaagcctggtgcctctgacgatacttggcgccacgatcagtcgtgcaagtggctacgtgtggcctaagctcgtcggccattcgtaccccccaaggacgcatttgttacgaaatgtcgcatgaagctgatatcgccatatgcccagtggacacacgctggccgccc

SEQ ID NO: 592332 - DNA, 849 bp, Homo sapiens
tgcggtggctcatgcctgtaatcccatcattttgggaggccgaggcaggtggattgcttgagatcaggagttcgacccatctctactaaaaatacaaaaaaattagccaggcatggtggtggccacctgcctgaggcaggagaactgcttgaacctgggaggtggagtttgcagtgagccgagattgtgccactgcactccagcctggatgacagagcgagactccgtcttaaaaaaaaacagccaggcgtggtggcacatgcctgtaatcccagctacttggcaggctgaggcaggagaattgcttgaatctgggaggttgcagtaagccaagatcgcgccactgcactccagcctgggggacagagtgaaactgtctcaaaaataaaataacaataacaacacataaagataaaacatttatggtcattagaaatcgacaaatggacaacacattaaaaataagagagagggccgggcgcggtggctcacacttgtaatcccagcactttgggaggctgaggcaggtggattacccaaggtcaggagttcgagaccagcctggccaacatggtgaaaacccgtctctactaaaaatacaaaaatcagccgggcatggttggcacacccccgttaatcccagctactcaggaggcttgaggccagaatttgcttgagcccagggaggccagaaggttgccagtgaagccgagatcatgccaagtggactcccagcctagcttgacaggagcgaagaaatcctggtttccaagaaaacaaaatcagaaaataaaacaaaaatcttttgggcgcgtcattctcgcctctcgaaaaaagtttttagaacat

SEQ ID NO: 592333 - DNA, 151 bp, Homo sapiens
tatcacaagctatcagcagccccagcactagccaaagtagacaaccccagagtaagtggacacgaaaatggactaccattaacggaaactcggaaagtgtaacgcaggtactacctgctagatagtgagtactctggcgtcgaattattca

SEQ ID NO: 592334 - DNA, 305 bp, Homo sapiens
gtaaattgtgtggtccctgccgggcgtggtggctcacgcctgtaatcccagcactttgggaggccgaggcgggcagatcacgaggtcaggagatcgagaccatcctggctaacacggtgaaaccccgtctctactaaaaatacaaaaaattagccaggcgtggttggcgggcacctttagttccagctacttgggaggcttaagcaggagaattgcgtaaccccaggaggcggactttccagttagccgagattttccacttcctccagcctggccacgccacagacgcgagactttttttaaaa

SEQ ID NO: 592335 - DNA, 605 bp, Homo sapiens
aaacccttgctgacatttcttaatcacctcctagaagctataatagtagaactgcagaaggtgtagcgagagtaaattattgtactcacagtcagacactctgtgactaccctacaagggatccagcgctcacatacatcatgatcgtcatcgctttctgctgatctgcctgacttgactacactaaactaaaatacttaggaatagacctgacccaggaggtgaaagatgtctactaggcaaactaacttttagtatctgtaatgggttaccaatgagcaggcagcaggtacagcagaagaagtcagtgcgtgggcttgcgcatccaatgggtactgcaccttagatggtaaggcttaggttttgacttactaaattactaggtacgattattttctagtttatgtcattaaaccttaaaaactgctaagtaaccccttccatctcttgttaaatattgtaacatttcatactctcatttatgctgcctgacgttagagtgtatgtatccatatggtgactacctaaaatactacctataaagagtaaactgttagtagtgttttagctgtatttaatgcagtacagcttaccttgggatccct

SEQ ID NO: 592336 - DNA, 830 bp, Homo sapiens
  misc_feature (11)..(11): n is a, c, g, or t
  misc_feature (61)..(61): n is a, c, g, or t
  misc_feature (65)..(65): n is a, c, g, or t
  misc_feature (79)..(79): n is a, c, g, or t
  misc_feature (89)..(89): n is a, c, g, or t
  misc_feature (96)..(96): n is a, c, g, or t
  misc_feature (104)..(104): n is a, c, g, or t
  misc_feature (106)..(106): n is a, c, g, or t
  misc_feature (124)..(124): n is a, c, g, or t
  misc_feature (139)..(139): n is a, c, g, or t
  misc_feature (142)..(142): n is a, c, g, or t
  misc_feature (151)..(151): n is a, c, g, or t
  misc_feature (196)..(196): n is a, c, g, or t
  misc_feature (203)..(203): n is a, c, g, or t
  misc_feature (212)..(212): n is a, c, g, or t
  misc_feature (218)..(218): n is a, c, g, or t
  misc_feature (291)..(291): n is a, c, g, or t
  misc_feature (301)..(301): n is a, c, g, or t
  misc_feature (303)..(303): n is a, c, g, or t
  misc_feature (323)..(323): n is a, c, g, or t
  misc_feature (343)..(343): n is a, c, g, or t
  misc_feature (372)..(372): n is a, c, g, or t
  misc_feature (374)..(374): n is a, c, g, or t
  misc_feature (381)..(381): n is a, c, g, or t
  misc_feature (415)..(415): n is a, c, g, or t
  misc_feature (433)..(433): n is a, c, g, or t
  misc_feature (441)..(441): n is a, c, g, or t
atgggtacctntaactgctccaggacagcggggaggtacgagaggaccttcttctccctgngggngaccttggcaaggngattgggcanaagtacnactgtggngnagagatcctgatcacggngctttctgccataanagnggaggcggntgttgcaatcaaggccatggcaaaattactggctcccaggatggnggtggtngcagcagtnatcctntgaacctggagaggccccctccccgagcctgtccttgctttggcccggtcctaagctggactcctcctacacnattttttttncntttttttttggttttccccnccccctcaatttgtcggggngcccctgccctttaccttggtcccttggncnggggggngggaaggtgtggccttggtgaagctgccctcctnttctcccctcacactacngcctggtnggggtacaaggggttgggtgctgcttgtggttaagtctttttcgcccaccccgccattcaatttggaatcagaaagcggtggattctggcaaatggtccttgtgccctccccactcatccctggtctggtcccctgttgcccatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaaaaaaagaaa

SEQ ID NO: 592337 - DNA, 1193 bp, Homo sapiens
cctcttgttgtgctcatgattgtgtttttgcatacgacccgtcattgtgctttgtgtatcgctgctagttgctcgctctctgcccaatatgctgctttgggtttggatcactcctggtggtggcttatattgtgttgtttctctctgtcacttcacattttgtgtctcctccctatcctcaaggggtagtgtctcctccttctgtttgtctctcccctgtgtgggtccactctacgatttctcctctcacagctctcgcggggaggtgtccgagaggtggcccccttgtttctctctgcctgtgggggtgagaccctcgtgtcccactaggaggttgtgagcacaacattgttctggtcccttttggggatcaggttctctgtgtgtcgcgggtccttgtgttgccccttgtccagaaggggggccacaccgtgtggccagtcaaggggccctggtccacattatcttgggcttctccaccaggggtgtcgcctgttgcttgggcgcaccccgtgtgttccttcttgtgaccttcccggatgggcccccctttccccgagccttggcctgggcttttgggcccgcgtgccttatatctgggtcttcctccgtagcccagtgttgattggagcgcttgttaattttgtgtttttccccacgcccccctcccattctcttcgcgggagccccctgccctttctacgcttgcgtctcccttggccccagagctcggttcgaaactttggccctttgtgaaacttgctcctcctctttttccccctctcccactgccagcccctggtgggggaaaaaggggtgggttctgcttttggtttattttttttttttttttttttaaattccatctggaatcagaaagcggtggattctggcaaatggtccttgtgccctccccactcatccctggtctggtcccctgttgcccatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaaaaaaagaaa

SEQ ID NO: 592338 - DNA, 98 bp, Homo sapiens
ggggaatgtattacatgaggctgcaaacgtcatgccacccttgaatgatactccccagtgctccccttcttgctaaatgaaccatgttaccccatgtg

SEQ ID NO: 592339 - DNA, 839 bp, Homo sapiens
  misc_feature (11)..(11): n is a, c, g, or t
  misc_feature (61)..(61): n is a, c, g, or t
  misc_feature (65)..(65): n is a, c, g, or t
  misc_feature (79)..(79): n is a, c, g, or t
  misc_feature (89)..(89): n is a, c, g, or t
  misc_feature (96)..(96): n is a, c, g, or t
  misc_feature (104)..(104): n is a, c, g, or t
  misc_feature (106)..(106): n is a, c, g, or t
  misc_feature (124)..(124): n is a, c, g, or t
  misc_feature (139)..(139): n is a, c, g, or t
  misc_feature (142)..(142): n is a, c, g, or t
  misc_feature (151)..(151): n is a, c, g, or t
  misc_feature (196)..(196): n is a, c, g, or t
  misc_feature (203)..(203): n is a, c, g, or t
  misc_feature (212)..(212): n is a, c, g, or t
  misc_feature (218)..(218): n is a, c, g, or t
  misc_feature (291)..(291): n is a, c, g, or t
  misc_feature (301)..(301): n is a, c, g, or t
  misc_feature (303)..(303): n is a, c, g, or t
  misc_feature (323)..(323): n is a, c, g, or t
  misc_feature (343)..(343): n is a, c, g, or t
  misc_feature (372)..(372): n is a, c, g, or t
  misc_feature (374)..(374): n is a, c, g, or t
  misc_feature (381)..(381): n is a, c, g, or t
  misc_feature (415)..(415): n is a, c, g, or t
  misc_feature (433)..(433): n is a, c, g, or t
  misc_feature (441)..(441): n is a, c, g, or t
  misc_feature (449)..(449): n is a, c, g, or t
  misc_feature (460)..(461): n is a, c, g, or t
  misc_feature (463)..(463): n is a, c, g, or t
  misc_feature (469)..(470): n is a, c, g, or t
atgggtacctntaactgctccaggacagcggggaggtacgagaggaccttcttctccctgngggngaccttggcaaggngattgggcanaagtacnactgtggngnagagatcctgatcacggngctttctgccataanagnggaggcggntgttgcaatcaaggccatggcaaaattactggctcccaggatggnggtggtngcagcagtnatcctntgaacctggagaggccccctccccgagcctgtccttgctttggcccggtcctaagctggactcctcctacacnattttttttncntttttttttggttttccccnccccctcaatttgtcggggngcccctgccctttaccttggtcccttggncnggggggngggaaggtgtggccttggtgaagctgccctcctnttctcccctcacactacngcctggtngggggggngggggtgggtnntntttttnntttttttttttttttttttttttttttttttttaaattccatctggaatcagaaagcggtggattctggcaaatggtccttgtgccctccccactcatccctggtctggtcccctgttgcccatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaaaaaaagaaa

SEQ ID NO: 592340 - DNA, 135 bp, Homo sapiens
ctgcgtgagctgcgctgccgggaagtgcctccgcaaaggccgtggccgcgtgctgtcgcgcagcccgaagtaaggcgtgagcccagcgaccatttggcgctgaagccgccgtggctggcagccagataggcctcg

SEQ ID NO: 592341 - DNA, 170 bp, Homo sapiens
  misc_feature (94)..(94): n is a, c, g, or t
  misc_feature (121)..(121): n is a, c, g, or t
cagctatatcaatctaatatttattctaaagggcaaaatgcttccacaaaattattatgtaaggcaaaaggcgttcctccttggctattaaaanaaagcacgagcccgaaaaccaaaaaanatccagagacaaccggcacattaatagcacaataatatattcatgttaa

SEQ ID NO: 592342 - DNA, 564 bp, Homo sapiens
cccccccccggggacatatttaaaaaggggttttttttggtttcccccccccccccattttttgggggggcccttgccctttcccaagcccccttggccagaaccaaggaaaccgttacccttggtgaaacggccccctttttttccccccccctaaaaaccctgttggggaaaaaggggggggggccccctttggggtaaaccctccttttttttttttttttttttaaattccatctggaatcagaaagcggtggattctggcaaatggtccttgtgccctccccactcatccctggtctggtcccctgttgcccatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaaaaaaagaaa

SEQ ID NO: 592343 - DNA, 111 bp, Homo sapiens
gctcgactgctgcatgtcgttgcacttggtggacttgtaaatctcgggatggaactgatgctcggtgcgggtagtagagcagtactggcagtgcgtctccgtagctcacac

SEQ ID NO: 592344 - DNA, 417 bp, Homo sapiens
gcatgcctgcagactcgtagagggagcacgacaccactgcacccactggtattaagctggcgggaatcatgccagcgatccaccagagtcagctgaaactggcagctcagggcaggtggaccagccagcaagacccagaccatccaactcagctgatcctgagatgagaccaagctgctgctgaggacgacagccctgctctggtcactctggaggctgaccagtctatgcacagctgaagctggaggggacgacaagcccagctctagtcacacaccggacgctgactagcctatgcacagctgaagctggaggggacaggccctgctctagtcacacaccagaagctgactagtctacgcacagatgaagcttgaggactgatcaagcaagtaaatgaggctagaaatcttaaga

SEQ ID NO: 592345 - DNA, 2240 bp, Homo sapiens
ggtgttagctatacgatgcgacacatcgaccatagcgagtggaagaggtaggtatggtagtacgcgctaccgtcctttgttggttcggagaagcatagtaagtgagtggactcgttctcgccaatcttagtgtacgtggtggcggacgctacgaagtgaggagggagcatcagtcattccatggcgaaggaagataatagtcaggttggttgaccatgatgaaccactgtgttagaggagtgggggtgcgatacagatggggtggcaccacagcacatagttgtgtgaggtgttcgtgtggccggctacaagcgggagtaaggaagtagagggtgtgtcgtcagccacctccgttgtggttctgctgcctaacgtggggggacgacgagtgagggggtggttggtgggtgcggcccggcctgacgtcgcgtgtgttttggcggttcacgctatgttgtgggggctcggggtgatggggtggggtgcctccctcgcgtggtcgtcgtggctgggccgtgcgcctgactttgttgtggttgggtgcgtccacgcggacggttgttggtgcccgcgccgctggggtgtgggggtggcagttgtggtggggggtggctgccgcgcgcgtggtgtggtgtgtggatggtgtacgtggtgtgtttgggtggagtcggcgcggggcggtggtgggaggagggtgatgttggatagggtgtgtgggagagtcggcgtgctgcgccgcgagggaggataggggcgggcgttggttgtcgtgcggagtggcagcatccacaacgtatgtgtggtcgtcgtggtgggaggtagtattcctgcggcagcagggtgttagtttgtcttgtcgtcgtcgctcggcgcggtggtcatcgtggggtgctgcgtggggggtgttcgttgttcgcatcatgtgtggggggtgcgactcaccctctgcgtgtgtggtgttgtcgtctcttcgcgggcgcgccgcagcgcagttcgttgtgggtggggcgtcggcagcgggggacgggcgtgtgcggctgcaggaggttcgtcagtgtgggactacacgcaacagacacaacgggtctcgtcgcggcgcgagctcggcacaacaacatatatgatctgtgtttgatgtacagcgagggggtacagcgcgaacagcaatggtagtgctgactgcgacgactaccacaagttatatgtcgttgttgtggtagaaggaggtatagtcgtagtgttggtctacttgtggtagtaaaacaaacatggtagttgtgttgtggttgtggtatgtatacgtcgaggtagtgtagggacatcaatcggctgatgtagaagatgagtagaggttgggttgtgccgacaccagtctgtgtgagtgagtgcgcggccgtcggcgttggttttgtgggttcgccgcgactgatgctgttgtaggtagagcgtactacctacgtcttgtgtggtccgccggccacgcgacgcgtctcccctcccgccgctgcggctgtagttgtaccagctgcgcctcactgcgcgtcacggcttcgtctgcggtcgtggggggtagacgttcgtgtcgtcgtagtagagtggcgcggcggtgttgtccaccgcattttgtagtagtagtggtgtggacatcacaaccactactcttgtgtggaggaggtacgacagtcgacatcaacatcaagtgtggtttagtcttctgctcacgcaccagccgtgggacgacgacaacagcagaatatagtctacacagcggcgcgtaggagtagtgggcggtggagagttttgtgttgtgaagaacacaatgatggtggtctctctctgtgattgtctcacgacacacgccgcgctagagcgcacatagatagtcgtgttgtgtgatgaagcacacacaccagctgtgtgtgtgagagataaatagacacacaacaagagagagaagagagatgatatcaaactaatggtgtgagggtggggctgtgagatatgtatgtgtgcacggagggatgagggtgcgacacaccatactcccactcctcacgcacggggaagcaacaacacagcacgtacgcgcggtttctataagagagagagagcacccacccaccttcaccacgcacacaggtgtgggtgtgtgatggtgggcaaaacgggtgatatatgataaagtgtgtctgttgtgtgtctcaatatataataaataaatagataataaataataataa

SEQ ID NO: 592346 - DNA, 241 bp, Homo sapiens
aacatgtattgagacacagtctagtgtaacactgtttcaacagtcaggagctactgtccttcttattctaatgagacatagctctactgttccctgctttcaatagctgagagttagcgtccttcttattctaatgagacataatctactgttccctgctttcaatagctgagcgttaccgtccttcttattctaatgagacacagtctactgttccatgctttcaagaagcaggaactgg

SEQ ID NO: 592347 - DNA, 872 bp, Homo sapiens
tagctgacaacaagatacgtacaagaaccggacacgaacactaatagtgatgggaattatgcagctatacacccttgtgatggatcttgcagtatgcaaacatttcgggagctctttggcacattattaattccgccggttatgtttcagagttgctgacaagacgtaaggtccaacaacggcaccggttgtgcccgccccccggatttttttgcctacgtggccgtcagttttaacaaggaagtctcccgcaacactgggcttgcaagcgactgcaacaattacggctggaaaccccgaggaatccgcaggggctcggcggtcttgggaaaaacccccgtgggcggtcatgcaaaaggaccccccggcgggatgccggacgcgtcccccgccccccagggtcaagagcccgcctgcgaaaaacagctcccaaaaaccggcggggccacatagggggtatcccgagccccccgcctggaaacgtcggggggatagcccgtcactggcagccacacacgggctccgcctgaacttcgtagagcgtgtgatcaacccccggcccccctagagtaaagcgccattacatgcttcgtttgggccttagaccgccacccaactcatcaggacaccgtgcgtgtccgccgtacgtacttcgcaatcggagcgcagagtgcggtcaccccagcgtcgtcccgaggcaacgcccggcagggggatgtctctagacctcaaacacgcgagtatgctgagcagtttctaggacaaaacaagcatctggaacggggctcccgagttcaatgaagtaagtcatcgggccccatgacacatccgttcaggatatccccaaagcttgcatctttggcaacataaca

SEQ ID NO: 592348 - DNA, 421 bp, Homo sapiens
ctggtacagtgggccgaattcattttgttttcctgcctcccgctggtgatctgcctgatcttctccatcatggggaaatctattgttcctgtaaagacagaggatatgcggggtccagcagataagcacattcctcccatccagggggacatgatctaactagagaccaagaaagcaaaactttgatgactccctagattttgtcctgaccccaattcctggccctgtcttgaagcatttttttttttttactggattaaacaaaagagaaagcagcatatcaaagctgatttcctccccctttttccaatgacaaaagttccagggctggttttccagtacatttttaaacaaggccccaaaaactttatgtttgcccgtccatcagtgaactcattaaaacttgtacagtgcccctgga

SEQ ID NO: 592349 - DNA, 187 bp, Homo sapiens
acaaaaacacaaagcaggcagtgtggtgtagactgacagtaccagataaaaactctaagaacctatgaggcgccagggcagtgcgggttgcttcacccatatggtctccttgggtgtactgcgggtgcttatgaagcagtatccctacggacactgaccctagctaaggaggggggataccgacgct

SEQ ID NO: 592350 - DNA, 774 bp, Homo sapiens
ggagcccctgtatgcaggacaggagtcacatgccctacacagatgctgtggtgcacgagatccagagatacattgacctcctccccaccaaactgcccatgcatgctgatcctgtgagtgttaaattctaataaactatcctcatccccaagggtcacgatcaataataatcatccctgacttctgtgtctgtcacaaatgacaaatgaattccccaacccagagatgtttgaccctggccactttctggatcagagtggcgattttatagaacagtgactacttcatgcctttctcagcaggaaaacggatattttctctcgacattgtctaatccacatcttcgccattccctcaagatccaatgaacattcgaacctccattaatagagacgtttcttgtggtcacttcctaaatgatatctgatattctccatactcttgtatcacttgtattgaccacacacatatgctaatacctatctactgctgagttgtctagtatgttatcactagaaaataaaggaaaaatgattaataaatgacaattcagagccatttattctcttgaagcatctagattagcatgattattatttacatgggtcagttcttagatttctttctctcgcagtaagatgacagtactgagatgcacagaaaatagcaatgtggagaggctgtagtggcctcgatagtgttagcataacaagggagaaaggcagagggtaggaaagctgttgaggtaaatgcgaactagagtttggaggctga

SEQ ID NO: 592351 - DNA, 238 bp, Homo sapiens
tgatggcatttagacccattcgagtcccttcctttcaagtccattcgattactgtccattccattccactcctttcctttccattgcattccattccattcgactgtattccattcgagtcaattccattcaagtccattcctttctagtcatttaaattcgagtacattccaatcctttccattccattttgttccattccattggagtccattccatgctagtctaaatgcaatca

SEQ ID NO: 592352 - DNA, 791 bp, Homo sapiens
ggtgggggatgtgggaaaagatggcggtgccgcacaatcccggggttgatccgggtcctgtcaaatgtcacgttctgaccattactgcaatagccacatctgtgtgatcacggagcacaacctgtcgccagcattcagtcatgacactcatgcctcatgggaaaggtggacgtacctcagatcagtggggattgttggaccactgtgtcctgcgagcacacagggacttccctggggcgatcatgttggtcaagcaaactatgggacagcagtggggtcacaagagtaatcataccctatcggagtagataaaactatgacatcaatgcaacctaccgataccactgagcgtgaacctcgggacagactttcacgaaacatgggaaaaatgggggaaccgccacaatgacgcagtcgacacgatgtcgtaaatcccgcaccgagacctaaggtgaacaagcgacacacgacaagtggcagggaacaaattcgaagaacatacactcagagaaccgcaagtcaacgtgggtgcaacaaactccaacatgaagcagcctatgtggccatttgtgtcgcaagcgggaatggtgtagtacggcgttgcacaacgcactttcaccaccaatggacaacatggggctttcaacaacgctgagtcaccgaaataggaacaagacctggtgacactttgcaaagacaaacgtccattactccatggtaattcagcccacttccttggaaatggcccaactctacttgtacgccaagctttcagttgacttaggcacatc

SEQ ID NO: 592353 - DNA, 625 bp, Homo sapiens
atttggcagtaggaatttgattttcttccatctattttaaatgatcatcttgagtacgtggcaaaaagaggttatgacctaatcacactcctctgagtccttagaggaagaacactaatctggtcagaataaattgtatcttttctatctttatatccatagcccaagagtttgctgaattgaaataaaaatgggatagaaaagtgaattcaaggagaatgtccagagccctaataccagaaggcagtctgcacagccaggtcagcattcttgaacaaatgcacttccattctcactcaaaatgccgactgcctttcttctttttctgactgacatttaaaattaaaaaccaaagttgctgggctgtgatctatggcagccttccagccctttgaaaagataaagttagacagaagtggtggtgaaatgaaaatgaagaataaggagtggtcaggatctatgaaagaattacagctagttctgatggattgatttttcctttctctcttatccagtctctggggtgctcgagagctagatctgctgaccttaacttctgaggactttgagcaagtaccatactgttcggatgattttcaaaaaagtgacatttagcattttgata

SEQ ID NO: 592354 - DNA, 237 bp, Homo sapiens
  misc_feature (78)..(78): n is a, c, g, or t
tacggggagaatgagcgagttatgataggttgactctgagtatatgggcagacatgtacatgttctctgatagatggngataaggcttctatgcaggagtcccaagctcaccatgcagtagaaggatctgccaagaattacaggcaccacggaaacgcacagtcgaagtgacactgacacctctaaaaatggaaaatgagagtcaatccaaaaatgccctgaaagaaagtagtcctg

SEQ ID NO: 592355 - DNA, 624 bp, Homo sapiens
tgttacgaacatgcaactaacaccaagctgccatatcctgaatagtgcactcttgttaacagtgtcatagtctagatgcacacagcttgtgcaggaacagcacactagaacgatttgacgtagagtctgctgctcacctttggtgacctgagcaatcccatgccttttttaaattcttatccccaaattgcagcacatgatgccagaaatagcactgaatcaagaaaatagccattgcggagctgccctcttgagtctttctgtccatcccattctattctgtactgtgacttcagttcaggaagttttgtatggtgtataaaataaaaaggaaaagagcaagtttgctcagtcaagtgatcagatcccgaatctagatacccagttctaaggccttatcacctcccctgcccaataggccaacaaccatagttcctcacattagtgattagcagacctctttgtggacgagtgaatttcacaaacagcacaatttcagaagaaatcgagggcacaggccctcacttttcttctttagacgcatcatcctgtgatgttgaaatgtcattcgcaggatgctgatgttgtgcacgtcaatcaccgggcacttgcataactcttaga

SEQ ID NO: 592356 - DNA, 268 bp, Homo sapiens
ccccggggggggggggggggggattttttccccgggccccccccaaaaaaggggggcccgggggggaaggggggggccccttttcccccccgggggggccccccccgggcaaaaaggggggcccaaaaaaaagccccccctaagccaaaaaaggggggccccaaatggggggggccccgttttttttttttgggggggccgaaaaatttaaatttttgggccccccccaaagggggggggaaaaaaaacccccccgggtcccctttta

SEQ ID NO: 592357 - DNA, 652 bp, Homo sapiens
  misc_feature (12)..(12): n is a, c, g, or t
  misc_feature (91)..(91): n is a, c, g, or t
  misc_feature (94)..(94): n is a, c, g, or t
  misc_feature (128)..(132): n is a, c, g, or t
  misc_feature (142)..(142): n is a, c, g, or t
  misc_feature (146)..(146): n is a, c, g, or t
  misc_feature (148)..(148): n is a, c, g, or t
  misc_feature (170)..(170): n is a, c, g, or t
  misc_feature (180)..(181): n is a, c, g, or t
  misc_feature (223)..(223): n is a, c, g, or t
  misc_feature (246)..(246): n is a, c, g, or t
  misc_feature (287)..(287): n is a, c, g, or t
  misc_feature (289)..(289): n is a, c, g, or t
  misc_feature (293)..(293): n is a, c, g, or t
  misc_feature (297)..(298): n is a, c, g, or t
  misc_feature (301)..(302): n is a, c, g, or t
  misc_feature (316)..(316): n is a, c, g, or t
  misc_feature (338)..(338): n is a, c, g, or t
  misc_feature (351)..(351): n is a, c, g, or t
  misc_feature (375)..(375): n is a, c, g, or t
  misc_feature (378)..(378): n is a, c, g, or t
  misc_feature (389)..(389): n is a, c, g, or t
  misc_feature (394)..(394): n is a, c, g, or t
  misc_feature (405)..(405): n is a, c, g, or t
  misc_feature (410)..(410): n is a, c, g, or t
  misc_feature (423)..(423): n is a, c, g, or t
  misc_feature (637)..(637): n is a, c, g, or t
tcagcgggcgcnctcaccgcaccaggtggaaggtgagccagttcatgagcataggctgcgccgccgccaccgccatggtcaggtacatgcncantggttccgggccccacgcaccgggaccccctcannnnntgcgtctgcnaagntnttcagccgcagcgtccggttcntgaacacaannttggccacgcagcaccagcccagcaccaggtagtagccaatnttcccgaagagcaggcccatgtngtccccgccaattatcccgacattttttttgcccaagttgntnaccnggtnnttnntggtgtggtcggtnttgttagttaccagttttttgntgttttggttttncagctcctccaggttcagccaggncanttctgatctcncttgntgccccaggangtctngggagatcctatnctgggtccccagcgcaagatcagccaccaaaacgtaggttatgaaagccattgtctggtaatgtagaggtccggggcattgacgtcaaagcggggggccaccgggggtgtcctgttggtactgcacttcccagtcctggtgtaggtaggggaagaacagcaggcccagctttctgcccaacatacatggtgtccacagcaaagtaatacttgancttggtgatggggat

SEQ ID NO: 592358 - DNA, 710 bp, Homo sapiens
aagctggtacgggcgggatgtaaggatgcaacagaggaagacctgtctcataaaaaaaaaaaaaaaaagaaataagaaaaagaaagcggatacacccccgggtattaagataattgagatcattcctgtaaacacagcggagtagcagcatctagtataataggcacgcaataaatacgagctattatggctgaggcatggcatatgggggctcttattactccatcctctggtgtagcctaagtttggcagctgtgtagggaagaccgcctcatactaatgaagcacactgggctggggatcatttcagacctgcagatctctttggcatgaaatgcaagggggccggggctccctcttctgcatttgtgcacctgcattttaagaacataatgaatgatgggcattggtctctttgcattctcatctaggcttgggcccatcatcctaacctgtgggctacatttggaatttcgggattgggtaatggaatgcttcagatctccctccaagcttggcttcctataaattggatacccatgactcataggtcatcatctgagtcatgataaaaatacggaataaggctgggcacggtggctaacgcctgtggatcccagcacttgggaaggccaaggcaggtgatcacttgaggtcaaggagtggagaacagccgggccaacatggtcgaaaccccatactctacccaa

SEQ ID NO: 592359 - DNA, 123 bp, Homo sapiens
ggcggtcccactctagtcaggagatactagcagcccccttcctccctggagcattttctatactcagttcctcaaataccactctcttcatcttcctcactactcacctgacccgccctctga

SEQ ID NO: 592360 - DNA, 526 bp, Homo sapiens
ggggggtgtttgtggagggtgttttgctccgtggtggtcggtgtgttttgtcgggggtatgtgttgtgggtttttgtgggcgatgtgggcgcgcgggtgtctcggttggcttcgtgggagagggtcaaggggcatgaggcgctgtggggggtttttatgggagcttgtcgcggggccggctttcgggttggttgctggttatgtcgtccgtggagggggggggggtggcccccccctctcttgtgtaggattttctcaggggggggggcgggagctcctttgggcttgggggtgggcggtgggggttccccaaaaggtccgggttgcgggtttgggcttagggggggcccgtgggaaaaataggggcccccccgggggggtttaggggttttttccctccccccccccccggggggatttaatgtgcgggggtcccgggggggggggtttttctcccccccccgggggttaggccctttttccggggccccattaccccccctttaattttttttttggttttcca

SEQ ID NO: 592361 - DNA, 953 bp, Homo sapiens
ggcaacgcggagccgggaagtcgtcgctactctggtggaactcagagtggttctggaggcggcggacgcggaggtccctcagaggatccagcgaggggcgccaacaagaggcgaagaggtggcaccagggcggcggcaggaagaggagcgggagcaggagcgcggagcggagcgtcccgacccgccgtgcgtactttctggagggaaggggcgggggaatcggcccctgagggaagcgcccggtggcgagggggttagccaagttccggctgcggcgccactccctcggttccacggcagaggagagtgttttttttccacgaggcttccgccggctcgtgccgtccgggggcggagcatccctgcagcgcttcgttcggggcggcgtgccgtcccagctcagctccggggaaacgcgagccgcgatgcctggggggtgctcccggggccccgccgccggggacgggcgtctgcggtggcgcgactagcgctggtactcctgggctgggtctcctcgtcttctcccacctcctcggtatcctccttctcctcctcgggccgttctggcttctgccgttgtccgcccagccccccgttgccggaccagtgccccggctgtggagtgctccgaggcaggcgcacagccagtgcgtcaccgcattctgacgcgaggtgccaggactgccgcctaggtgggcacctcttcttacggcaccaagtggcgtgctcctggcggggctttgccgcggccgcgtggggagtggcggctcaactcagaggcagcgctgagaagtgcgcgggggcttcgaggttgccagctggcagtgactgcaaccgttgggctcggcttgtttcgggcagcaggttggcccccctggtgtgttgacaatgcccacaaggcagtaggttgggcgccggcacagcgcccgggcaccccgcgcgggccccgctag

SEQ ID NO: 592362 - DNA, 374 bp, Homo sapiens
gtttacacaggaaaaaggtttaatggacttacagttccacatggctggggacgcctcacaatcacggcggaaggtagggaggagcgagtcacatcttacatggatggcagcaggcagagagagagcttatgcaggaaactcccgtttttaaaaccatcggatctcgcgacactcattcactatcacgaaaacagcacaggaaagacctgcccccataattcaatcacctcctacccagttcctcccacatgtgggaattcaaaatgagatttgggtgaggacacagccaagccacatcaatatcctaacagctgccacaatgattaacttatggccaaactttctccccatcacggcccttccgtagtcttctc

SEQ ID NO: 592363 - DNA, 905 bp, Homo sapiens
  misc_feature (293)..(293): n is a, c, g, or t
  misc_feature (306)..(306): n is a, c, g, or t
  misc_feature (332)..(333): n is a, c, g, or t
  misc_feature (356)..(356): n is a, c, g, or t
  misc_feature (406)..(406): n is a, c, g, or t
  misc_feature (408)..(408): n is a, c, g, or t
  misc_feature (412)..(412): n is a, c, g, or t
  misc_feature (444)..(444): n is a, c, g, or t
  misc_feature (475)..(475): n is a, c, g, or t
  misc_feature (490)..(490): n is a, c, g, or t
  misc_feature (509)..(510): n is a, c, g, or t
  misc_feature (530)..(532): n is a, c, g, or t
  misc_feature (601)..(601): n is a, c, g, or t
cccatcagcaaaggtagcacgcacccattgacaccatcacgacatcaccaagtatcaccaagcctggctccatcgacttctaacaaccagctctttgcacctggagcggcgactgagcctggggcaagggcagcagcggaggctcaggagccaagccctcagacgcagcatcagaagctgctcgcccagctactagtactttgaatcgcttctcagcccttcaacaagcggtacccaccagaaagcacagataatagacgtgtggtgcagaggagtagctcgagccgagaacngagggcgagaaangctggagaccgaggagaccgccatanngcggagtgaacggggaggggacngtggggaccggcgttgatcggtgcgcggacacctgctaccaagcggagcntncagnaaggaacgtggaggagcggagtagagaacggncctcccagcctgaggggctgcgcaaggcagntagcctcacggaggnatcgggaccggggcgggcnngccgtgaagcgagaagctgnnnctaccccagtgagccccctgaaggcggctcatctctgaggaggacgctgagacgaagaagatccaaggnctgggtccattggagagcacgtgatctcctatctcggtgtggaacatgtaacaccagtgtaagatccaaggaggcgctggcaaggaagactgggacgtcaaacgtgcctcggtctctttcaatcctccgataacgagacatgagccgctcggaagactcctacaagaacatgcgccgcgcggccgtagaccagtggcgacgggggaagccggtgatgagcgccaagacctggttgccacgggaaggtgcatcagctggcgtgggggcgagcatggcctaatacggcccccaggcaatcacccaa

SEQ ID NO: 592364 - DNA, 302 bp, Homo sapiens
gaaagatcacaggagccacatgagtaatttggaattttctagtagccacatttttagaaaagttaaaagaaatgtgtgaaatacattttcacaccatattttattcaactcaatatatccaaagtattagcatttcaacatatcatcaatgtaaaattattgaggcatatttctttgttactgttctaaggtctccatatcctgtgtgtattttacacttacagcacatctcaattcagcctagctgtatttcaagtacttcatggctacttttcttaaaacaactaattctcaaaaaaaaa

SEQ ID NO: 592365 - DNA, 306 bp, Homo sapiens
gtattaatataatggaagtaaacgacatatggtctcgttcggtctacacaggggggagtgcagtggtgcgagtctcgatatcactgcaagcgtccacctcctagacttaagctattctcctgcctaagcctcccaggtagctgggattacaggcatgtgccagcatgcctgactaattctgtattttcagtagagatggggttcaccatgttggacaggctgttcccgaactcctgaccacagatgatccactcacctcagacgatccatccactccctcccaaagtgttgggacttacagacgtg

SEQ ID NO: 592366 - DNA, 245 bp, Homo sapiens
agctcggttcccgaaagcacacccatcctgggagcctacagagccagtgcttctgaaacagtgattataatagggagggttgcgcagggccatggatacgtggcgatacgatttacccggtgcgagggattatcccgactgaacggtcgttgggcaatgtctatgtgaacccgtcaggcacataactttcaatgcaccaacgatttcgccgttatcagtcagaaataatacgcaacacctgaacc

SEQ ID NO: 592367 - DNA, 341 bp, Homo sapiens
ggacccctatcgtctgccaaggtgaaagatgctaccctgaaaatcctccttgaagggtcccttacattactgcctgaaagggggctgcccagatattttaaatctgcttgtgtgatttcacacatgtcctgcaatccacactaattacactgaggtttcagtattggtttcaatagagaagtgatttgtggggaagatgctagggaaagtctatagcaaataatagaaaggaaaattaataaatcacagctcttttcacataaagaaagaaaattttttgtaaggtgaactatttaaaacacaattagctcattcatgtcttggcagcagcatcatgggta

SEQ ID NO: 592368 - DNA, 390 bp, Homo sapiens
acttagtccctgcttagactgcatcggtttggctgatgctgtagggatcatatggatgtgctttttatgcgtgttgaatttcttcgaaaatttctttataactctagagcccaggtgccgtgtggagtctttgttctcccactttctattttcgctgtccttcagcccgttacttaatttctgggcctcaatttcctcatctgcaaatttctgtgcccatttcttgaaatgggcacagaaattgtcgaaaaagaagactttattaacagagatttcttgcatcttctctgccttgtacttttcaacttgaatatgttggcatttctctacccttgttttgttggctataatcattcagtattcatgtcccaatttctgtgcccgtttcat

SEQ ID NO: 592369 - DNA, 318 bp, Homo sapiens
aaattccgtctcttgggaggccaacgtctggctggatcacttgagggccaggagtttgagaccagcctggtttaacatggcggaaaccccttctctacttaaacagaatatcaaaaattagctgggcatggtggcacacatctgtggtcccagcttctcaggaggctgaggcacgaaaatcacttgaacccgagaggtggaggctgcagtgagccgggatcacgccactgtactcccgcctgggcgacagacagagcgagaccctgtcttaaaaaacgaaagaaaaaacaaatggaatttgtgggcatttttaggcta

SEQ ID NO: 592370 - DNA, 217 bp, Homo sapiens
cgctcggacaccacccttctgggctccttttatctcccgctctgaaatcccatcgctgacgtggctgggacctcctcctcagctgcttctccctgtttccccgccgcgagtctggcgcctggcgtgtgtaaggcgctcagtagacttttgtggagcgaagaaacgatcgcagaggtgatgagcacgagcgcagttaggaggctattggtccgagcgg

SEQ ID NO: 592371 - DNA, 202 bp, Homo sapiens
cacgaggtcgagctcgagcctcccgccgttctcgtgcagcgcgcgcacgcccacacggtcggggcgctcgacgcgatgcttgacctcggggaccgacagggagccctcttcccagaccttgcggttgccacaggcccagacgatctcgggattgatgagcacgcgcagcccgtcgcgggtctccgacatgtcgatcaccatg

SEQ ID NO: 592372 - DNA, 235 bp, Homo sapiens
tgtcttccgaaggagagtttattcagaggactccactgtatttctgactttcttcggatactgaactcaggttcagagaattggttgttagtggtatagcagtgaccacttgagtatgcacccctgaagttccaactctcctcgtcctgggttagactaggacggtctacgtagtatcacactgggtaccgttcccgtcattattggtggttttagaggacgtaaacgttaccca

SEQ ID NO: 592373 - DNA, 356 bp, Homo sapiens
  misc_feature (169)..(169): n is a, c, g, or t
ctctgcttcaacacaacacccttctctcccattttggggggtggggggtggcattccctcaacgccccctttggcaagctcatttcctggtatgcaacgaattttggctccagcaacagggtggtggccctcatggcccacatggcctccaaggagtaagacccctggncccccagccccagcaagagcccaaaaggaaaaaaaagaccctctctgttggggagtccctgccacactcagtccccccccccaatgaatttcccctcctcccagtttccatgtagacccctttaaaaggggaggggcctagggaaccgccccttgtcatgttccatcaataaagtaccctgtgctca

SEQ ID NO: 592374 - DNA, 144 bp, Homo sapiens
aggaccagacttttatttgctatcatacttatttgccatctttttatgctaattatggagggttacttttaacattagtattataagggatctaagtcttatactacgaaatattcattacctttatgtttacgatagtctcta

SEQ ID NO: 592375 - DNA, 311 bp, Homo sapiens
atggacacatcaatatacttccgtgactcaaaggacactattgtctgggtacagtggctcatgcctatatcctagcactttgggaggcccaggcgggcagatcacaaggtcaggagttcgagaccagcctgcccaacatggtgaaaccccatctctactaaaaaaaaatacaaagattagctgggcatggtggtgtgtgcctgtaatcccagctactcgggaggctgaggaagaagaattgcttgaacctgggaggtggaggttgcagtggtgagccaagattgtgtgactgcactccagcctgggcgaca

SEQ ID NO: 592376 - DNA, 232 bp, Homo sapiens
cagggtgcgtgtctgttgtaatgtaggagagcacccgatgccatctgtggcatcatgagccacacacaacagggctgcatggctgcatcaccgcgagccacgtccgcagtgatcctccaatcttcgagcactgttggatccgcggccacggcagccctggtgtacacatggttgtcaggttccttggaggctgagggcagccagagacagagtgcgacaatgaccagcacca

SEQ ID NO: 592377 - DNA, 237 bp, Homo sapiens
atgtcgcagaataaggcatcaagacaaatatgtccagaggattaccactttcccactgatgccaatgtggtgtaaacatggtatatcgatgaattaatcttgtcatgggcatttggagagtccaggagagaagactcacctctggcgcttgagtgttaaactaaagagaggtttggtagagtattgattggtaatattatatccttctccttacactcaatttcttgaccctattcg

SEQ ID NO: 592378 - DNA, 271 bp, Homo sapiens
  misc_feature (250)..(250): n is a, c, g, or t
aaacttgtgcaaataactttattaccataaacatatgaatattcatgaatagattcccaattctggggcactcagagagcaaaagcaaatgtttcaatttttgtttacaaaagtatactttaccaattgctgaagaaaaaaattcataaatctgggagggataaaacattcaaaaaatcaggcacattttccaattaaaaaattatggaaaacattatccttttgttatttaggtcccatggaatggggngttcttttccttctttggtct

SEQ ID NO: 592379 - DNA, 288 bp, Homo sapiens
  misc_feature (8)..(8): n is a, c, g, or t
  misc_feature (26)..(26): n is a, c, g, or t
gtttcatntccctgccatttgccatnctccagtgctaacggaaagaagtgaccagccatcctgtgccaagccatcttcttggccagtttacctgagatcaggtttatgaaggaacctgtcaagcaagctaaagtgtctctgaacaagcaagttgaactgaacataattattgatggagaagaaacaagcaagcataaaaggactgcaggaggtgctgtgggttggaccgtgggctgtggagggtttgtgtatgatgagaagccctgtacagtcttctcaagaaatacc

SEQ ID NO: 592380 - DNA, 254 bp, Homo sapiens
aaaaatccccccccttggggggggggtttggccctttttcccccgcccggggccctttttccctaaaattttttttgggggggattcccctttttttttttggtttagaaattgcccccctttttccccccccctgggcccccccaaccatttacccgcccctaataggtttgtccccccccttttttttcttcctccccgccctaagtttggcctttggggggctcccaaaagggtttggttggccccaatta

SEQ ID NO: 592381 - DNA, 463 bp, Homo sapiens
ggttgtaaaggaatttgaggatttggaacccggccccagaacccctggattttgggggttaaggaccagttttttaaattgggaaggtaggattttggcaaaaattgaggggtcaggttggccaccttagggttaatggcctaataccatggcctttcttttgccaggggttaaccagttttggaggtaaaggattagcaggccttcaattggataaattttttagaatttaatcctttaaggcgctgaatccgttttggtttttccatttaattttccagtggttctaaggtattggtacctggattttggataatcctttcttccggaatcttggttggctctttgggtcttggaatttgtggaatcttgtgggtttctcggtacacacggcctgtgacatgtggtgatagggcacagtttttatgtgtgagatgcgttttgtgagggggtttaccctcgc

SEQ ID NO: 592382 - DNA, 298 bp, Homo sapiens
atcgcggactatgaaagcggacgggccatacccaataaccaggtgtttggcaaaattgagcgggccattggcctcaagctccggggaaaggacattggaaagcccatcgaaaaggggcctagggggaaatgaacacaaagccttgaaatcagtgggctccagctgattttgttccgccggttccccttggccgccagttccgttttcctcacgggccgaacggaacaaggggtccagcttgggggggaccctccccagcccattcctgttgtcaaacaaacaaaaccttgcaaaggga

SEQ ID NO: 592383 - DNA, 414 bp, Homo sapiens
acatcagcagcagctcaaaaggttctccttcttcatcaagaaaaagtggaaccagctgtccctccagcaaaaacagcagccctaatagctgcccacggactttggcgaggagcaaagggaggctccggctgtcccagattggcagcataaactgtcaagtagtaagaagaacttggatgccagcgagaatggggctgggcagatctgcgagctgcctgatgccttgagctgagggccatatgcggtggtgcagccatccagagctgctcacttctgaggaccacgaggtagcttcggccaatgccctccttcatgagcatgaaccatatggcaatgcctaccgcaacgttcagactgcgcaccacagtgcacgaacaccgccctcacgtcctcccagcccactcacttcactcc

SEQ ID NO: 592384 - DNA, 126 bp, Homo sapiens
ggtcagagcttagtgattccccctgaaattggcaaattggatttaacccaattaatagtgtgtgtgtggccgcagtcatgtccctcacatcctttgaacaaatgaaaattacttttaattccttca

SEQ ID NO: 592385 - DNA, 527 bp, Homo sapiens
acgaggacattacattacgataacggacagtgctgggattacaggccttaaccagcatgcctggactattgccattttcagtgttgtgtccattgactgtttcctgttgtaccaaaaagtcatcaggagatacatatatggatagtgaaatcctctagtgacatggaagtttctgtgtcatgcatatcgagaaattgtgatgcctggatgcctgaggttccttggatgtgacgtactatgcatttgcaagtatttgctccctgtatagatccaggatctatagataaactattgtcgcattcagaactgtgtttagaatacaataatacgttgtcgtgatgtaataggactgaagcctctattactgcatgtcaaccaaaggttctctggtgtagactaaacatctaagggtcagactaccttgtggaacctggcattgttctccttctgtagcactaagttacatttgttctccgtgtcaggatctttgcagatcacacacaagaattgctggtcgtccaacctgt

SEQ ID NO: 592386 - DNA, 350 bp, Homo sapiens
gatggtgatgcagccctcactaaccgtgatgggccctcagcattggcctccagaggggcgtcgtgacccgcggtgaccaggccaccttccttctctttgccttcagtgatgtcagtaaaggcatctttgccttggacatcagcagggaaggggagggcaagggagcccttgacctgggaggggaggccaccagcattggtctctggcagggcgtcgtgacccactgggacgagccctggccgcctccttccttcccgttgccttcagccacctcagcaacggcatccttgacatcagtaaagatgaaggggaaggtgatggaggcctctttagtgccacagggccatcgc

SEQ ID NO: 592387 - DNA, 267 bp, Homo sapiens
ataaaatgggggaagggccggaaggtccccctttaaggggcctttggccatttaaaaccaccaagccatttgggtccccgggaataatgttcaatattaagggccgccaccaggttaaaccccttaatccaaatcccacccataatgaggttatccaaataagccaaattttaataccttttatgccaaaaaggtaaatttaaacctggaaaaaggttctgggcctttttaaaaaaaaaaaatggggtttttttaaaaagaaaaaaa

SEQ ID NO: 592388 - DNA, 192 bp, Homo sapiens
  misc_feature (47)..(47): n is a, c, g, or t
cccactactggccatctgatctataaatgcggaggcatcatacctcnatttttttctagtgccttttatgctactaagacaattcaccactatcctgttaccttgctttactgactggatgtcaagccttgagactatgatgacgctgtctctctgtctcccgctctaaaatgtccagtccatgagggcagt

SEQ ID NO: 592389 - DNA, 116 bp, Homo sapiens
cttcggatactggacgcacgtatgggcgacatcctagtagccttttttttttatctttaggacaattatgtaattgatttatttctcccctactatgatccaaaaaggatttatag

SEQ ID NO: 592390 - DNA, 379 bp, Homo sapiens
gaccaggcatcagctggcgtccaagtaccttactgagagccccactgcttgatggcaagctctaggcttgcttgggataggtgactttgctcatgaagcagctgtactgagtagtctagtacggacacatagatcatcaggaagggcctgttgaaacgcacaaatggtccttgtattccactaaatagcagaaaggcagggtagattttgactgctgtaggagacaaatgcttctgtgccctcctacaaatacatcaagcacagccatataggaccacctggaaaactagtaggttcctggcccctgtgatccctgacaggtcagccttgcagggaaaaggcttcctacaatgcccagctggagaagtatgtcgtacag

SEQ ID NO: 592391 - DNA, 561 bp, Homo sapiens
attagctgataaaggagactgtaggaattgcatccagactgtgatttgagggggttggctgtagtgcggacgtggcgttgtgggtgtgagtgtctgtgaggagaactacaagcccgtacgcttcggctctcgatccaatccagtagacaatggtttcatctgagggacagtgaggggtcctatctcggaaagagtctggatggagagggcattctggcagaagagtacaaccaggctttcaagcaggcatcgcagtctattgccctagctcacttagtaggtaaggggaaccatagatggaggtgtcttatcgtgaaacagaggatggggtgtaagcacatagaatccgcttccatccatgatgggcatacggcccaattggcaccggtcatgcaaggcacaagctacattgtatacgccccgctacacctggatagcatcaatggtttccaatagatgtaagcatttaaagtgaaaccgcgtgtgagcgactaacaatgttgagccgggtttaattgtgccgacccacctgtttgttgcaacctgggttcctggggtatc

SEQ ID NO: 592392 - DNA, 453 bp, Homo sapiens
agaagttaaacattagaattttcttacatgaattgaattatcagaaaataatttgtattgtcaaaattccacagctgtgccaacttacagaaaaaattagtgcatttggtattaaacatttaccattatataattattgtcttgatactaaattcaggcaaaaccagatcagttacttagagaatgagatatccaaaataggatttaataattcttcaaatctttatatggatccaacactccagtctcttttctctgcttagtaaatattgctgattgttttagggggaattgaccagtgaacacttagaagcttttgttttctgattttaaaagataaaacgtattggaaaggttactgcttatcaaagtagaaagctaactgtcctctagcgccaaagtatatactgaggaattgagtgggaaatccccacccaggttttcccattggca

SEQ ID NO: 592393 - DNA, 102 bp, Homo sapiens
  misc_feature (2)..(2): n is a, c, g, or t
  misc_feature (69)..(69): n is a, c, g, or t
gnagtgcatggctggtttcggccggatgatggctcaaaaagaaaggaaaggatactttcaggcttagangttagtcttttttatgttggaaattttcacaac

SEQ ID NO: 592394 - DNA, 462 bp, Homo sapiens
atatacacacgcgagagatcacactcagcagacccacagatcacacccagcatggatcacacccgagcacacccagcacagataacatccagcacacccagcacagatcacacccagcacatgcacagatcacaaccagcacagatcacacctagcacacccacagatcacaaccagcacagatcacacctagcacacccacagatcacacccagcacacagaaatcacacccagcacacccacagaccacacccagcacagatcacacccagcacacccacaggtgcttatagacagacacactcagatgcccatgattacagaaggtcacatgcaaagttcacacaccaacctggaagatggaaagacacccatggactttgtcttaggctgggtttcctggaggcagaagctaagacgtggatttggctgcacattattggggcagtgccctcgggagt

SEQ ID NO: 592395 - DNA, 133 bp, Homo sapiens
cgtttagacagaagtttttacttcgcaggattttgctagagcgttttaccactccagacctagccccatacccccgcaattaggaggacactggcccgcaagcaggcatcacccgcgctaaatcccctagtaa

SEQ ID NO: 592396 - DNA, 438 bp, Homo sapiens
  misc_feature (4)..(4): n is a, c, g, or t
aganaactgctgtggctatcttaatatcatatgaggtggattttaaggtaaagaatattataagacatgaaaagggacctttgtagtgttaagagagttaattcatctggtagacataataatcataagatatatgtcctcaataatagagcttcaaaataaatgaagcaaaaatttacccagcactttgggaggccaaggtaggcggattcacctgaggtcaggagttcaagaccagcttagccaaaatggagaaacttgtctctactaaaaatacaaaaatcagccaggtgtggtgtcatacacctgtaatcccagctactggggaggctaaggtaggagaatcacttgaacccaggaggcggaggttgcagtgagctgagatcatgccacagcactctagcctgggcaacagagtgagactccaatctcaaaaaa

SEQ ID NO: 592397 - DNA, 418 bp, Homo sapiens
  misc_feature (352)..(352): n is a, c, g, or t
tctttcatctttttatcaccaagtcctggtgaccttggcaggtgccacccatgagtgccaatgtagcattcatctatgaagcagggaaggcccatagaaaacgaatgatctgaggccaggcgcagtggcttacacctgtaatcccagcactttgggaggccgaggcaggcagactatctaaggtcaggagttcaagaccagcctgaccaacatggagaaaccccgtctctactaataaaatacaaaaaaagctgggtgtgttggcaaatccctgtaatcccagctactcgggaggccaaagcaggagaatcactggaacccaagaggcagaggttggggtgagccagtattngccattgcactccagcctgaacaacaagagcaaaactttgtctctcaaacaaacaaaccaaaaaaa

SEQ ID NO: 592398 - DNA, 203 bp, Homo sapiens
tctcccctccccccctttacaccattccccctcggaggcgcttccccgggaggggcaaagccggtctaacaccacagaaaaacacacaccaagaacacacgcacaacaaccaataacacacaaggacagaagcaaataacaaaaaaaagagaacccaaaccaaacagcatacaaccaacatcaaagacaaacaacaaaacagg

SEQ ID NO: 592399 - DNA, 224 bp, Homo sapiens
tcaattgactcgtacccacactttccttcctcggtgcatgtccccattgtgcctgggtagctggaattcctaaagaagaaactaattgacatagctgccttcaagagcccaggtggggacaatagcttgtagcacatacacacgagtttgtatcctacaagaacgtgttttgaaaacaaattgtatgtggcagatcgcttattaaggctattttgcggggggag

SEQ ID NO: 592400 - DNA, 83 bp, Homo sapiens
ctacaagacggcacccggtactgcgcagccatcggcgcagccacacgggggagaagccctttccgtgccccgagtgcggccgc

SEQ ID NO: 592401 - DNA, 529 bp, Homo sapiens
  misc_feature (386)..(386): n is a, c, g, or t
gtagaagatggtgttttcttttcctcgcataatatatagaggagataatgttgttgttccacagcggcacacacacaatatttgctacatttgtgtgtgtgtgtttgtggtgtagcacacatgtggtgcacatcatatatatgtagtatatgtgcgctatattaaatgtaaagaaaaaatgtgtgttgtgctcacaggtgtatattgctgtgtagatatagagatgtgtctacatatatatgtgacacatctctcttatatatattgtgtctcttctctctccttctctgatatatataagaggttaagagggactggttttgtaagaaacactctttccactatttagatggattcacagaatatataggtatagagctgatatnttctggaaaataggctccagatgggtaacttcttaatatatatttatgggaccactattggaattgtaacttgcattttagccgtgcatgtttttaattgacttaactggggaactgaattcaaatatgcctcttattatcca

SEQ ID NO: 592402 - DNA, 85 bp, Homo sapiens
  misc_feature (44)..(44): n is a, c, g, or t
tcactagagagctgtgtgccattgcccaggcagagtctctgcgntacacaactctaggaggctttgctgtgcagagggcctgctt

SEQ ID NO: 592403 - DNA, 215 bp, Homo sapiens
tgactggagtaatacaagtgtggtctatacacacgagtgagaagtaatactcagcattaacaagaaaagaacttctgacgcaggctacaacgacaggattaagctggaatacgattatgcaaagtgaaataagccagtcacaacaagataaatattatatgactatcagggtattcaaattcagagacagaacgtagcatggcaggcgccagagg

SEQ ID NO: 592404 - DNA, 247 bp, Homo sapiens
atatgaaatcagctcacctcgagctcccaaagttggaattactggcgtgagccaatgtgcctggacgacgggatccttattaagagaggtacgtgtactgcaactgaatcttcaggccacgagcaataaaagtttgatatgccatacatagccaaggaactttatatattactccagaacaccaaatgttgacgccactttagaaactacttctacaacctggaaacgtgaccatcagattttacct

SEQ ID NO: 592405 - DNA, 1371 bp, Homo sapiens
  misc_feature (613)..(613): n is a, c, g, or t
  misc_feature (726)..(726): n is a, c, g, or t
  misc_feature (793)..(793): n is a, c, g, or t
  misc_feature (801)..(801): n is a, c, g, or t
  misc_feature (864)..(864): n is a, c, g, or t
  misc_feature (992)..(992): n is a, c, g, or t
  misc_feature (1021)..(1021): n is a, c, g, or t
  misc_feature (1027)..(1027): n is a, c, g, or t
  misc_feature (1037)..(1037): n is a, c, g, or t
  misc_feature (1066)..(1066): n is a, c, g, or t
  misc_feature (1094)..(1095): n is a, c, g, or t
  misc_feature (1098)..(1098): n is a, c, g, or t
  misc_feature (1115)..(1115): n is a, c, g, or t
  misc_feature (1143)..(1143): n is a, c, g, or t
  misc_feature (1145)..(1145): n is a, c, g, or t
  misc_feature (1168)..(1168): n is a, c, g, or t
  misc_feature (1175)..(1175): n is a, c, g, or t
  misc_feature (1178)..(1178): n is a, c, g, or t
  misc_feature (1199)..(1199): n is a, c, g, or t
  misc_feature (1205)..(1205): n is a, c, g, or t
  misc_feature (1208)..(1208): n is a, c, g, or t
  misc_feature (1210)..(1211): n is a, c, g, or t
  misc_feature (1216)..(1216): n is a, c, g, or t
  misc_feature (1219)..(1220): n is a, c, g, or t
aatgagatggcagctaggaagaacatgctattggcggcccagcatactgtgtcaagaattcacacgaacttctcagccaagaccggacaccccatgggaccagcaggctcgccccgagtcttggagacgaacatacagaactgcttgtctcgatttcatgccttgattacccatcgggtttggcgagccaggccatctgtgccgcggtgtctgccctgcagaactacatcaaagaagccctgattgtcatagacaaatcctacatgaaccctggagaccagagtccagctgattctaatcatagaaccctggtagaccaatggagataacacactaggagaactaagaattgtgaacgaagaagaggttaggagagtagggaaggaacaggactgctataaatccttctccaccgctacagactgggaacccctcctggcctgggggtaagagtttgttaccgtagccttactagtttaaagagccttcactggttctgcatcacccgtcccgtggacttcttagttgtttctctagcgctgagctatctcctaacttggacctattatcagaaggtgacaagtactggctctttattcattaagcttttttntttggaaccccattctttccttctctgaaagtggtgctataagttttagaatcttttaaatacattcccgtgggccaacagacccacacacttagccattgaaatgtcaaatngatgtgccctagatcaacagatcaacaataccttttttttcagtgtccaggtaatgggttggttttngtgtccgntaaatatttaccttgaaaaaaacgaaaagtgtgtatctagcttcttcagagatcaagtcctcnggtaggaggcaaaggttctatctgcttagcaacctagttaataagtggtatctgacacactctaaaccccgtgttcaaacgggggccttctggttttaggaaacttgtagaaacgaagcctgctgatngatttttttctcctttttttttttttttntttttnaacttggaanagttaactcttcaaagggggagactcttngaaatggacatgtccctttagaggtacnngangctttattggcatattnattccagatgtttcgagtaaacttgcanangggtaggcacgaagcaattggtngctgctngtncacccccaagttccccggggnaggtcncgngnnatttnaannaaacagtgcgttgagttgtccagcattctactctcacggcgtactcacacaggggggtcggcaacattccggtggcccttcttacgacctttcttgcgacctgggactccacttttcagtcttacttttctcactgctgacggggctcatc

SEQ ID NO: 592406 - DNA, 255 bp, Homo sapiens
  misc_feature (37)..(37): n is a, c, g, or t
  misc_feature (89)..(89): n is a, c, g, or t
ccatagatccccccattgagctgtggatgggcaaacncgggtggatcccccctcccccaaccccccattgagccttgggccccccctcnctttcctcccctcccccttctccctgccttcttttttttttggtttgagcccccaggccttttcccctttgagggaggtgcttcgaagaatgttgcccccccctaagtgttagaagcctatgtccgttcatccctgagaggtttgaaagaataaaaataattttta

SEQ ID NO: 592407 - DNA, 108 bp, Homo sapiens
tttggttgatctagaggagtttattatatcaatataaatggaaatgatatgcattgaaggactcgtgggatattatgatccaaatatacacaggaaatgatagcattg

SEQ ID NO: 592408 - DNA, 731 bp, Homo sapiens
gttcttccattaaaatattcttcacaagcggttatgcagtcgtgccccgcggcctgttgctgaccccgggaatctagagtcgtaccctcttgtgtctctctgattcagtcttaagcgtgataatgaagttgtgcgcccttttaggctcgctctactgtcgcttgtctatagattttctgcctccttttagaaaattgaacttgaaaagacaggatgaacgtggtacacagcatgtgaagacaattctttcaagaagtttggctgtcaaggaaaacagagaatgtgctaaagaacatacagacacagagcagacaggccacctttgcagatcacatggagcgtttgtctgatattagaagctagcatgaagctaagctgggaacgacagagagaccaagtcctgatgacattgtttgaacccagagatccagacatgcctgaaaactagttttaccactggtacttatccgttgaactgagccaataaactctcttttatacttaaccttgcggttttacctggcatttttgtcagttgacagctcataatattctacatatagagagtatacagtcattagatcaactccaagaagacgcccgaatacaaatcctcgggcgttttttgcggcgctgcacaacgtttgtgatgtgccctggtgtattggttctcgaccccgtttccttcacggggagacgcggccccaagggcggtaatcaaaccgttcttt

SEQ ID NO: 592409 - DNA, 1009 bp, Homo sapiens
aggcaggcgtgtctgccgaagaaaccagggaaagtggtgtgcttatgcatgttcacatcgacggcagatttaccaccaccaacagaaagtcaagaaacagatgcagtcagacccacataagcaggacgttggactgaaaccgagttcctgagccggcctcacaggccccagatctatttggagccatccaccacccccatgaccctggacacggactatcaaacgtaagatcatcatgagcgacatggatgcgtgcacacccaacatgggaccccatataagggcacaccgatcaacgtcatcacagaaaaaatatacttcaaacctgacaagagacaacatagagaccatataaatcggaacgacataaagtatcaacagggccctagaccagaaaaaaggatggaaaatgccttcgagagaagacattgagaaaatccattccgattacaacaccaaacatcaaatgttcgggcaaccaaggatgagaacccagatggtgcaagaactattaagacaagacactcacgacaacactggaaaaacgtgatgcacacgaaggcactccgatgattcccgaaaccacatcagacaatggatgaaagccagggaagatgggagacgcaaacgcagtccaggcagaaagaatagcatgaccggaaggactagaagatgtaagaatagaacgaagaatcatactgaataaggaacagaatgtacaaacgaacatgtgaatagcgatcgaaaccaacgaagaaatacaagacaaccctttaacacaaggaccatagttatccccggagtgaattgaacaatgtgaacacaaacacagaagatacaatgacaagacacagggaccaatcgaaaccatcgggccggagagaacacaccaaagaaggaagaaagaactgatacacgaaggacagacgcacaaaaacagtaagaaggcatacatagaagaagactaggtacagaaaaaacaaacaagcatacttcgacgagaaagaat

SEQ ID NO: 592410 - DNA, 780 bp, Homo sapiens
gcagaggattgcctgctaccaggagttggcagccaactgaagagcaggggtcagcccacccttcaaacaagcccccactggagaccccacaccgctgtgtggctggacttctgccccacacaattgccacatcaacctcatggaagtgtcctaccccaagaccacccctcagatggtgctaggtccttcagcatccgctttggacgcaaacccatccctcatcggcacttgaccctggagcaaggccactgaaccccatgtagtacaccgcagcactgcatcaccaccatggctgctccctcctggaagtgcttgcctgctgcagagggtgatccccagaggccagggtctccatgatggcaagttcgggccagaccagtgggacccttggtcaggacgaccggggcctcagacttcctactcaagcaggaggaccgtgacgatccaggatgcactacctgcacgctcttcagccacgctggatgtggccctgcacaggagatgaagcaatatgtcacccatgatcaacagtgctgttgtccagcatcacagagaccaactacgggtgggtcctgcgatgcatccttggctgaggaggcctccttccctgccccatggtcagtgacagagagcgagatggacatggagtgaccatgtgtggcatcacaagaaggtgtggcttcaaggaggcgcagaggaggaccaccggaggactcaggcaaagcaaccatgagatcatcgagagtactacaagagcgtgtaccaggcaaacgggcaatg

SEQ ID NO: 592411 - DNA, 701 bp, Homo sapiens
  misc_feature (149)..(149): n is a, c, g, or t
  misc_feature (549)..(549): n is a, c, g, or t
gagttagtgcttaatgaggtcagaatttcagttgagataacggaaaagttctgaagatgggatgtggtgatggttgcacaacaatgtaaatgtacttcatgttactgaaatgtacacttgaaatggctacaatgggccaggtacggtgnctcatgcctgtaatcccagcactttgggaggccaaagcaggtcaatcacctgaggtagggagtttgagaccagcctaaccaacatggagaagccccatctctactaaaaatacaaaattagccgggcatggtggcgcatgccctgtaatcccacctactcaggagtctgaggcaggagaattgcttgaacctcgggaggctgaggttgcaattagccaagattgtgccattgcactccagcctgggtaacaagagcaaaactctgcctcaaaaaaaaaaaaaaaacaaaaaaaaaaaatttttggggggcctgggccccgaaaaggtttttaaaaacaattcgtcgtggggcagcgggggcccacgatggttactgtacaacgttgggctaaggctggtncccaaggagagaatccggccaagaaatagtgctggggattttcccccaagtaaaaaacgccgggggaaaacggagctttttggaacaatccataggagattcagagcacaatacgggcgcttacacgggtctcaaggactcgaataaatagg

SEQ ID NO: 592412 - DNA, 266 bp, Homo sapiens
aaggagacgatcccttcttcattatcagaatcacatcatttctggatataattgagggattcttgaaaatgcttttgataatggcataaaacttaggagtttcatagctgaatgcctgcttatctcatccaatatacctggagaggaaatacacagagggttcaccggagtaagcaacgaaagttgacggaagaaccacatgaaaattcctcatgtcaaaagacactttaatgccctatccttcttcaatcgggagatcaaaataa

SEQ ID NO: 592413 - DNA, 333 bp, Homo sapiens
tctttaattagaatgtctcacttattttgtaaacattttgtgggtacatagtacatgtatatatttacggggtatgtgagatgttttgacacaggcatgcaatgtgaaatacgtgtatcatggagaatgaggtatccatcccctcaagcatttttcctttgaattacagataatccaattacattctttagatcatttaaaaatatacaagtaagttattattgattatagtcactctattgtgctatcagatattaaatcattctttttatcttatttgtttttgtacccattaaccatccccacctccccctgcaaccgtcagtaccctta

SEQ ID NO: 592414 - DNA, 387 bp, Homo sapiens
ggtcgacaccaccatgcccggccctgaagggtcatttctgtaaactgattattgcctgattctttcactgacttctcacttggaaacttttttaacttataggcaagtttttaaaatagtacaatggggccagattcagtagctcacacctataatcccagcacttggaggccaggatagcaggatcacttgagctcaggagttggaggctgtagtgtgggctgtgatcgtgcctgtgaatagccactgcaccccccacctgggtaacagagtgaaaccctctctttcaaaaaaaagtgtacaataaacacccatatgcataaaatctgtagctcagttccacaagagctgacattttgccacattgctctctctcagtcgacgcgg

SEQ ID NO: 592415 - DNA, 1094 bp, Homo sapiens
gtccggagcatcggtgcagtttcgagggtaaagcctttggcgcggtgatgtggacttttgttctctaactacaactcccagcatacgtcacccctcacgtgggcgctaggtgtggtttcgtgggatagggtcaccagtgaaaagttgtgcagagcccaacatgagcttcatttccaagctgccacctatctctgcctcctgcgtagcatccggaaacatgtggccctacatcaggaatttcatggcaagggtgagcgctcggtggaggagtctgctggcttggtgggtctcaagttgccccatcagcctggagggaagggctgggagccatgaacatggagaatatccttggatgctgcattcataggagaattgaataatttctatcaatatgtatttatcattaaattttttttaagtttaaaaaaaaacaaaaaaaaaaacaaaaaaaaaacacaaaacaaaacaaaaaacaaaaacaaaaaaaaggcgcgcgcgcgcgccccccccaaatttcccctcccgcgagggcggcgcccacagttctctcgccgccgtcccccccgctcctctctctcttgccccaagaggtggcgcccctctttgggaggagccgccgtctattatatcagccctcggagccgcgctggcgcgcgcgtctgtcgtttcccaccgtcgggctccgtcgcgcgggcgacacacacggtcggagtccaccgctgtggagccactccctctgtggggaagacggagagcacccctctctatcttctcccgcgggggcgggggcgccacacgcaccatttttggtgcgggcgaccaaaactctcctccccttacccagagcacagtctatttacacacaggctctcttcacaccagagagcgcgcacacatatatactacacactctccttccagcacaggcggccgtatactaacccgcgcgcgtgtctacaccccccccctggccgctccagtcatttgtccccgccaccgccgcgccattagaaacgatcctgtggccgccaccaacggcgagcatagttctacctcctctgcgcgcacaaattttttttttcccgccggggggt

SEQ ID NO: 592416 - DNA, 1352 bp, Homo sapiens
gtccggagcatcggtgcagtttcgagggtaaagcctttggcgcggtgatgtggacttttgttctctaactacaactcccagcatacgtcacccctcacgtgggcgctaggtgtggtttcgtgggatagggtaaggcgaaaatgaagtgacgatgacgtaccaaagaggaaaatagttgaatatgttgtgtgagggcgtcgtttgcagaagccccagtggcctaatggataaggcattggcctcctaagccagggattgtgggttcgagtcccatctggggtggcctgtgacttttgtccttttttcccctttctaaacaaagcgaaatatgccaactttttttttttttttttaaatgggaagtgtgtgtgtgtttttactagctggtgggctgcaattttcgagaatctgcacacacccatgtcctttgtctgagccgcaggtcccctgggatttggggagacgtcaatacgttgaattttgatatcccttttataaatcatttaaaaatgtcttctcagcgtgttccatatcaaatccacacccacaccccccgccgggcccgcttctcctgagactcagcggttggtcggcttacgggcatcttcaatgacgcagtgaagaaaagcccctgtttccccaaacccttgttctgggttagaggtcctggtaccttcagttaacagtcgggtttcgtttgatttgttacggcgcccctgggccttcgattaataaggttcggtcaacggacaagtgagcggttccactgctcgtcagtcgatagggggagtcggtagtctgtccgaccgtaccattaggcgcctgggccggaggaggggttttcagggtcgtaggacgccgttgggcaccacgctcggagaaggacaggacaatggcggccttagggtccccgtcgcacacttttcgaggacttctgcgggagttgcgctacctgagcgcggccaccggccgaccctatcgcgacaccgcggcctatcggtaccttgtgaaggctttccgtgcacatcgggtcaccagtgaaaagttgtgcagagcccaacatgagcttcatttccaagctgccacctatctctgcctcctgcgtagcatccggaaacatgtggccctacatcaggaatttcatggcaagggtgagcgctcggtggaggagtctgctggcttggtgggtctcaagttgccccatcagcctggagggaagggctgggagccatgaacatggagaatatccttggatgctgcattcataggagaattgaataatttctatcaatatgtatttatcattaaatttttttttaagtttaaaaaaaatcactcagatatacaaaaac

SEQ ID NO: 592417 - DNA, 116 bp, Homo sapiens
ctacgtggcttgtgggctccccttacctgtgctacgatgaacggcggtggtgtgttccttattccctacgtcctgatcgccctggtcggagggaaccatagccactggtcaaccca

SEQ ID NO: 592418 - DNA, 419 bp, Homo sapiens
  misc_feature (419)..(419): n is a, c, g, or t
cacagactccatctgccatcagttccggcgagaacagcttgagcagggtccccctacagtgctactgcacccagtaccaggactacagcctgtcgtaagaccacacggagtaaggcatggcatgtcggctgctcggaccctcatttgactcctacctgctgcctgaactgaccatatatgactgtgaagtgaacgtgcccgtgctgggaagatccacgctactgcaaggagggcaccttctaatacctctggaccatgctaattgagccaagcctgctacctgcgcaacgactctgccgatgtagaacgaccagcttcactctcttggtgtgctgttgcaactatgtatttctaacgccagcatactattaacaagatggactcctgtcagacttgcccaggtgaccatgcttggcctn

SEQ ID NO: 592419 - DNA, 1771 bp, Homo sapiens
gtccggagcatcggtgcagtttcgagggtaaagcctttggcgcggtgatgtggacttttgttctctaactacaactcccagcatacgtcacccctcacgtgggcgctaggtgtggtttcgtgggatagggtaaggcgaaaatgaagtgacgatgacgtaccaaagaggaaaatagttgaatatgttgtgtgagggcgtcgtttgcagaagccccagtggcctaatggataaggcattggcctcctaagccagggattgtgggttcgagtcccatctggggtggcctgtgacttttgtccttttttcccctttctaaacaaagcgaaatatgccaactttttttttttttttttaaatgggaagtgtgtgtgtgtttttactagctggtgggctgcaattttcgagaatctgcacacacccatgtcctttgtctgagccgcaggtcccctgggatttggggagacgtcaatacgttgaattttgatatcccttttataaatcatttaaaaatgtcttctcagcgtgttccatatcaaatccacacccacaccccccgccgggcccgcttctcctgagactcagcggttggtcggcttacgggcatcttcaatgacgcagtgaagaaaagcccctgtttccccaaacccttgttctgggttagaggtcctggtaccttcagttaacagtcgggtttcgtttgatttgttacggcgcccctgggccttcgattaataaggttcggtcaacggacaagtgagcggttccactgctcgtcagtcgatagggggagtcggtagtctgtccgaccgtaccattaggcgcctgggccggaggaggggttttcagggtcgtaggacgccgttgggcaccacgctcggagaaggacaggacaatggcggccttagggtccccgtcgcacacttttcgaggacttctgcgggagttgcgctacctgagcgcggccaccggccgaccctatcgcgacaccgcggcctatcggtaccttgtgaaggctttccgtgcacatcgggtcaccagtgaaaagttgtgcagagcccaacatgagcttcatttccaagctgccacctatctctgcctcctgcgtagcatccggaaacatgtggccctacatcaggaatttcatggcaagggtgagcgctcggtggaggagtctgctggcttggtgggtctcaagttgccccatcagcctggagggaagggctgggagccatgaacatggagaatatccttggatgctgcattcataggagaattgaataatttctatcaatatgtatttatcattaaattttttttaagtttaaggtttttctctgtaattttgtttactagttcttaggggaattaactggacatttcatctttactctcagtgaatttactgaactttttgcactagactgatgttgtttttctacttaaaaaaatttttttatattttattttaaaagtagtacaagccttagccaggcacggtggctcacgcctgtaatcccagcactttgggaggccaaggcaggcggatcacctgaggtcgggagttcgcgaccagcctgaccaacatggaaaaaccccgtctctactaaaaatacaaaattagccaggcgtggtggcacatgcctgtagtcccagctactcaggaggctgggacaggagaatcgcttgaacccgggaggtggaggttgcggtgagctgagatcgcgccatggcactcactccagcctgggcaacaagagcaaaactctgtctc

SEQ ID NO: 592420 - DNA, 82 bp, Homo sapiens
  misc_feature (2)..(2): n is a, c, g, or t
tntgcgacagagtctcttgtcgcccaggcctggggtaccaatggttgtgaatctcagctcactgcaacctccgcctcccagg

SEQ ID NO: 592421 - DNA, 782 bp, Homo sapiens
gcgcgtccttgggttcagcaagcgagtgccgcctgggtggtatgctgtggctctgctgggggtcgctgtctgtgtgctgcggtggggaggtcgcgttttagtcgtgggtctggggattatgggttccagccggtggtctgttgcgccccctgtggaagccgtgtttgcaatggtttgctccatcactctcgtgtccttgtgtgtggtgtcgcgggccgctcctttgctgatcctgcgggtgttgtgcaccgtcgtgtggttgcgccggcgcgcgcgtggcgcctctatgtcgtcgcgggatggcacgcacgttgtgatttttcggcgcgtcggggcttcgcacttttttgtctctccccgcgccgactctcctgtctctcgggctatctctctcctggtctgttggccggaaacgcgccgtcttttgcgccctcgccgcgacagtccacgctccacgccgcgggctctgccacttttgttgtcatagaatatgacgctctaactgcgggtgtgattgcatgtgtgtgcgctcctggttctcgtctgtttttgccgcctgatccgccgcgctctagggtgtgggagctgtttgcacccactctacaggggcaccctttcacataactaacaatttcttccccctcttttatatcccacggtgttcgtccactactcctctgcttcctactctctatattgtctgggcctcgcctcccttttactatagaagaacaatattaatgtgctccttctcttacagaacaaacaaataaccaaaaaaa

SEQ ID NO: 592422 - DNA, 169 bp, Homo sapiens
cacgagggtatgtctggcttagcacttaatcacagaaacttatatgatgcgcactcctcctcagagtcattcaggtatagacactgaactgtgtccgtattatttctttcattaggagacactgtcctaacagatacatggggctcagggaatgtgagggtcacacagg

SEQ ID NO: 592423 - DNA, 545 bp, Homo sapiens
gtccggagcatcggtgcagtttcgagggtaaagcctttggcgcggtgatgtggacttttgttctctaactacaactcccagcatacgtcacccctcacgtgggcgctaggtgtggtttcgtgggataggcagagacagggtttcaccgtgttagccaggatggtctcgatcccctgaccttgtgatctgcccgcctcggcctcccaaagtgctgggattacgggtcaccagtgaaaagttgtgcagagcccaacatgagcttcatttccaagctgccacctatctctgcctcctgcgtagcatccggaaacatgtggccctacatcaggaatttcatggcaagggtgagcgctcggtggaggagtctgctggcttggtgggtctcaagttgccccatcagcctggagggaagggctgggagccatgaacatggagaatatccttggatgctgcattcataggagaattgaataatttctatcaatatgtatttatcattaaatttttttttaagtttaaaaaaaatcactcagatatacaaaaac

SEQ ID NO: 592424 - DNA, 435 bp, Homo sapiens
tatttcctctgtgcaatttactttcactctagtgaatgcttatttattaaatctttctctgtggacctgtatctctagctgggttaagaatttctgacttgctgcttctctgggtcaccagtgaaaagttgtgcagagcccaacatgagcttcatttccaagctgccacctatctctgcctcctgcgtagcatccggaaacatgtggccctacatcaggaatttcatggcaagggtgagcgctcggtggaggagtctgctggcttggtgggtctcaagttgccccatcagcctggagggaagggctgggagccatgaacatggagaatatccttggatgctgcattcataggagaattgaataatttctatcaatatgtatttatcattaaatttttttttaagtttaaaaaaaatcactcagatatacaaaaac

SEQ ID NO: 592425 - DNA, 1253 bp, Homo sapiens
ggcaggagaagatggagttcacactgcttccctgcatttccccagatgactgaaggctctaggccactactcactcagacactcctcctcgaacatcgaacatcacctacctacgagagagaggacaatccatggtactgctggatactcgagacaaacaaggtcaatacatgtagctactcggaaaaagaacagaaacaacacaacacgatcacagtgccaaacgaaaaagagctaacaagacgacaaggaaagggcacacagagccctccagcacaacaaggaggacaaagcagaggaacaacaacaaccgcggaaaacaaaaagacacaagagagaaacaaacagagaacacagccaagaaatagaaacaaaacgaggaagaagaagaaagccagacacccgagcaaggagagagaactgcaacatgcaagacacagagaacaggcgaagcacacagagcaggaataacgcagaaaagcagaacacagaaacaagaagaaaagaagccgcaacacaaaacaaaaaaagaaagaagaagcgaaaaagaaacaacaccagaaaaagagagaaagagagcgaacagcgccggcgcaggagcgacgagggaggaagccaagagaagaagaaaaacgggcaagacacaacgaagcacaacaaggagagagaaaagcacaagagaaacaagaccagagcaggggcaagggagcggcaagagaggaggaagagccagcaggagagagaacgcaaaacaacgggaacaaggagaagaaaagcaagagagaaggcgacgagaacgacgaaaagaggagagaaggacagagaaggggaaggaccgaaacagaaaacaggggcgcaaaaacacaacacgggggggacgagaacacagggagcagagggacacggcgagcgcaacgggagataggggcagaggaggagacgaaaagagaaggcacaagcgaaaaacaaaaggaaggagggaagcacagacgaaggtagcacaacggcggacacagtccgagacaagaaagacgagaaacaaggaggaaaacgcccgcgaagaagaagagcacgaccagccacaagcgggggagagagaagggacagagcggagagggggagagcgcgccgagacgaagggaggagcggccaacagagaagcaagaagtcgaagaagagagcgagccgaaggcgcagcaagacagaaagtcagggaacgaccagcaagaaacggcaccggagcgagaagcacg

SEQ ID NO: 592426 - DNA, 424 bp, Homo sapiens
  misc_feature (8)..(8): n is a, c, g, or t
  misc_feature (16)..(16): n is a, c, g, or t
  misc_feature (41)..(41): n is a, c, g, or t
  misc_feature (54)..(54): n is a, c, g, or t
  misc_feature (134)..(134): n is a, c, g, or t
  misc_feature (139)..(139): n is a, c, g, or t
  misc_feature (145)..(145): n is a, c, g, or t
  misc_feature (160)..(160): n is a, c, g, or t
  misc_feature (170)..(170): n is a, c, g, or t
  misc_feature (182)..(182): n is a, c, g, or t
  misc_feature (208)..(208): n is a, c, g, or t
  misc_feature (210)..(211): n is a, c, g, or t
  misc_feature (214)..(214): n is a, c, g, or t
aggcctgngacaccgnaaattgccttgaacctgggaggcgnaggttgccaatgngccgagatcgcgctactgcactccagcctgggcaacagagagagaccttgtctcaaaaaacaacaacaacaaaaagtcanagtcntaatangcgcaattattggcntctttcttcnagagcccaaagngaatttaaggggtggaaccatcccantnncangggtcaaaactaggattggatcttggtttgaatgaaaaaaagcataaaatattcttgcaataattgtaaaaatttgaatgtggactaagtcctagattatattaaaatatttttaattttttaagcttgacaaatgcactgattgttatactttaaataactaaaaatctgagaatccacagtgctacagacaataaatgataaaatggg

SEQ ID NO: 592427 - DNA, 199 bp, Homo sapiens
agaagttccaatagcattatgtctagaaaaaaaagtacataccttaattttaaaatcctgctaaaaatgttgtgatcatttgaggactcagcaagttggaacctttctgttgtgtagggccttgccttgatgttgatgggctgctgactgatcagggcggttgtcgttcaaggttgctattgaaacttctaaaactagg

SEQ ID NO: 592428 - DNA, 1116 bp, Homo sapiens
  misc_feature (816)..(816): n is a, c, g, or t
  misc_feature (900)..(900): n is a, c, g, or t
tccacgacccgccacagtggggctcaatatggccggggccccatgtggcgaggacatttttttttcgagccactttttccagaggacccacttgttgtgtttccctgggtcccgggccggtttcctcgtgaggtgtccccactatgcccgaggacggatttgttcccaggaccccttcctattttttgggtcggtgggagtccccgcagttccgcgtcccctttcttttgtccaccggcagcggggcctttcagggggttgcccccactgaagagcccgagatccaacccggggtttgttgaggttcgcactatgtggaacccgttttgtgagggaacacacacataggagtgggcgtgtttgttaatagccccccccccaagagcgatgtgggtcccaggattttttttttttgggatatttcccattgagcgctggtgggaatttttaaaaagacgcccttatgatgtttctccccacaacacacaatcgcccacacataccatggggcaaaagagattttaatatagggtgcgccctcccttggggaacttggtgtttgtttgtggtgttccccactggagacatttctcttctgtcttgttaattttctaggggtcccaagtatggggcgcgaacgagaaacacgctcctctcattgtatgtaaggagtttttttgagggccccccaattgtctccgagacgccccctctacatagtctccccagatctcggtgtctcctggtatacaaatctccactctaaaggagttttctccatagaaggttcactgtgtgccccaccacccgagaacntgctcacaccagatgcgctgctttctcagttgtaggcgaacagatgacttcgtggcccaggcccagatacagaaaataatgtgngcttctttgtccacattgagcaccagcacaccctgtggagggggacatcttctcccgttggagccacactagccagctggtgaggaaattggggaattctatggtattaaggttgtgttaatcgattgttgggggagaaaatccttgggtatggaaagcggggttcattgtgattggccaataaatggcggccgccccttgtcattgttttcccca

SEQ ID NO: 592429 - DNA, 1165 bp, Homo sapiens
gaaaaacagatccgcgacagctaggcgcgtgagaccggcctgcccgcaggtactgctctggaccgtggaccctgctgtgacctgggagacgcagaacctgcctggaccacctgcgctggggacgacgtgtggccatgagctcgcaggaagctgagcgggccgaaaggcaggaggctcagcatacactgtctgtgaccttggaacagtggcttcggcagcgccccctctagatctcagtgaccttgcttcagcttgaaacaaccggaacctcaatcttgacatatatgtaattggtaatgcaggaattgaactctgggatcataagacctcacttatcacgatgctgcctataatgacatcgtggagcagattatcctcactggattgtgaatataccccatctgagcattcagtcaaggtctccacatgtccgtattgcagagggatcctacttacatgggtctatgccaaggtaatcagaacaattgtgccctattattccaggatctctgctcatacatcaaataccaaccccacacttgaacctgataaggggatacgtggacgcgaaacaaaacggtgagaagtcaaccacttctgccttgaaacctacatcagctactatgtacagcaatcattcaaactgtcaacctgactccaccagatataccaacaaaatataccaagcgcgattggaggcacatattgaacgggattccttgcagaattgcaagagataggagcaggagcgacgaccatcaccaaagactccatggacccaacgagccgtcagtacatcatgggacagggagagcattgaactttatggaaaatgacggaccaattggagaatagaaaaaatatggtatccgcgacgaattcccaatcagaaacacgcagtcacaacgaagttagacccacatatagactaaacgaagaccccaacaacaaacattttcccgataaaactattaaccgacatatataccggaacaatcccaagatacaccctaccaatttcttacagataacaccactcacaaaaatggatacagataacaccacacttataataaaacacctatgaataaactcatacagcaaatgaagagcaaaaacaatagaaagaaaaaacatcagctacaagaataggcagacgcatcaa

SEQ ID NO: 592430 - DNA, 181 bp, Homo sapiens
taccatttacgagtacggagccctcacaattgatggggaggagtacatcccctatcaagcagcatggtggcaaatacgtcctctttgtcaacgtggccagctacgtgaggcctgacgggccagtacatatgaactagaatgcactacagcgaagagcttgcaccatgtcggtctaggtcat

SEQ ID NO: 592431 - DNA, 438 bp, Homo sapiens
  misc_feature (324)..(324): n is a, c, g, or t
  misc_feature (421)..(421): n is a, c, g, or t
  misc_feature (432)..(432): n is a, c, g, or t
gtctctgtcacccaggctggagtgtagtgatgtgatctcagttcactgcaaaccctgcctcctaggttcaagcgattctcctgcctcagccccctgagtcactggattacaggggtgtgctaccatgcctggctaatttttgtatttttagtagagatggggttttgccatgttgcccagactggtcttgaacccctgacctcaagcgatctgcctgccttggccttcccagagtgctggggattacagatgtgagccaccccacccagctgattttaaaaaacaattttaaaaaaacgttttgaaacagcccaaatttacatnaaaagttgttaagtacagttggaaagatttttttccctggaaccattttgaggggtttaagtttgccgacctaatggccccttcaccctggaatggntgggtgttgcnttccct

SEQ ID NO: 592432 - DNA, 391 bp, Homo sapiens
gggaccgcccggaggaaggggggggggtaaaatgtaaaataaatgttttgggaaaccccccccctgcttgtggccccacctgctgcagacccgggccccgggccgaggttgctttctgtgacgaccgcctggtgacgctggacaccaggagggttatggcactgccctcccctcctggagcccctggcactgaccacctggacttgacctgactcctggtcactggccaaacacccatcctcaccccagccaccccgggccctggctggtgccgtgtgacacctgtagcccacctgtgtgtctttgctccgcccacccctgcgtggcgccggtcaggcgcaaacctggcgccagtgtctaaatgtccatcattctcagaccaaaaaaaaaa

SEQ ID NO: 592433 - DNA, 2554 bp, Homo sapiens
  misc_feature (18)..(18): n is a, c, g, or t
  misc_feature (44)..(44): n is a, c, g, or t
  misc_feature (57)..(57): n is a, c, g, or t
  misc_feature (66)..(66): n is a, c, g, or t
  misc_feature (72)..(72): n is a, c, g, or t
  misc_feature (117)..(117): n is a, c, g, or t
  misc_feature (123)..(123): n is a, c, g, or t
  misc_feature (161)..(161): n is a, c, g, or t
  misc_feature (233)..(233): n is a, c, g, or t
ttttccccttccttaaanaaaattggaaactgggggcaaggggncaagaaacgcctnttcccaaantctctncccccaaacctctctgcgcccaattgccaaaagccctccaacaanaccctnccaagggccccaaacaagctggttgttagggggtccanggcccctcccatgcccggggaacggaggtgcaaccgtgaaccacagttggtgggggcctgaaccgctggcgnccgggctctggcagagcccctgagatcctgtggggtcctgaccactgcactgggtttttcaagatgaccaggaattcgtgaggctgggtggtgactccgtgggggggcggagacatggccatccagaggtcggggaccaaggacaccgtgagcagaatagccagtctctcctcactctcccccaggcaaggagagcacaggaaggggttgcaggaactcatggtccagttgccagagagccccccacaacccctgcagacccagagctggctcagcggaggtgccagcccagccttaggtgcgaggcttggcctcctttccagttagggcaggccgccaggcccggccacgtctgcatacacagtcctggctgtagtcctggcctggaggggtgtcctggttgctgggtgatctatgcagggacgggaatgaggggcaggggtcttggggtgtgtcccgccttcccctcccccgtcggtgccacctactcagtgcaccgggtgggctttttggattccctttgtccagccctgacctccccacagccatcgggagggccccccagagcgcatctggaggaggagggggcgcaatgaggcagggaaggtcggcgccctgcagctgcctccgctgcgtgtggagcgaagggagttctcaccttgcgaagtctcatctgtcaggctttcctccgggtgggcgctgtccgtcctgctgcccgacgtgcacgacagcgtcctctaccgcctgtgcctgcagccgctgccgctgcgcgctgggcccgccgccgccgcgccagagacccccgagccggccgagtgcgtggagttcaccgccgagccggccggcatgcaggacatcgtggtggccatgacggcggtgggcggctccatctgcgtcatgctggtggtcatctgcctgctggtggcctacatcaccgagaacctcatgcgcccggccctcgcgcgccccggcctgcgcagacacccctgaagcgcgaggccgcccgcccatctttgcgccacctgcctgagggcgcctgagctcccaggtcctccgcccgctctcctctcctcattcctgctgcctccttaagatccccgcggaggaggacctgccggcgacggctccggcactttggcatcatcacacgccctttccagccgggcgtcagactcccagactctggccccggattggcccctgggcttgcgctgctgtgccagccgcatccagggctctccccgctctccgcaggcctttatagaggcggccagggcatggagccccttccagcaagagccatgggcactccggctcaccccgcacctccatcctgtgccgaattgtcccagacagaccgtcgccattgctcggtcactgtgctttgcaggcctggggcgcagctctccaagcctgtcctgccccgccccaccccactgggcttaggttagcttcgtgccttagtatctcgggcccactgcaggagccaacaccctctgctgtccagggggggtctgtggccctaagattggccggcctctccatgcatctggccagcgtccccttggagacaccttcaccctcaagcgctgcagaagcatgaggtgagggcctgcagcgctctgtaccgtttagggtgttggaccagccgggagcctggcaggcctggcccagcggccagggtgagtgttctcagaccccgggcagctggtggttctccagggccaggtaccccttttgtgtgtgcgacctctgactaggtccctgtgggaatggggcagatggcggccatcaccactgggtcccagggcagaagcttagataccggccttgagcagcccgaccttccaccgctgcctggatcccaagcctcagccgacccaggggaccttggtggcaacggtgtgactgacagcaccacccctagcctttgcatgcccaggggtcgagagccagtatccggcccagacaatgccacccgccatggaagaaaagctgaccctgcccacctgctgcagacccgggccccgggccgaggttgctttctgtgacgaccgcctggtgacgctggacaccaggagggttatggcactgccctcccctcctggagcccctggcactgaccacctggacttgacctgactcctggtcactggccaaacacccatcctcaccccagccaccccgggccctggctggtgccgtgtgacacctgtagcccacctgtgtgtctttgctccgcccacccctgcgtggcgccggtcaggcgcaaacctggcgccagtgtctaaatgtccatcattctcagaccaaaaaaaaaa

SEQ ID NO: 592434 - DNA, 263 bp, Homo sapiens
acacacacacacacacacacacacacacgtgtgcacacaccataactgctgtgcctaccaatgctgtcaggatgctactagttcattaagcattttactgtgctgggtgcaacagggcacacaaactctgctttctcagaattccaagtttaggcaaaaatagcccatgggcaaataactgtagtgcaagataaagtgttacaagtgttctgaacaggtttgtggtcgacgcggccgcgaatttagtagtagtaggcggccgc

SEQ ID NO: 592435 - DNA, 102 bp, Homo sapiens
gggtcggtccacttgttaaagcagctttaaagctgggtgcatttcttcataatgtataacgcaacttttattcatccaatttctgtttgtggaggtagcact

SEQ ID NO: 592436 - DNA, 486 bp, Homo sapiens
tccccactgttgtcctgccgtgtcggagggttgcttgacctcaagagttcgaaagcaacctgggcaacatagtgtagatctcgtctccacaaaaaataaaaatatagccaggtgtggtggcatgaccctgtagtcccagctactcaggaggctgaggcaggatgaccgcttcacgcacacgttcagggctgcagtgagctgtgctctcgccaatgcaccccagtctggctggcagagcgagaccctgtctccaaaaataatcgtacttataattaccatagatttaattctctgagtgtaagataccatcctattcaaaactggtatggcttatagggtttcagaaacccttaataacgtatcctaatattcaaagcaaacctccaattcccaaactcttgggaactgaaagactaaacacagaggcctatgggtcaccagttcaatgcctaacgacccgtgaagctgccatggagacgctgaggt

SEQ ID NO: 592437 - DNA, 1915 bp, Homo sapiens
cgccctggtcccctacaaggtgctgcccgagggccccgaggcggtcggcgggcgcctgtgcttccgcagccccgcgcgcggcttccgctgccaggctccgggctgcgtgctgcacgccccggccggccgctccctgcgcgccagcgtcctgctgcaaccgcatgcgtcctcctgcatgtggcgcctggccccggccgccgcgcgccgtgtgcgcgccttcgcgctcaactgctcgtggcgcggcgcctacacgcgcttcccgtgcgatgcgcgtgctcctcggggcctcctgccgcgactacctgctgcccgacgtgcacgacagcgtcctctaccgcctgtgcctgcagccgctgccgctgcgcgctgggcccgccgccgccgcgccagagacccccgagccggccgagtgcgtggagttcaccgccgagccggccggcatgcaggacatcgtggtggccatgacggcggtgggcggctccatctgcgtcatgctggtggtcatctgcctgctggtggcctacatcaccgagaacctcatgcgcccggccctcgcgcgccccggcctgcgcagacacccctgaagcgcgaggccgcccgcccatctttgcgccacctgcctgagggcgcctgagctcccaggtcctccgcccgctctcctctcctcattcctgctgcctccttaagatccccgcggaggaggacctgccggcgacggctccggcactttggcatcatcacacgccctttccagccgggcgtcagactcccagactctggccccggattggcccctgggcttgcgctgctgtgccagccgcatccagggctctccccgctctccgcaggcctttatagaggcggccagggcatggagccccttccagcaagagccatgggcactccggctcaccccgcacctccatcctgtgccgaattgtcccagacagaccgtcgccattgctcggtcactgtgctttgcaggcctggggcgcagctctccaagcctgtcctgccccgccccaccccactgggcttaggttagcttcgtgccttagtatctcgggcccactgcaggagccaacaccctctgctgtccagggggggtctgtggccctaagattggccggcctctccatgcatctggccagcgtccccttggagacaccttcaccctcaagcgctgcagaagcatgaggtgagggcctgcagcgctctgtaccgtttagggtgttggaccagccgggagcctggcaggcctggcccagcggccagggtgagtgttctcagaccccgggcagctggtggttctccagggccaggtaccccttttgtgtgtgcgacctctgactaggtccctgtgggaatggggcagatggcggccatcaccactgggtcccagggcagaagcttagataccggccttgagcagcccgaccttccaccgctgcctggatcccaagcctcagccgacccaggggaccttggtggcaacggtgtgactgacagcaccacccctagcctttgcatgcccaggggtcgagagccagtatccggcccagacaatgccacccgccatggaagaaaagctgaccctgcccacctgctgcagacccgggccccgggccgaggttgctttctgtgacgaccgcctggtgacgctggacaccaggagggttatggcactgccctcccctcctggagcccctggcactgaccacctggacttgacctgactcctggtcactggccaaacacccatcctcaccccagccaccccgggccctggctggtgccgtgtgacacctgtagcccacctgtgtgtctttgctccgcccacccctgcgtggcgccggtcaggcgcaaacctggcgccagtgtctaaatgtccatcattctcagaccaaaaaaaaaa

SEQ ID NO: 592438 - DNA, 160 bp, Homo sapiens
  misc_feature (26)..(26): n is a, c, g, or t
  misc_feature (31)..(31): n is a, c, g, or t
  misc_feature (43)..(43): n is a, c, g, or t
  misc_feature (110)..(111): n is a, c, g, or t
agccagatttatatcagacttctgtnaatanaatttcaacatntctggacgggctcatagtagaccggaacagatccatgttgagctcttcaaatttggcccgagtcagnntctcagaaaagtcttctccttcatagaaggactcaatttcaattcttgc

SEQ ID NO: 592439 - DNA, 293 bp, Homo sapiens
gttggctgactctgagtatccgggagtagagagaaggagcagaaagttgttctgtgtggggctggcagtgatttgatgaccgcctctgctgctctcacctgggactgggcccattatcctgcttggtcacacccagcccagaagacgggtcctcctgttccagtgactcactgcagttatcgtgcccgcgtcttctggtgttgggtacctccgtgccgttggtgaagacacaccagcagtagcctatgctctcatagcactggagtggcagatagttgccgttctctcttact

SEQ ID NO: 592440 - DNA, 2598 bp, Homo sapiens
  misc_feature (18)..(18): n is a, c, g, or t
  misc_feature (44)..(44): n is a, c, g, or t
  misc_feature (57)..(57): n is a, c, g, or t
  misc_feature (66)..(66): n is a, c, g, or t
  misc_feature (72)..(72): n is a, c, g, or t
  misc_feature (117)..(117): n is a, c, g, or t
  misc_feature (123)..(123): n is a, c, g, or t
  misc_feature (161)..(161): n is a, c, g, or t
  misc_feature (233)..(233): n is a, c, g, or t
ttttccccttccttaaanaaaattggaaactgggggcaaggggncaagaaacgcctnttcccaaantctctncccccaaacctctctgcgcccaattgccaaaagccctccaacaanaccctnccaagggccccaaacaagctggttgttagggggtccanggcccctcccatgcccggggaacggaggtgcaaccgtgaaccacagttggtgggggcctgaaccgctggcgnccgggctctggcagagcccctgagatcctgtggggtcctgaccactgcactgggtttttcaagatgaccaggaattcgtgaggctgggtggtgactccgtgggggggcggagacatggccatccagaggtcggggaccaaggacaccgtgagcagaatagccagtctctcctcactctcccccaggcaaggagagcacaggaaggggttgcaggaactcatggtccagttgccagagagccccccacaacccctgcagacccagagctggctcagcggaggtgccagcccagccttaggtgcgaggcttggcctcctttccagttagggcaggccgccaggcccggccacgtctgcatacacagtcctggctgtagtcctggcctggaggggtgtcctggttgctgggtgatctatgcagggacgggaatgaggggcaggggtcttggggtgtgtcccgccttcccctcccccgtcggtgccacctactcagtgcaccgggtgggctttttggattccctttgtccagccctgacctccccacagccatcgggagggccccccagagcgcatctggaggaggagggggcgcaatgaggcagggaaggtcggcgccctgcagctgcctccgctgcgtgtggagcgaagggagttctcaccttgcgaagtctcatctgtcaggctttcctccgggtgggcgctgtccgtcctgctgcccgacgtgcacgacagcgtcctctaccgcctgtgcctgcagccgctgccgctgcgcgctgggcccgccgccgccgcgccagagacccccgagccggccgagtgcgtggagttcaccgccgagccggccggcatgcaggacatcgtggtggccatgacggcggtgggcggctccatctgcgtcatgctggtggtcatctgcctgctggtggcctacatcaccgagaacctcatgcgcccggccctcgcgcgccccggcctgcgcagacacccctgaagcgcgaggccgcccgcccatctttgcgccacctgcctgagggcgcctgagctcccaggtcctccgcccgctctcctctcctcattcctgctgcctccttaagatccccgcggaggaggacctgccggcgacggctccggcactttggcatcatcacacgccctttccagccgggcgtcagactcccagactctggccccgtgagtttggcccgcttgcgttgcctattgctgctgggtagtagccgttgccggctactctcaaggatctctcgctccagctcctccagtagcgtgcggcttgtgatagatggccggcccatgtggcagtggacgcccctgtccgagcaagagccatgggcactccggctcaccccgcacctccatcctgtgccgaattgtcccagacagaccgtcgccattgctcggtcactgtgctttgcaggcctggggcgcagctctccaagcctgtcctgccccgccccaccccactgggcttaggttagcttcgtgccttagtatctcgggcccactgcaggagccaacaccctctgctgtccagggggggtctgtggccctaagattggccggcctctccatgcatctggccagcgtccccttggagacaccttcaccctcaagcgctgcagaagcatgaggtgagggcctgcagcgctctgtaccgtttagggtgttggaccagccgggagcctggcaggcctggcccagcggccagggtgagtgttctcagaccccgggcagctggtggttctccagggccaggtaccccttttgtgtgtgcgacctctgactaggtccctgtgggaatggggcagatggcggccatcaccactgggtcccagggcagaagcttagataccggccttgagcagcccgaccttccaccgctgcctggatcccaagcctcagccgacccaggggaccttggtggcaacggtgtgactgacagcaccacccctagcctttgcatgcccaggggtcgagagccagtatccggcccagacaatgccacccgccatggaagaaaagctgaccctgcccacctgctgcagacccgggccccgggccgaggttgctttctgtgacgaccgcctggtgacgctggacaccaggagggttatggcactgccctcccctcctggagcccctggcactgaccacctggacttgacctgactcctggtcactggccaaacacccatcctcaccccagccaccccgggccctggctggtgccgtgtgacacctgtagcccacctgtgtgtctttgctccgcccacccctgcgtggcgccggtcaggcgcaaacctggcgccagtgtctaaatgtccatcattctcagaccaaaaaaaaaa

SEQ ID NO: 592441 - DNA, 375 bp, Homo sapiens
tcactatcagatcacaccaggatacaccaccactagcaggcgctagagctatatagtaggagggggcagtccgggtatggtaggacgaatgcctaagctaagtactagaagaactatcccgacggatgtcatcaagtgcagggcagccagcaaaagaggggtccacaccttcagggagactgatacccgcaaggggatcttcttcttcactgcttgttgaaggcaacggctcttctaaggattcctcgggaatctgctccagagatggccacggcagaatctctggtggaagagctctcacaggatgcatgtggggagctgtcctcagtgtggctgagcagatacccctgacccatcactcctgccttgcacttc

SEQ ID NO: 592442 - DNA, 270 bp, Homo sapiens
tgtgtggtcgatctaaggatccggaagatctggtgtgatgatgctgcaggcatgtcaagtagaatacatgtgaagaggagtgcatcaagagcagcaatcttgacattctcagacttgttccagacaagatggtgcctgacagctgcacataagcaaagcttcatcagggttgatgctcttatccagttctttccgattgacgacgtcttggagaagcttctgaatcttgcggatacgagtagaacccaacaaccaggacaatatcatgaa

SEQ ID NO: 592443 - DNA, 282 bp, Homo sapiens
  misc_feature (18)..(18): n is a, c, g, or t
  misc_feature (68)..(69): n is a, c, g, or t
  misc_feature (72)..(72): n is a, c, g, or t
  misc_feature (90)..(90): n is a, c, g, or t
aaaaaggtaaatttaatngatataggagtgtgtacatcatctcctgtttacctgacaaagccaatgcnnggntgtgctcaagactttcgnaattctcacattctccatgtttctgggttctacagtgtttgtacagttttgctactcattgatttcctaaaatccttaaggtcttgagttcatctggtctgctgatttcacgggtcttagggaaacagtgttctctttaggactttccatgccatgaggggccctggaagggatagcctcaacaactttccc

SEQ ID NO: 592444 - DNA, 230 bp, Homo sapiens
tcgagctgtgcagttttagcgggtacaagatctaccccgacacggaggcgctacgcaggaaccacgggaaggtgtttccagttcttaatgcgagatgcgagtcggcttttcctttccagagagaattctctcgcagatataactctggctctctctctacagagagggagcgcacaaagagggcacactcggagagatttacaaagagaagagcacgccgcgcagcagac

SEQ ID NO: 592445 - DNA, 403 bp, Homo sapiens
ctgcacttcatcttgcaaagcgctatttcaggcacatcgattggaatacaggaagtagcccgcacctgccagtgagctcgccattcaggattggaagagtgagcagggcatcttgcgaaatcattgtgtgtcttcaggagagatgtgcagatgtcttgtaacaactaattataatgcaaattagggctacattgtaatctgctttgttaatgaaaatgataaaacagaatattgacaagctaggacacctgtggtatctttaattgtatctccttcagaagtttgcttcttatggtataataaagtatggaagaatattgagtatatgtttactctgggcctgggagaacttaactttctagagcagtttgttgacttgtgtgcaatggggagaggtaccatg

SEQ ID NO: 592446 - DNA, 598 bp, Homo sapiens
gtgctggacctccgggtagcgattgcagtagcctctgccgaccctggcttgaccgggccccgctgtgaccagtgccagctgaggctactgcaatcgctacccggtgtgcgtggcctgccacccttgcgtccagacctactgactgcggaccgtccgggagcaggcccgtagcgctttggtagactccgcaatgccacctgccagcactgtaggtcacgggcactgggcatggaggaccgaggcctggcgtccctggatcctaggatgcaaagagtaagattgacgcatgatccagaagacagcttctcagacaaggaccaccgaacgtcacaagagccaggagggtggctacaggtggaccagatgccattcctctaccctcagcgcgaaactactccaggggccatgcagaagactgagattcatgcgcccctgggaagcgagcgaagaacaatgtggtcgcactatcccgcagaaggaccccttgggaggaagtacttagaccgaggacaagccttttccgactggggtcgtcgcctatgaactaattgttagtcacagaggtgaacgcacgagtacgacagagtatggaacaaaa

SEQ ID NO: 592447 - DNA, 373 bp, Homo sapiens
tctttagactaataggtgaaaagccttagcggggtcgttctatggggaaaccaccaccgtcactgtaaccacaacaaatcaacgactgctcagccgctcagagaatacaaagcacttgtaactgaaatgatatcaatagctcacaacaggaatatacagtgactacctgccccaagtactcttgggtctggcagaggaatacacagggggatactcagcaaatctgacagccaggatggtacagtcccaacaaaatcagaacagacattgagagttatcaggacaaacactagccatcagcaactccagaggctgactcaggaactatggctacctatcagccccgccttcagtaccgtgcaccatgcactaa

SEQ ID NO: 592448 - DNA, 951 bp, Homo sapiens
  misc_feature (155)..(155): n is a, c, g, or t
  misc_feature (682)..(682): n is a, c, g, or t
gcacagaaggagacgtggaatcggaagagaagggatacttcgaggacgttagaaagaagtcacaaatcgttcaaaaggtggtagtaggagagatacacaaaggaatctacataggattaagcaactgcgccgtgtcccggagcgagaaagcaggntcgtagtagtcaatgagtaggtgaagacgattctaggcttaaaagcagtctttcaagggaaaggtagaatggggaggaagccggaaagagtgcgagtgaacaggtatgaaggatgatgagcgtggggtgacatgggaagaaatagacgcgagaggctattacggtgtggagggcctagtgtcttgttgggggagacgagcagaggcatgttccgtggggagttagaaaagagacgggattaagcgtttgtccgtgtgcctacagggagggatgtggtctggcccctggaagatgcacatttccgcctagtggtatggtgaacaatagggactcgttttagtctgcgcaaagaggaattgaactatgcacccggtgtgttgtggctaatgtgacgcagacgggaaccagttgcctgtttgggtaaccttttggtgtcgtgggggattaaaagggtgtattgcgcgatttacgaaagccacgggttggtgaatttctaattaattgcgaagaggaaactcttaactgcnttgaagggggtgtggtcacaagaacaggctagatggcgtgagaaaacaagaggtgggaattagaggtaaagaggttataacatggagatcaagaggaagtttaaaaggcaagttcccagtggtggttggcaattccatttggtctagttaaaaggagttaaggtgggcttaattaaggcggttctggtgtcagcggtaagagggaaaaggttccgggggtaaatttgtttcttgcaaattaggggtgcaaaggatttccttttgtaaac

SEQ ID NO: 592449 - DNA, 122 bp, Homo sapiens
cgtaacccacggtgccaccccttccgagggcaccaacaccagcgggggctagttgtgggttgtagggaagaccttctcccgtgcttgcaaggagctcaccatgcctttggggggggatctct

SEQ ID NO: 592450 - DNA, 173 bp, Homo sapiens
gtgtgttctgaggatcccgtacacttgaaaccgtaagacaaagaacaggtaaagagggcacaacacacttctaccgtttataccaaaccaaaatcatgaaattcaaaatccaagtatcaaaaaattccagccaagtcaaaaccaaaaccaaagtatccagcaattcaaggggt

SEQ ID NO: 592451 - DNA, 318 bp, Homo sapiens
gaactgtgaaagggggaagaggacaatggatctgtgtgttgactgtggacacattggtgatcttggagggggatatgagcaagcagcatctatcgccgccaatccagggacagcagagaattatggatatacagaagtaaactgggcttgatacaatggtcacgagacatgtgtataactgcttttagaacaggaagtttttcagaaaacggaaggaaatgcttttagtccattggattgtgccgtgattaatgacaataaaagtgttgttgagatgttaattgatacattaagtgcacacattgtgaacgccacaga

SEQ ID NO: 592452 - DNA, 417 bp, Homo sapiens
gctttctttttgaggaagacgctggtctgtaaggggctgaggatttttggtccgcacgctcctgctccttgactcaccagctgttcgctctcgccgagggaacaagtcggtcaggaagccccgctgcgcaaacagccattggcttttcacacgggatacccggtgatataaagcaccctgttgggatgcccggacggtggagccaagtttcaacgctgaaatttcggaattcacgccttaaacaaagccctgcaaacgttacacacattccccttggggaacacaccagcggttgcttgttgcctttgcacccttggcattcacggacggctgcctgcccaaaaccatgcacccccgggaatattctttccaaaaggttggcacaactggtggaccccaaaggttccggcaaacatg

SEQ ID NO: 592453 - DNA, 181 bp, Homo sapiens
aaaaaaaaaaaaaaaaaaaggttttgaaaaataagcccccctgccttttgggaccccagcattttttattttcccccccatatcccggggagaacccgggtttcaagctttttggccatgaaaggggtccccttttagaggtcatgaggttgaggctaataacccttttttccaggaccca

SEQ ID NO: 592454 - DNA, 1216 bp, Homo sapiens
  misc_feature (22)..(22): n is a, c, g, or t
  misc_feature (197)..(197): n is a, c, g, or t
  misc_feature (235)..(235): n is a, c, g, or t
  misc_feature (280)..(280): n is a, c, g, or t
  misc_feature (706)..(706): n is a, c, g, or t
  misc_feature (737)..(737): n is a, c, g, or t
  misc_feature (800)..(800): n is a, c, g, or t
  misc_feature (809)..(809): n is a, c, g, or t
  misc_feature (834)..(834): n is a, c, g, or t
  misc_feature (843)..(843): n is a, c, g, or t
  misc_feature (896)..(896): n is a, c, g, or t
  misc_feature (945)..(945): n is a, c, g, or t
  misc_feature (994)..(994): n is a, c, g, or t
  misc_feature (1078)..(1078): n is a, c, g, or t
  misc_feature (1190)..(1190): n is a, c, g, or t
aggaccacaaacaatttcttanctccccccgccaataccgcccttcacggccccgcgcgcccgccgcgccccttcgcgatcagggaggagaagggagaaggagcctagctatatctcgtagaatgatgattataacagaacgctaattaataaggaccagaacttatactgaaaaaccgatcatacgtatcgataanacaaaataagacataagtagtaccattcttcatgcggnagcgaatcggggggggggagcgagcaacacatgcgcgtcccgccncccctctcctgctacaatcaaggagagaatacgcccacacatcacagcccacaatcacatgtacttcaaatcccgtccagcctcccggaggaggaatcgagaaggaagaagatagaagacgtgtagattacaaacccacatgcaggacgtagcacgcataagccttccacgacgcagccgtgctattcgtggtccaccacagcacgcggtacgcggaagtcgggcgcagcgaacgacacagggcagtcgctgagcctaacagtctgttctccgtctcctatcactaagataccgcaagaccgtacactacacaacatcgaatgtaaggtaaccaatacgcagacggccatccgtagactaaagtacgcgcgcatacgatgagtgtgtgcgaaagagaacgcgcacagcaggaatgagacctaatgncgaagcaacggtcaccgagagctcgttaccnctcgcctctctctgtcacgcgctccacacgcatacactcatacgtcagctggattgcaaccanccacgtggntcgcgctgcgcgcatagcgacgcgnagcgtgtgnatagcataagacaacgatgtgaacgagcgcggtctcgctagtacactcccttncacgctcctatgcagaagacgatgacatagcgacatcgtgcacgtaaanacgacgtctcatctacagcagaacacgcacagacgcacactcgcgctcncacctcctcctgacctaacatacctcggacgctcatctcctgaatcgtacgcgaacacgtacgtgcatcgcacgagcgagatangtcgtcgaggtatagagcttgcgcacttacgtaccacactatccgcctgacacgcgcgcccgccatcgcgatactgatctactatcgactaatattcgcaatgccgactatntatgacgcactcctccgcgctatcgg

SEQ ID NO: 592455 - DNA, 143 bp, Homo sapiens
atacaaagcactatgaacatgtgcctaactcatgctattcttatttgaatagattgctctttggtcccagctcatgttcatcactcccttcaaatgcctattcttcctattatatcttcttgactgatgctctcctctgttga

SEQ ID NO: 592456 - DNA, 198 bp, Homo sapiens
atatcgataataactagtatggagataaggggtagtaggtgtgcctatgagataagaagtgggctagggtatttttaatcttagagcgcaagcctatcatcactgcgcccgctcatacggggcacggccgtggctcggtttatagacagttgggtggttggtgtcaatgagtgaggcaggagatccgagaaggtaagt

SEQ ID NO: 592457 - DNA, 419 bp, Homo sapiens
  misc_feature (194)..(194): n is a, c, g, or t
gaggattttcgtcacccttactgaaaccccctggggctttcatcatcagaggtcaaattattatgataactattccattaagtttgccaaacatttgtcgtggttaccagtgcagcctgtcaaattttgctatttgacccagctttggaaaaatttagttcttggtttttccgttttggattaaaaagacggtnccagttttatttggctgtttaaagccaaattcagctatttaattatggtttcatggcccctgttgaccaatgtccagggtatggggggcttccctgtcccctttaaagcattgcttccaggttttttgttttttaaaatgctgggctgtaaaaaactgtcaaacttgctatttcctgggacagggtagtttttcccctttcatttgaataaaagcagggccccca

SEQ ID NO: 592458 - DNA, 385 bp, Homo sapiens
  misc_feature (62)..(62): n is a, c, g, or t
  misc_feature (323)..(323): n is a, c, g, or t
  misc_feature (335)..(335): n is a, c, g, or t
taagaaacactataggggaggaagtatgcatatacatgtccatatgtttattataaattttnctgatacgaaagatatgtggcacacagtctataagtaacaatgaaatatacagtattctttatggcaaattccatatagtgaattggttcccatggaattctttttttttttttttttgagacagagtctcgctctgtcacccaggctggagtgcagtggcgcaatctcggatctcggatcttggctcactgcaacctctgcctcctgggtggacgccattctcctgcctcagcctcccgagtggctgggactacaggcgnccgccagcacgnccggctaattttttggtattttttagtaggaaaccatgggtttcactggt

SEQ ID NO: 592459 - DNA, 1514 bp, Homo sapiens
ggctccctgagccgcctccccaccatcaccatggccagaggcttctatatttccaaagtccctggagcatacctagaagacacctacctgagacagaacaaccaaaacacaaacacacacacgatacaagaaaaacacccaaaaaaaaaacaaaaacaccaacaacacccccataaccaccaccaccccaaccaccacaaccaccaccaaccccgcctcgggcagcaccgttggaccaggagtaaagcgtgggaatctgttaccggctccccgaacacgtctattggtagtcccatattagatcctagatccatgatgaagatctgtcttatatatgacctgtttagtcctacatctctttcctaagtatatctgttaatgttctcaagttatctattgttttataagtagttcgagccttgtatttcatgttttcaggttgtgcgtctctgatttggttgtattgtttttattgaatatctgtacagtagcatgtctatagctccatcatatccttagtaaagttcttactatagcttaattcatctttttttacttgtttctttattttatgtgttctatcgtgattagtttaattattctcctatattcattatttgttaattaaattgtgtatatatcttgatcctctaatgttttctctcttcttgcttttgtgtttattgtattcttatatttatctttaatgatttcctgaattttttgtttttatgtctctttgatgttctagtgttttgaatctctataatttaatattgtatcgttcttttactatttaaatatctttccttttaatttttattatatgttatatctattctctcatttttatatagtatttaatatttttatcttatttcttgaatgttatcctgatgtttttgattatgtttatttttatgtttgttagtatttcgttaattgtgttgatgtatcttagttctagtttcctgttcttagttgtttgatgtttagtctgttaataatgtgatttattaatttataggttatgtgtcttttgttaatattttgttttatatgtatttattatagttccatgttgtgtagtctatttcgtttttatagtaattatctattttatttctttagtatcttatttgactgtagtatttctgtcctgattgttagtatagttatatctctgatttgctcttcttaagtaatagtctttatgtcgttatatgtagatatagttcctcttaatatttcttctattctattgattatcatatatctgctaatgattgttgatttgtcatattgattagtgatacgtagttcatgtctcttgatatgtatgactcctatttcttcgttattttgtatacttcattctcttgtattatgtacatgttttgctgctatattattttcggtatttctcattaagctatgttctcttttgttatgatgattttcgtctatattcttttttctctcaattttaggtttttttgtaatattaagtcttc

SEQ ID NO: 592460 - DNA, 882 bp, Homo sapiens
tgccagtaccgtgttggtatgcgtgagtgccggttcatgaggaaggttcaagtgaagtagttcgttaggaggctgagcgatatgggtgctgtgattcgccgctagtaactttcgttagaattgttaccctatctaccgcgagctaatactaattatgtggtgtactcgatttctctactatgtcaggagcgatagggccctccgacgggattgccaactagcctgtcgtgatgcgggaccagccggtctttggaccgccggagctcaggttccaggtggaggccacggttggcaaaattcagctgcgaagcttacttggaggtgacagatgtcagaagtgtatgacacagtctaatttacaatgcgactacttatactgtgggtctgcgatcgccttaagaaggcgacgcttcctcgcagacactggacctgtacctaccaaagagactgctttcccattgggaattgcttggtaaagacttgagtagtttacaatctatgatgatgatgatgtgtctccattcgctggaaggtcttgagagaaagaccacagaaataaggcacaggcctgatcaacctgctgatgaacctgcagaaaaggctgatgaaccaataggaacattaagtgataagccacgtctatgatatgtattaatcaaatatgtaagaatactggctccacatactgatgacaataatgtatactttgaaccgaaaggtgactgagtggtggatatgctatgttttaggaatcagtccagatgtgagttttttccaagcaacgtcacataaatacctatataattggaactacattggtattctttgaaagggtctgtataatcattttctagaaagtatgggtatctatactaaggttta

SEQ ID NO: 592461 - DNA, 151 bp, Homo sapiens
gtccccgcgtcgtggtgcggggtcacgggtgtacgcgctgtcgccgctttcccgatgttttccgacatcagcgaacagctgaagagcttcatcttttccaatttcgtgccggccgccggcaacgtcatacagaactaccgggaacagttcg

SEQ ID NO: 592462 - DNA, 652 bp, Homo sapiens
  misc_feature (24)..(24): n is a, c, g, or t
  misc_feature (632)..(632): n is a, c, g, or t
gagggttttaaagattattggtanaatacaatgtctttaaaatggaaacatgtggtctaaattacgttccaatattaggtttgctgaatgctttaaggtcataaactgcttatttggcttttgaaaattgtttaacttgcctgctttccagctaggtaaggcctgggaacatgtggagttggccatgcccctagctatgctgcaaacagtcaaaccttttcagaacataacttaccaggttttacattaaagttaaaattgctaagagtcaccattgtaacatgcaattaagactactagaaacggttttacatgcacggtgtgtaagaatagtagaatgtatgtctctgtgtgtgttttgtaaaaggtttttacttctttaaaatttctgagtcattattttggcaaaataaataatctggaattccaaaatcaaacttcagtttcaaaattgtctttcctaatgcctggctttctggatggatcagagggcccctgaaaacatccagaaaggaggtaaacaggattatttgatgtgtttaggtacatgggattgccaaaatgatgttcagtcttctttaagttttttttgtgaataatactaatatatgttccaaaattgtatgggattnctaaaatagtacatgctatc

SEQ ID NO: 592463 - DNA, 140 bp, Homo sapiens
gcaggagttctgggcagtcactatacacttgatcctgactggccacactgcctgcctctctcctttacttcctcatccccacctggtcccatcccacgcctgtctcctcctgaccgctgaccacccatcctcttacgagt

SEQ ID NO: 592464 - DNA, 119 bp, Homo sapiens
acgagggctagcctcacagatggggtacctgagagatcacatggtgtgcacaagtacgtggggtgacaggcaataaaattttaagaattcttaagtctgggggactgcgaccaggcgta

SEQ ID NO: 592465 - DNA, 670 bp, Homo sapiens
gatgcggttccgggcccccctgctatatgagcagtacatcgtggcagtatctcacccaggaggagctcagtgcccgcaccccaacccaccagccccccaagcccgggtcccccgggagacctgcttgcccgctctccaacttgcttgctccatgtcctactgaggatgctgggagctacatgcagctgtcttgctccaacatgcaggaggaggaggagtgcctgcttggatggaatgatggaagaggatggatggacatgtgactgatggaagaaccagaggtcatggcaacggactctggaggccttggtgttcccgactcgcgagcgagaggcttgatcctgcgacgaggacgttcaccagccgcatgcaccaagcgcttcctagatggcaaggacggggactttgactacatgcacagtatgacgacaaaccccgacttcgacaacctcgacatcgtgcacgggatgaggaggagaggtattgatgaggaagaactgaggatgcgccagccagagtgatggggactgatggcgcacccttcccaccgtctgccccatccccatccccaacaaggctagctgattccaggcctgctcagtgacccatttctctaagggggacatcatgggcaggtgcccacaaaccaaaaaaaccaacaatataatgg

SEQ ID NO: 592466 - DNA, 230 bp, Homo sapiens
ccccatttttttcccccccccccccccctttgggcaggggggatgtcctacaggaaatgttttcctctgtcccccccttcccccccctttcaaaccaggccccttcttgggggaccaatttttaccgggccgggggaccgaaaaacccccctgctctggggaaaccgcccccttttactttaatttttttaactggacaaaaaaaaaaacccggatttttattttttcca

SEQ ID NO: 592467 - DNA, 489 bp, Homo sapiens
  misc_feature (2)..(2): n is a, c, g, or t
  misc_feature (61)..(61): n is a, c, g, or t
  misc_feature (72)..(72): n is a, c, g, or t
  misc_feature (101)..(104): n is a, c, g, or t
  misc_feature (108)..(108): n is a, c, g, or t
  misc_feature (112)..(113): n is a, c, g, or t
  misc_feature (124)..(124): n is a, c, g, or t
  misc_feature (130)..(130): n is a, c, g, or t
  misc_feature (178)..(179): n is a, c, g, or t
  misc_feature (219)..(219): n is a, c, g, or t
  misc_feature (251)..(251): n is a, c, g, or t
  misc_feature (260)..(260): n is a, c, g, or t
  misc_feature (263)..(263): n is a, c, g, or t
  misc_feature (270)..(271): n is a, c, g, or t
  misc_feature (294)..(294): n is a, c, g, or t
  misc_feature (296)..(296): n is a, c, g, or t
  misc_feature (300)..(300): n is a, c, g, or t
  misc_feature (306)..(306): n is a, c, g, or t
  misc_feature (315)..(316): n is a, c, g, or t
  misc_feature (325)..(325): n is a, c, g, or t
  misc_feature (328)..(328): n is a, c, g, or t
  misc_feature (338)..(338): n is a, c, g, or t
  misc_feature (343)..(343): n is a, c, g, or t
  misc_feature (383)..(383): n is a, c, g, or t
  misc_feature (440)..(440): n is a, c, g, or t
tntacgttcaatattaccaaagttcaatataataaaaaatataaataaacaaaaaaacatnaaaaaaaaaanaaaaaaaaaaaatgcaaataaataaaaannnnaganaganntctcccagatncccctnactcaggacccttccccgcagcttggcagtggccactcaaggcttggnnacaggcaaggcttggctcaatatcctgtcaggggcaaaanccaagctgtctgggagggtcgggggatgcagnaaagatgtntgngaatcannaaaccattgctgcatttggggtnanaagntgaatntgccaagcnngagggagcnctnaggcctcatnctcantgggggtcctattacttgaagatatatctaaatttcaacncccaagcctcctcttccaacaataaagaagccatatctaaaaaaggaaagtcaaaanattacctcaacctcactcaatgagctccacgtatttgcagggaacatac

SEQ ID NO: 592468 - DNA, 120 bp, Homo sapiens
cacggcactagtaaggatagcagcgggatacgggcggcgggagctaggggaacaggcataggacgtattacgggcaagcagacctgactaggcggacgcaccgcgctatacggcctagaa

SEQ ID NO: 592469 - DNA, 180 bp, Homo sapiens
ctcacgatcgtgcccacatctcacgcactgtctacccaacacaggcatgctcataaggaacggttacaaaaacgtacaacggcactcggcaaatcttaccccgcctgtataccagaacacatcacctctagacatcaccagatattagacggcaccgcactgcccacgtgacacactgtt

SEQ ID NO: 592470 - DNA, 792 bp, Homo sapiens
tctcattacctttttgaaggggtctcaaaatcctgtgacaaatttcgggccaagttgttcccactaaaaagtactgatttaaaacctaataatttaaaatggccaaacccaaaaaagaaacaccaaaggggctccacaaaacatttctccttttccttctgaaggttcaacgaggcatggtatcatgacccagctctttatactactaaacttaaagggccaatgtgacacaaacagttctgagaccgtgcttcacacgcacgtgataaacgaggggggcggtggccaggtataagggataataatccatctaagccttcctgagcttcacggggcaaactggcgcgaccatggcacagcgtccagcagcctgcatggccccacggcttcggagtgacacccaccagcagacgtgcaggcgcctcaatactcaccgacccgagcaaaggcgacccaaagggggaatagtcgtgaaaagccctcctaaaaccccccagtggacactggcacaggaacccagtgtctcagacgccatgggcagagcaactcccccaagaacaatccacaacaaatatcaagagcgcccatactacagacacagtattgtacacccaagaaccagcgcggatccacactgctttccccgtaacagagacagccaacacctgagcaatagcatcctgtaaagccccagtgcggcaaaatccaaacacaagggggaataaacccaggcgcccaaaatggcgcccgggcaaccggccccaaggaaaacacactccgaagcaacgggac

SEQ ID NO: 592471 - DNA, 148 bp, Homo sapiens
ttccaaaaggggggttttttttaggccccccttttcttttccccctaatttatttgagttcttactttttgaggcggggaaaactccctgttaaataatgccccccttggttatgcttttattaatttttttggcccccgttgcttta

SEQ ID NO: 592472 - DNA, 206 bp, Homo sapiens
  misc_feature (13)..(13): n is a, c, g, or t
  misc_feature (37)..(37): n is a, c, g, or t
  misc_feature (59)..(59): n is a, c, g, or t
  misc_feature (83)..(83): n is a, c, g, or t
  misc_feature (154)..(154): n is a, c, g, or t
  misc_feature (180)..(180): n is a, c, g, or t
tccctccttcctntccttcctttcccttccttcctcnccctttctctctctttctctcntctttcccttcctttccttccctntctttccttttaagacaaggtctcactctcttgcctaggtaggagtgcagtgatgtgatgatagccactgnaacctccagctcctgggctcaagtgntcctcctgcctcaacttcctgagtag

SEQ ID NO: 592473 - DNA, 254 bp, Homo sapiens
gcatgcagtgacgatagtgtgtcgatctgcgctagttgtgccactactggaaggacgaaagcaggaacacaacagggaactgccgccgcctaccaggaaatcgatgtgaactggtctacaaattatgcagcacatactaacgaagaaaggacaatgctgaattcaaattacaattaaaaggcagtcctccaggcatctttcaaagctacgccctagcatagcaaagtccagtctcaggagcagtaatcaagaga

SEQ ID NO: 592474 - DNA, 916 bp, Homo sapiens
agcggaaggagctgctcctcaaaagcccgggcggacggcggcgacggcgcgggttcctagcggcagcctcagctccaccaccatcccgtcaccctccccgcgcttcctctccgtcccctcgcgctcctagtccactctggtcgcagccggcgctgtcctccgccccccgtgagcctgccgcgccagaccctcgtcccagtactatggtgggacctgccgggccatcgttgcgccatctctcatcgacgctgcgcatcctagactcgtaactgatcgtgcccggtccttttacaacgtgtgtgagtgggcaagcgtcttcgagcctaggaacctgcaacgcatcaacgctggctcaccgagtctcctcctacaaggtctgacggtgaagattaagccctagcgacgctcgcaggtctgcagcaatgatttccattggctggtgtgcttgtcccacttggcaactgaagtctagcagagcctgatggggacagagttgtatatacgggtacatatgacacagaaggtgtgagcccaacgaagaagtggagaacggcaacccatccagatcacctatgccgttcacagacattgggaccttcgagacagtgtggcaagtcaagttctacaattaccacaagcgggatcactgccagtggggaagccccttctctgtcattgagtatgaatgcaagcccaacgagacacgcagatctgatgtgggtgaacaaggagtcctgcctctgaaagtggctctttctgatgctactggacaatcttttcagaacatctactgtttcagataaccagcgcaggccttaaacaaggcatgccacaaccattgctgttccccatctggtactaatgacctactaggcctggtattttgaaaagtgtattccctctgacacatatccta

SEQ ID NO: 592475 - DNA, 267 bp, Homo sapiens
tacttggatggtttggaatggattaccattccagttctggcacttatacccctctgggtggtttgctttttacaccttcctgggaatcccattttcctaaaaaataacgacattttcagatctggaggagcctacatctcaatgtctgtgggttataaattctggacaggatacaatagctaaacttaatgtaggcaaatgcagagacatttaatctgacatgttgacctctacactgagactatactggcatagtggctaaaacaa

SEQ ID NO: 592476 - DNA, 1056 bp, Homo sapiens
  misc_feature (222)..(222): n is a, c, g, or t
cataaacaaaatctaccttacttgaggaattaggtaggtaaggaatgatcacattggagtttgggattaaaaacaccaaaaaaaaaaaaaatgcattgtggttctctctacactggctaaaaaatattggctctacactgtaagttttaaacgttacgttttctgtattgaattgtacgtgtgggattgtgagttagcattgtgtgctgttgagttggcccncacaggttacatttcacccttcttagttgcagccccatcagtcttaatgaaggaaaataaaaacaaacacaaagccttaagctcttggagttaccttccttttaccaaattgagcattggttctaaccaccgtggagccttgggcctacattgtggaaacaaggccccttcctgcccttcgtgttccattctctttagagcattacctttcattccactccagtgctcagcacgttcctcaattcccaatgcgaacaatttagttgtggcttagaaaaccacttttgcttgctaatttttctaacacttctgagacctgtggtttgggttcaccaagatttttgtgccaccaaatctcgtgttaaagaagtgccgagaactgtgggccttattataaattttttctcacagattgaaaattaagcgccctttgacctttttcctcttgtgttctcgtggaggacatgtgttcaggctgagtgagtctactataattaaaaagggctcttggccatttttgtgttcaccttattccaccttacttgctccgattacgcccagaaaatttcttcataggtgaatcgtgaaagcaatgtgttgacttgaaggacccaggtttgaacggttctacttgttgtttggggaccaagttttgccccttttaattatttttctaacaaatggggcaacaacataggtatcaacacaaatataaataggcccctagaattaggtttttaatggccccaaaacacgataacacatacacacatcaaaataacagataaataaacacaacaacaaatggcgacggcccccatcataaaagatacc

SEQ ID NO: 592477 - DNA, 315 bp, Homo sapiens
gtagatcgatgaggaacagcacactgcaccacttctctgtcatagcaccttcagggatctgtgcaggactcacatttcatgctcaaggaacaaactcattgtttgagtcaggagaatattgcctttctgtactagatctttacctcttctgaaaggttctttacagttaaccaaagtgaaatgtgaacaggaagctagtgctcacagccgaatcagctctggatcaggttcctgccactggtgtggctggcctgtgtgggcctagtacaaatctgtatttatggagcttggatgccgccatctatttgatggtga

SEQ ID NO: 592478 - DNA, 333 bp, Homo sapiens
  misc_feature (333)..(333): n is a, c, g, or t
cttactttgcatagtttcatgagcactggccagaaagatagaaactgccattcaggcctatctgccatttagtaacagtatagccataaagcaaagcattactctggactttattgtcctgtttctatcgaattggactaacatgaatgtaggatactttagaaagcatgtaaagtactagaaacaatgaggtggcttcatttagagctcattctgagacctaaatttaaagggacaggcattacagacaacagagcgtcttcatacctaggagatttgcaaactctgaactaagggcttataagaacaagctgagcgtgttcattgtacatn

SEQ ID NO: 592479 - DNA, 729 bp, Homo sapiens
  misc_feature (1)..(1): n is a, c, g, or t
  misc_feature (254)..(254): n is a, c, g, or t
nggtgtttggctcaggtaggaaaagaggattctggggagtgaagagtcgggagaggagaagaaaatttgatagaaacacacggataatttctcagcggagagcggatatgccgaaagcacacatcgtaaaatgaaagtacgatcagaagaaaaataacagatagccatcataccaagagtcttgaaagaggaagtagacgcaagccgagcaccctaaagacgcagcgcgccgccatagtcgcagaaaacgagtngctcatgcaggagcgagaccagcccattcaaatgttcctttgtagggttataaaaaaaaaaatattcagtgagcgtatcaggtcaccaggtgcccgttacatatgagaaggcagaagcaacgaacgcatgtcactaacgaaaggccacatagcacaactgattgccccaaaagatcgcgaaagatctggagcaaaaaacaaatctggaagagaaaaaaacacacgtacacaaaaggtcaaacgcgttggttcgcccaagtcgaacagatcgccctgagaccaaaagttaaagaccgcgcctccacacctcgtagagccttgggtggacagacgaaacaaaggagtgccccagcccggggggaatcgacgtataaatacaaccaagcgcaggagggggagggcaagcatgacttttacaccaccccacaatgggttgcgcgtgataagatttttgaaaacatctccacacggatct

SEQ ID NO: 592480 - DNA, 409 bp, Homo sapiens
agtacggagatcagaactctggcttgttggacgtactggtaattcctgcaatttcaaccagaatattttcctaaataggtaaaaagctgaccttggaaccctgccagtgaaccttcctcactggtgctccactgatggcacgtggcacgcagaatccatggccacgatatccatggccaccgcttgccatcaccacctcgcgctggctgccgtttagacagtgcaatgcttaagaacaactgtatgcaatgctctcctggctcctcttctcagcccaggtagcagaccaggtcatggctctttcacggaagccattcctctctcataatcattgtagctcaggtgcctgtttaggagacggagctgtagtcaccacaatgattaatagagagtctccgtcgaactgggt

SEQ ID NO: 592481 - DNA, 620 bp, Homo sapiens
  misc_feature (52)..(52): n is a, c, g, or t
  misc_feature (90)..(90): n is a, c, g, or t
  misc_feature (102)..(102): n is a, c, g, or t
  misc_feature (112)..(112): n is a, c, g, or t
  misc_feature (123)..(123): n is a, c, g, or t
  misc_feature (134)..(134): n is a, c, g, or t
  misc_feature (171)..(171): n is a, c, g, or t
  misc_feature (181)..(181): n is a, c, g, or t
  misc_feature (204)..(205): n is a, c, g, or t
  misc_feature (210)..(210): n is a, c, g, or t
  misc_feature (244)..(244): n is a, c, g, or t
  misc_feature (259)..(259): n is a, c, g, or t
  misc_feature (261)..(261): n is a, c, g, or t
  misc_feature (269)..(269): n is a, c, g, or t
  misc_feature (281)..(281): n is a, c, g, or t
  misc_feature (295)..(295): n is a, c, g, or t
  misc_feature (335)..(335): n is a, c, g, or t
  misc_feature (337)..(337): n is a, c, g, or t
  misc_feature (351)..(351): n is a, c, g, or t
  misc_feature (358)..(358): n is a, c, g, or t
  misc_feature (373)..(373): n is a, c, g, or t
  misc_feature (391)..(391): n is a, c, g, or t
  misc_feature (394)..(394): n is a, c, g, or t
  misc_feature (436)..(436): n is a, c, g, or t
  misc_feature (454)..(455): n is a, c, g, or t
  misc_feature (500)..(500): n is a, c, g, or t
  misc_feature (504)..(504): n is a, c, g, or t
  misc_feature (538)..(538): n is a, c, g, or t
  misc_feature (597)..(597): n is a, c, g, or t
cgccctcctcgtacccgtcgcgcccccggagacccgatcccgccccgcgccncagtgccagaggcctgtatacccagcgggtgccgcttntccacccgaggnttccacctcnaacgagccatnttccacgctgnaggtagccagcccaggccaccccgctctcatgacgcnaaaggcggcngctatcagcacggtgcagcgctnnaagtncttcagcctgcgcggccctatgtgctgcaagcgngacctgcgccgcctncnataagacngtgtaccccatngagcggctggtggncgacaagctcattttccacaactctttcttctgctgcaanantcgtcacaccaagntcacgcntcgggcagctacgcngcgctgcacggggagttntantgaaaaccccacttccagaagctgtttaagagcaaaggcaantaagaagaggggtttggnngcaagcagcacaagcgacgctctgggcccacaaggaggtggaccncggnaccaagacggcctgaggcgtctgtaaccttccancccctctgcggaaggcctggagcgcggcaagcgcgggaaggtgggaagcgaggtccagnctggggcttgccgtggggggcca

SEQ ID NO: 592482 - DNA, 230 bp, Homo sapiens
aggctgcagagaagcagtctgagtcaaaactcaacagtagggaagctgacagtgcagccttcagtctgtggccgaagatctaagagcccctggcaaaacactggtgtaagtccaagagtccaaaagctgaagaacttggagtctgatattcaagggcagaaggcatccagcacaggggaaaagtgaaggccggcagactcaacacgtgttcttatcttattttccaactt

SEQ ID NO: 592483 - DNA, 319 bp, Homo sapiens
cgtcaagtaacagtaggcatagagaccaatattacagtaagcaaacacagagaccaacattacggtaggcaaacatagagaccaacattacagtaggcaaacatagagaccaacattacagtaggcaaacatagagaccaacattacagtaggcaaacatagagaccaacattacagtaggcaaacatagagaccaacattacagtgggcaaacatagagaccaacattacagtaggtaaacatagagaccaacattacagtaggtaaacatagagaccaacattacagtaggcaaacatagagattaacattacagta

SEQ ID NO: 592484 - DNA, 761 bp, Homo sapiens
  misc_feature (510)..(510): n is a, c, g, or t
  misc_feature (518)..(519): n is a, c, g, or t
  misc_feature (522)..(522): n is a, c, g, or t
  misc_feature (534)..(534): n is a, c, g, or t
  misc_feature (541)..(541): n is a, c, g, or t
  misc_feature (543)..(543): n is a, c, g, or t
tcttgttggtcgtctcttagaggatttctcccggaacctctgctcagcctggtgaaccacacaggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaatttcttcctcctctgctgggactcctttgcatggcagggcctcattctcacctctcgcaaagagggtctctttgtgtcantttttttnnatntaaaatgattgngcctctncnaaaaatcacgagatatgcacgacaacccggagacagggtcctttgggccccgtcgttttttacaagaccgttgttgtgcccgtattctcagaaggcgttactgaccgtcaggattgcgggcgtgagtgaccatcgcgtacacaggcctggaatccagttgggggctgtttcgaagacagaagatgatcggtgcatctggagcttgacccgcctggaag

SEQ ID NO: 592485 - DNA, 106 bp, Homo sapiens
gaggatccccacctcctaccccacgcaaacatatccttgtagatggagatactttaatttatcatggaaactctggtgaagttggctgctacgtgtgcttctcgac

SEQ ID NO: 592486 - DNA, 100 bp, Homo sapiens
tttctcactccccacgacccttcacggagacgctgacagagagcatgctggacagtgcagaactgaaagagcagattcaggcgttgatgagagagaacag

SEQ ID NO: 592487 - DNA, 823 bp, Homo sapiens
ctggcgttcatccagctgcagcaatgcgctcaggatctgctgcaacgccaagctcaacctcacctcgcgggcgctcgagccggcaggtaatgagatgtgcatacccgcccaacggcgtggagtgctacagctgtgtgggcctgagccgggaggcgtgccaggtacatcgccgccggtcgtgagctgctacaacgccagcgatcatgtctacgaagggctgctttcgacggcaactgtcaaccttgacggcagctaatgtgactgtgtccttgcctgtccggggcttgtgtccaggatgaattcctgcactcgggatggcagtaacaggcccagggtttcacgctcagtggctcctgttgccaggggtcccgctgtaactctgacctccggaacaagacctacttctcccctcgaaagtcccacccctttgttccgggctgccgccctccagagcccagcgatctgtggactcaaacacatctgtcaccacttctaccttcggcccagtgaggacccagatccagcagcaaacccatgccagcgccaatcagtcagactcctgagacagggagtagaacacgaggcctcccgggatgttggagcccaggttgactgatggcgccgttgggccacccaggaccgtggcgattcaggcagtatcctgcgaacaggggggccccatgagcccatagtaagggctgtgtggttcccaccagctggattgcagccttctgttggccgtgcctgtggtgtctacttgtgagcttctccactggaatttcctctcacctatctttgggctggttccctcttctatcacttg

SEQ ID NO: 592488 - DNA, 756 bp, Homo sapiens
ggcagtcatgatggacgtatgagagttgagccgctgtgagagcgatgccgggctcaggcgaggacgatgagagagggcggggcgggggccggatcccctctcagcgccgtgtgagcatccgcgggggcagcgccctcggggagccggccggctgcggcggtggcagcggcgggtcgctcgcctcctcttcgtcttttctaaccgtgcagcctcttcctcggcttctcctgaaaggggaaggtggaagccagtgggctcggtgcgggagccggctgaggagcgcgctcgtgctggtcggctggggacctcccggtcctggagcggggcgagggagaaccggcggtggccggcgtgcggcatggaggtatgcagctccagggagaggggtctgagtctgactgttcaaccatattccagcgctgggaacgccggagagttcggtctctcccccttctactgcctccaaacaacgagctgtgcggatggccggccggcaacatcacagggaccctggggccggtattcaaacctcccgtacagccagggcgcacagaccacaccgatgggcacgggacttccggaggacagccgggtcggatggcaagccgttaggaggattattcgacttcatccaacattcctgctgccggccgattcgagggctttggttgatgaggagaagcaggccagtcgtgcaaccactcagcaacagagaaaaaacaatacaggtggagcaaacaaggttgaaaagaggga

SEQ ID NO: 592489 - DNA, 1256 bp, Homo sapiens
  misc_feature (168)..(168): n is a, c, g, or t
  misc_feature (259)..(259): n is a, c, g, or t
  misc_feature (297)..(298): n is a, c, g, or t
  misc_feature (319)..(319): n is a, c, g, or t
  misc_feature (367)..(367): n is a, c, g, or t
  misc_feature (615)..(615): n is a, c, g, or t
  misc_feature (633)..(633): n is a, c, g, or t
  misc_feature (706)..(706): n is a, c, g, or t
  misc_feature (708)..(708): n is a, c, g, or t
caaagatgcagatctgaactctatgtttctaccccatgaaaatgggctttcttcggctgaaggagactatccccaacaggccttcacaggcatacccaggtcaagagaggatctacatttcagaatacctacaacttaaaggatatgcaggagaagcaatcagtttgncagtgggaaaataaaagaattttcctttgaaaaactcaaaaactctaaccatgcagcttacagaaagggaaggaaagttaagtctgactcntttaataggaggtcagttgatttggacttgctttgtgnncattataacaacgatgggacnccccatcctttggtttactgcggagttcctcagttgaggaaaaccttntctcatagaaactcactggatacgaacctgacttccatgtttcttcaaaacttttctgaagaagacttggttactcagatttggaaaaacataaaatagataatttttcttctgggacagacataaagatgtgcttggacatcttattgaaatgctccgaggatttaaagaaaatgcacagacatcataaaacaatgcataaagaaaaaatcaggagtagcatcagtgaaggaagtggtaatgatacnatttctagctctgaaacngtctatatgaatgtaatgaccaggttagcatcctatctgaaaaagttaccatttgaattcatgcagtctgggnantaatgaggctcatacattgtaacagacactgatcagtcaatatgccatagcattacaacttagtactcgcccttcttccctctaaggtgttgggtggctactgtaatcaacgcccgcatataatatgaatgatgttggtccgacgcgtcgtcagcgttcttgactcttaggacgatgtcgagaaaagcgtattgaactggctaaagatgacagagcgctaatgcgtaaggaagatggacaacgtagtgacagatccgattcgcaacacaactaccacacatagttccctctgattagtacactctgatgagagtaggaatgatcctacggaaactctaataacgccgtccaggggtccgaactctagcgagtgcacttcaagccactgaaaatcccttctaggatacaactgttttcctatgcgttggacgaacttttaagtgggaaaagcttcttgaatactttgacaagaaggaagtcaggaatggaataacagagaaagcacttgacgtaataaaagggagcaaaaaaacgaccagaacgagatg

SEQ ID NO: 592490 - DNA, 315 bp, Homo sapiens
aaacacccaatgaaccgatgccccccagattaatggtagacaccaaccgaaaatgaggctagacatctgatacacatagtaacacgtagggcacatgcacacacacatgcacgacatggggagtgtacacttactgacctacacgagcatcaggagtatcattaactctaaatgaatataaggttgaaccacatgaaatagctgacatttgcccacttaaaggtgataacatatagattcacctaacctcatagcatactgaactggacactcaggagcaaactaggaaaggctaccctgtaaggcagaagcata

SEQ ID NO: 592491 - DNA, 377 bp, Homo sapiens
gcttattaaaccagatttattctccacaagctgaagatacctgaggttacatgaggactggcattaaataatttataaatgtatttttgactgacagacttttatcataaggattcatgtgtttacaaaagcaaaatccaacctttccagagctagaaagtgggaaggtgcccggtctgcaagcacagccttgggggaggatgaggtcacataaacatctctgtctacactcttagaatgccctaagatgtatttaactccgcaatgacaagccttgtgggaaaacctgaaccgctgtgtggacttgcaaagtgcagatccaatcgcactccgtttcaaaattttcatttggaggcactgtagggcttctgaaagcg

SEQ ID NO: 592492 - DNA, 190 bp, Homo sapiens
  misc_feature (71)..(71): n is a, c, g, or t
tatctctcaatatagacccatgtttgcatttactcccaattgagttgtgctttgcctggagcaggatctgntacccttaagacaaaattttattcccccttgagccaaaggattccttacatccattgatagaccaaaattccagtcatcagaccttctgcctgctgtacagcctgctctatttttcctt

SEQ ID NO: 592493 - DNA, 213 bp, Homo sapiens
tgatgagctggaccccatgcaggagtgtagtgatgcatctcagttctcttcactccgcctccgggctcaggtgatctctcacctcagccccccaagtagctgggactacgagcacatgccaccaccctcgcctaatttttgtattttttgtagagatggggttttaccatgttggccaggctggtctcgaactcctgagctcaagcggtccac

SEQ ID NO: 592494 - DNA, 132 bp, Homo sapiens
tgtggaacctgcaccaacccccatcgctgccccagtaacagtgccagtggtatggaaacgaaagcagaagccaaagcacctaaggcaagaggctgccaagccaaaaggtcctatcaaaggtgtacccaaaaa

SEQ ID NO: 592495 - DNA, 329 bp, Homo sapiens
ttccatttcacctgctacttaacctgtttagaacacacaagtctaggccaggcgcggcgtctcacggctgtaatcccagcacgttgggaggctgaaggcgggtggatcacctgaagtcaggagtttgagaccagcctggtcaacatgatgaaaccccgtctctactaaaaatacaaaaattagctgggcgtggtgtgcgcgcctgcagtcccagctacttgggaggctgaggctggcggatcacgaggtcaggagatcgaggccatcctggctaacacggtgaaaccccatctctactaaaaatacaaaaaaattagccgggcttggtg

SEQ ID NO: 592496 - DNA, 148 bp, Homo sapiens
tcgagcgtgaaaaaatgacaagaagggtggagagaagttctgtacgaaagtcaaagaaatggtctgacccaaggcgcagtggtgtcgaggataatgggaagaggaggatgcaacatcactgcactacaggatgttactggtgcccata

SEQ ID NO: 592497 - DNA, 221 bp, Homo sapiens
  misc_feature (170)..(170): n is a, c, g, or t
cttaattgcggtgcctttccaacacaaaggtgttgtgatatctcaacccgggaaacaaggagctgaaagtggagtctggttcagccccgtgcagactcaaccagagcttaacgttgtctttcaaacaccctgaggctttctaaacaggcagtgcagacgttctctctggnggcacaaaggccctcgggtcctccccggttcccctggttcggatggcataa

SEQ ID NO: 592498 - DNA, 187 bp, Homo sapiens
accctaactgtagcacagaccttttgtcctccttctgccacctccacatcctggctacatccacttcaccagatttatcttcctacacatcagcaatcttacaacaattgcctcatcaaaaaccttccatgtggctggttacagtggctcatgcctgtaatcccaacgctttgggaggctgaagcag

SEQ ID NO: 592499 - DNA, 409 bp, Homo sapiens
ggactgagtactgagatatagagaacagtaccccaatcaacatagacccgggccggtagatacgggccgacactgaacgtcgtggtccagggacctgacagttaccaggctgaagatgagaagcagagggacaaggtgtcatccaagaattcacttgagtcctatgccttcaacatgaaagcaactgttgaagatgagaaacttcaaggcaagattaaggatgaggacaaacagaagattctggacaagtgtaatgaaattatcaacgggcttgataagaatcagacggctgagaaggaagaatctgaacatcaacagaaagagctggagaaagtatgcaaccccatcatcaccaagctgtaccagagtgcaggaggcatgccaggaggaatgcccgggggtaggaggt

SEQ ID NO: 592500 - DNA, 130 bp, Homo sapiens
  misc_feature (12)..(12): n is a, c, g, or t
  misc_feature (47)..(47): n is a, c, g, or t
tcagctcgtacntccaagaagcaccgctgacacactgttcctgctgnccggcagacacagtgctcacgcctgacttcctgaaccgctgccgcatgcatgcaatctccggctgcaggcttctttcccatgc

SEQ ID NO: 592501 - DNA, 115 bp, Homo sapiens
  misc_feature (40)..(40): n is a, c, g, or t
cactttctagctgaggttatctagaccttttgttacttcnctttccaggtactccttaatgactttacgaagttcttgtctgttaaatgcaagttggtaacttacttcctcctct

SEQ ID NO: 592502 - DNA, 685 bp, Homo sapiens
cggccattatggccgggtacaggtatatggagaaaaaaagtcagtctaataaaatcctagacagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattggggggccccaatgccaagcaaatttgaaaaatgggccttttttaaaggggggccaaaattaagggcccttgggaaaaaaaccccttaaagggggaaaaccaaaatttaaggggcctaatttaaaaagggggaaatgggaaaaacccgggggggcaaaaaataaaaaggcttggaaaaaaaacccttttcaaaaagtggggaaaattaaaaggggcccgaaaatggaggcctttaaaaaagggggaaaattggggtggaaattgggaaaattgagggaattttttacccaaaaaaccgggatgaatattttgaaaaaaaactaattttttaaacacggggacggattggggaaaaacccctttggaaaaaaaaaataacccgaaaaaagggggggtggtacctaatggggaaaaaaagccccttttaagaaaagggggccctttcgtgaaaagggggaaaaaacagtttttggggggaggggccccaaaaaaa

SEQ ID NO: 592503 - DNA, 925 bp, Homo sapiens
ggggtcaccagcagctgtacggtggagccacccggcgaaaattcgggccatggttctcgtctcattgttcgtgtctgttcaaactcggcacggtctgatccggaaatatggcctcaatatgatgccggcagtgtttccgtcagtacgcgaaggatagtcggcttgtcattaagttggactagatgctcttccttcagaggattatccggggtcatcgtactcaatgataaaaccagtgataattcttgctatataaaataaacatgtgaggaaaaatgaacaaatcatagccaaaagagactcgcgaggggcgcattaactatcgggtgcgggagcacaaaaagggtgcttcgcaattgggcgtcatgcgggcatcgtccagagtctaactgagacaccaccctttcttcttgcaaagtcgagagagaggaggcaagccaaggcgtgccttctcatatgtggggggaccgaatattaatcctggaagagcttgaaggagagaacccgtgacttacatgccgaatcccgtgtgacattcgccaccccatttccccttttgaacgctcccgggaagggtggaaaataaaattccccaaaaggggtctctgccggcaagggctacgaccatttgacaattcgaggaccctaaagcggagtagctaccggaggatccggtccatctgacttttggtgaaagcccataaaggaaggccactggacactttctaacgcgtcattggaagggggtcccaattcaggacggaagaaacacttttcaacggaaaatggtctccacacaaaaaaacgcaaccggacgcaatatccccgttaacacgggactacaacagaagcacacacacgaaacgaacacgaaaacacagacggaagaaatagaggccgcaccacacagaaccaagcacaaaaa

SEQ ID NO: 592504 - DNA, 729 bp, Homo sapiens
gcctggctgggcttcctggcagagctgagctggggcttcctgtgagaatgacctggggcgctgagtgaagtgctgctgcgtttgtcgctgccgagctcgtgtgcctcagctgtgccctgcaccctggtccccgaccccccgtggccccgagtggctgccagatcagacttcgtggtcctgccctccggaggagcagcctcgatggctggtggttttcatgagcatgtgagtgcctgactgttttcttgctgcatttgtgaatgatgccctgcctgtctgcagtggtgcctggaggaatcacttggtggatgtgtgtgcacagtgcactgaacatgtgctggtgtgcctttttgacgtgccttctttgtgtttcatgccaatggtgtgcttgctgctagcatgcccttgtgtgttgcccttggtgccatgtgcatggcgatcccctgcttccccttgccaccggtttatcctcttggttgtcttggtttcttgtcccctggtgtgcatttggtgtttcacagtgaatcccattcctgccaaatgtgccccttagtcattttggccttctgactccagtgtatttttgtggtgacacttgacaaatgtcatcccctctcaggagagttgtgcaacttggccagccaatttccctggagccattcacctcacccactctgtggccacttcattccagcagttgcaccccagcgtcaggcctactcaagttca

SEQ ID NO: 592505 - DNA, 844 bp, Homo sapiens
  misc_feature (114)..(114): n is a, c, g, or t
  misc_feature (125)..(125): n is a, c, g, or t
  misc_feature (168)..(168): n is a, c, g, or t
  misc_feature (176)..(176): n is a, c, g, or t
  misc_feature (234)..(234): n is a, c, g, or t
  misc_feature (360)..(360): n is a, c, g, or t
gtcgcgtacccgaagaagtacaagcatcgtaaagcgttggagaggtgtcaccggacacggcggcgacaggtgtgttcccttaacgtacagttggatagaaaatcaagtatattntaaaagaaggnatgtgggatcaaggaggacagccttggcagcagtggcccttgnaaccagcnacaatggatgcagtcattccagcaccaacaggatccaagccagattgattgggctgcnttggcccaagcttggattgcccaaagagaagcttcaggacagcaaagcatggtagaacaaccaccaggaatgatgccaaatggacaagatatgtctacaatggaatctggtcaaacaatcatgggnatttccaaggggattcaaacttcaacagaatgtggcaccaggtttgtagtatatgtagttcacaatcttcagacttttaaaaaacagaatgaagattattattaaattatttaatacgcttagttgtatgacttctggaaattaactgcttcttaaagaataggcagttttcaatatgattagactttgacattatgtggtctaacaattattctgtactcatcctgctagcttcgtggcactcagcatcgattctttatctaggtaacatcattcctaggctgacaggggctgagaacactctggaaacctcacttggcatctagggaagagagcaattcttgggactctctatagcaaccctctggcccttatcagaacgctgcaactgggcagagtacaacatgtctagcctctaacttacaagaacagtcgtgtccactgatgtgaacaaatgagtgaggcaagtatactcatgcccata

SEQ ID NO: 592506 - DNA, 396 bp, Homo sapiens
tccctgatgaacaagaaggaggtggtggaggctgttgaccatgtagagacacaaccatggtggtagtgggcattgtgggctaacgtgggaaaacccctcgaggcctccggacattcaagaactggacataggcatgagacacatcagtgatgacatgcaaggagagcgaacgtatcaagaactgggcatgaaatctaaagaaagaaggccaagaccaaaggtacctggcagacgaaaacatgggcagggaactgagggcatgggcaaggaaacgccacgccgggagggagggaacatacaggcaaggatggacggaaggtactgggcaagggccatgccggggtcatagggcccagaacccagatgcgccatgaagcacgtcagggagccaagaag

SEQ ID NO: 592507 - DNA, 290 bp, Homo sapiens
caacgctacctcttccctaaaaaaaaaaaaaaaaaaaaatacaaaatttagctgggcttggtggcccatgctttgtaaatcccagctaactcaggaggcagaggcaggagatagcttgggagtcagaggttgcagtgagccggagtttgctgtgagccgagaccactgcactccagcctggtgacaaagcaaaagtccgtctaaaaaaaaaagggtgctctttggcccaaagtttaccctaaaattggtgaacaacacatgggcaggttaggaaaaaacggggggccgca

SEQ ID NO: 592508 - DNA, 311 bp, Homo sapiens
  misc_feature (32)..(32): n is a, c, g, or t
  misc_feature (89)..(89): n is a, c, g, or t
  misc_feature (176)..(177): n is a, c, g, or t
  misc_feature (183)..(183): n is a, c, g, or t
  misc_feature (214)..(214): n is a, c, g, or t
  misc_feature (220)..(220): n is a, c, g, or t
  misc_feature (242)..(243): n is a, c, g, or t
  misc_feature (247)..(247): n is a, c, g, or t
  misc_feature (272)..(272): n is a, c, g, or t
  misc_feature (282)..(282): n is a, c, g, or t
  misc_feature (286)..(286): n is a, c, g, or t
  misc_feature (292)..(292): n is a, c, g, or t
  misc_feature (295)..(295): n is a, c, g, or t
  misc_feature (311)..(311): n is a, c, g, or t
gaagtatgttttccattcatttcagtccatgngaaaacacattgcagtcaaaattaaagatatccatccataaattacttttatttctnattaaatgggcacagaatcattagtatattaataacagatatgtttattattacatatccatcagtgcggctttcaataccacttgnnacatgnatatcatcctagagacgatcggttttccagngcttcntatctgatacacattactgccnngccnttttttttttcttttttgttttttngttaaggggntagncgatangtnatgctgtgcatatgan

SEQ ID NO: 592509 - DNA, 460 bp, Homo sapiens
cgcgattttcttccccagtttcttggaaaataaaaaaaaaaggtttgccagtttaatttttcccaaattttccttttttggaccttttttttctaaaagggtcctgggtcaattgggcaccataaaggttttcaacaaagggggtgccctctccggggtcacaaagaaggaaccccttaaactttccaaggccggggataagggtttgttgcccagtttaaaaaaaggactcaaaccgctggggccatgtttttaaaggccaaccccatttttttccccccaggggaggcattaaccaaaccctttgtttttttaatgtttggccaaaaaacccagtttcccctttttatgggaaaaatggtgaatccccccccaaaaaaattgcctttgtggggctgaaacccttcccctcattcctgggcccctccctggttgaccttaaaaaaggggttggctgggg

SEQ ID NO: 592510 - DNA, 374 bp, Homo sapiens
cggcgtggcggctcacgcctgtaatcccagcactttgggaggctgaggcaggcggatcacatggttaggagatcaacaccatcctggctaatatggtgaaaacccgtctgtactgaaaatacagttagcccggcatggtggcacacacctgtagtctcacctactcgggaggcgtgagcaggagaatcacttgaacccaggaggtggaggttgcagcgagcatcactgtactctagcctggtcgacagagcaagactccatctcacaaatgcaatccacggaagcaaccacatatcctctggaagctaacagaattgttaaagaagtctcaaagttaaagcaacgaacattctcacagagccaggcatggtggt

SEQ ID NO: 592511 - DNA, 525 bp, Homo sapiens
  misc_feature (132)..(132): n is a, c, g, or t
  misc_feature (143)..(143): n is a, c, g, or t
  misc_feature (186)..(186): n is a, c, g, or t
  misc_feature (194)..(194): n is a, c, g, or t
  misc_feature (252)..(252): n is a, c, g, or t
  misc_feature (378)..(378): n is a, c, g, or t
agtgcgtggcgggggtcccgaactacagtggggcatacataatctgctgctatgcttcgaggctgtagtctgaagtcaacctaagttttaaacagtaaggtgaacctctgagatagaaaatcaagtatattntaaaagaaggnatgtgggatcaaggaggacagccttggcagcagtggcccttgnaaccagcnacaatggatgcagtcattccagcaccaacaggatccaagccagattgattgggctgcnttggcccaagcttggattgcccaaagagaagcttcaggacagcaaagcatggtagaacaaccaccaggaatgatgccaaatggacaagatatgtctacaatggaatctggtcaaacaatcatgggnatttccaaggggattcaaacttcaacagaatgtggcaccagattgggaatgcatcagcaaccccacaccccctccagatcagccatggatgccacaacacaggccaatggacattttcctcttcttgaggcagcacagtaggcagtg

SEQ ID NO: 592512 - DNA, 214 bp, Homo sapiens
  misc_feature (8)..(8): n is a, c, g, or t
atcggggntggggatgtccgcggggtgagtacgttattgttacaaacactgtttggtctccaaagtgacagtcccggctcctgcctgtgaggaggtacggccgggcagccgcgtgtggctctggtgtggactgggcggctccacagtatcccctcaggatcagtgcttgtcctctggtttctgagctttgtcctgcgggtggatgccgtttgca

SEQ ID NO: 592513 - DNA, 612 bp, Homo sapiens
  misc_feature (116)..(116): n is a, c, g, or t
gccaatcctctctgtatcttcctccctcaaaccctaatccccgtctaatcaccgagaaataccagataaatctccattgggggctattctataaaatgtctgacaagcacttcttnacattgtcctagtcctcaaaaccaagagaagtcctaggaagtgaaatctggaaccaaaaaaagacactagggaacaattagcgaaatgggaataaagtatgtagttaatagtactgtaacaattttgtttcccttaattgtgacaaatgtaccattgtaatgtaggaaattgaacaggagaaactgggtgaggtatactctgtatactagcttgcaacttttctgtaactataaaactattctaaaataaaaagtttatctaaatagacaagttagggtaagggaaataaagtatatatggatcaaaatcccttagaagcaaataataataaacattcttttgatccctttatattagtggcaggacagggatagccttctcatttagaggatataaaattattaataaaacaatactataagccgggcgtggtggttcccgcctgtaatcccagcactttgggaggctgaggcaggcggatacctgaggtcaggc

SEQ ID NO: 592514 - DNA, 283 bp, Homo sapiens
  misc_feature (176)..(176): n is a, c, g, or t
  misc_feature (245)..(245): n is a, c, g, or t
  misc_feature (261)..(261): n is a, c, g, or t
  misc_feature (275)..(275): n is a, c, g, or t
tcactcctctgaccttgacccacttaggtcctgtggtcacttatttatttatttatttattttactttaagttctgggatacatgtgctgaacgtgcaggtttgttacatgtgccatgaaggtttgctgcacataccaacctgtcatctaggttttaagccccacatgccttaggngtttgtcctaatgctctccctccccttcccccaccccccgacaggccctgggtgtgtgatgttctcctncctgtgtccatgtgtnctcattgtttcaanttccactt

SEQ ID NO: 592515 - DNA, 376 bp, Homo sapiens
ttatcagcccattccaaaaaaggagctaggtggagatagcaagtaggaaggacatccctgtgcggatcttcacgtactccccgatacccttgagctatggctgcttggtggaaataggcagcacagatgcacttcctgacgatgtcccagtcagtgccacacgaggccaggctcatccgctgctgcaacatgatgtccttgagttgagctcgcacctaccggacactagggcaggagacggaggcaacacaggagggagccatccatttaaatcatcgaccctcccctcataccaacatcctgctcatccaccactctaacttccgcattcccttagcatgaatgaaatgatcgtaaaaccaaatgatgaagtaat

SEQ ID NO: 592516 - DNA, 552 bp, Homo sapiens
  misc_feature (4)..(4): n is a, c, g, or t
  misc_feature (39)..(39): n is a, c, g, or t
  misc_feature (78)..(78): n is a, c, g, or t
  misc_feature (90)..(90): n is a, c, g, or t
  misc_feature (109)..(109): n is a, c, g, or t
gtgntgagttcgcttgggtcgggcattgggtttcctggngggtcggggtagtggttttgggtttagtggttggggcantgcacaatatantgggtagtgagcgaggagntgttccctaatagtgcgtatgggcttgatggcgaggtccctaaggataaggaaggaggcgtgtttgattcggggcccttcattgtaggtgagtgagacaggggcttcgatttggtcagtacacagcagcttgtacagtggttaacaactcaggattggctgggcacggtggcttacgcctgtagtcccagcactttgggaggctgaggtgggcagatgacaagttcaggagtttgagaccagcttggtcaacatagtgaaaccccatctctactaaagatacaaaaaaatagtcgggtgtggtggcacgtgcctgtaatcccagctactcgggaggctgaggcaggagaattgcttgaacccaggaggcggagattgcagtgagctgagatcgcaccactgcactctagcctggtgacagagtaagactccatctcgaacaac

SEQ ID NO: 592517 - DNA, 223 bp, Homo sapiens
  misc_feature (10)..(10): n is a, c, g, or t
  misc_feature (26)..(26): n is a, c, g, or t
  misc_feature (30)..(30): n is a, c, g, or t
  misc_feature (51)..(51): n is a, c, g, or t
  misc_feature (76)..(76): n is a, c, g, or t
  misc_feature (195)..(195): n is a, c, g, or t
  misc_feature (198)..(198): n is a, c, g, or t
  misc_feature (200)..(200): n is a, c, g, or t
aagctaatangttggttgctggtctntagntagacacaactcatgaggctncttggttcttcgtgtagtccaccgnccatggtatcacactgttgaagtaaactcatccagaaacacccttgactgaaccgagcccgatcaggttttagacgatcgaaattaagaggaaagagtaattactcctccaagacaccnaantncaggacacttagtgatcacttaa

SEQ ID NO: 592518 - DNA, 281 bp, Homo sapiens
taggggtaatgaaaaatgtaaatcccgggtatccttattcccccccccggtatcatattatttcattttccccaaagtcctttaattttaactgaaccccagcaggatttttagaaatttttctttaacaaacttggaagatgatttatccagctgaactgtctttagaggtaattattgggaaggtctgttttattttttcaggggggttcacagggctttgatgttcagtttgtatttttggaattgctttacttagaaattaaaacagcccaccatta

SEQ ID NO: 592519 - DNA, 930 bp, Homo sapiens
ggtaggtgcttccggacattcatactgaattcgagtcacactgttcgcctctgatgtgccattcctgtggctgtgtgtctcgcactccacgatgagtggcggcgcctgcctcgttggatagatcctctgtgagatgatcgcactacaaattgaggtcagtagaactccttgtacatccgctggatagttgacagaacggtcctcctgagagatccagtgaagatagcaatgtcactatgtgatgattaattgtctcgtcatgtatgtaccctagtcgtagaaaacgtgttgctgaagtatgatcccctgtaatgaatcggtaggatgcctttggaacatgctgtgtagatgcagtcgtcatgtagtttcagaagtgccatctaagcgaatatagcctgagttacaaatctgcgtatgcagcagtgggtgtacccttgtgggataacatgtgactctcttgtgccctgatttgaatcgtaacggcgtgaacatccttgggaaccatgcacgtactgccatgatccagagcaggcccttaccggggagtccacgagggttcttgagggtgaactgagccccaggggacagaggcgaacgcagctcatctcacgtggatggtcatctttatgatttaaccctagcctaaccaaatgatcgtcgtgggataacacagatatctcctctgggctgtgtgtgaatcattgccatccccatgcactcaacgtgggagctcactcagatgtggtttgatgtggtaggagtgcctgcctcggggcagttctggcacattgctgtggcaccatcgaccctgtgaacaaccatgggaggttcactgctcttgattcttgtacttctacgcgaaatcctgcacggacattgcaacaagacacgaacagatgttgcagaaaaggcggttacccaaggtggata

SEQ ID NO: 592520 - DNA, 275 bp, Homo sapiens
  misc_feature (246)..(246): n is a, c, g, or t
cttttttaaaaaaatcaagtctaggtcggtcgctgtggctcacgcctgtaatcccagcactttgggaggctgaggcgggtggatcacgaggtcgggagatcgagaccattctggctagcatgatgaaaccctgtttctgctagaaatacaaaaaaattagccaggcatggtggcagatgcctgtagtcccataatgctaagattacaggcatgtgaatgcttgagattacaggcatgagccaccgngcctggcccatcatccccttttgaaggtt

SEQ ID NO: 592521 - DNA, 101 bp, Homo sapiens
gcggccgcctactactactactactgctcgaattcaagcttctaacgatgtacggggacatggagggagtttcattaaatgctaactactttttcaaaaaa

SEQ ID NO: 592522 - DNA, 290 bp, Homo sapiens
  misc_feature (58)..(58): n is a, c, g, or t
  misc_feature (116)..(116): n is a, c, g, or t
  misc_feature (126)..(126): n is a, c, g, or t
  misc_feature (139)..(139): n is a, c, g, or t
gccgtagtggccgttctgcgtggcggccggcggggccaccggcggcggaaagacgacncggtgggggcgtcctcatcccgctctggccacagacccgggttcgtgtcgccctcgtnctcccgtccncgtcgggggccgncattcggggggcccggcccatagaagtctaagccgttgcagtcgcccgcgccacggcgccacagcggcgcacggcctccttggtggcatccaggtcatcatcggacgccccaaaggcggaccacgggaagctggcagccggcggcggtcgc

SEQ ID NO: 592523 - DNA, 329 bp, Homo sapiens
  misc_feature (2)..(2): n is a, c, g, or t
gnagtgcaatggctgggaaaggcatcaggtaggagtgagcagacctggaagacaaaaattaagataaagaggctggccggagtgcaatggctcatgcctataaccccagcactttgggaggccaagggggggcggatcaaaaggtcaggagatcaagaccatcctggctaacatggtgaaaccccgtctctactaaaaatacaaaaaaattatccgggcgtagtggcgggcgcctgtagtcccagctactcaagaggctgaggcaggagaatggcgtgaacccgggaggcggagctgcagtgagccaagatccagccattgcactccgg

SEQ ID NO: 592524 - DNA, 963 bp, Homo sapiens
  misc_feature (206)..(206): n is a, c, g, or t
  misc_feature (307)..(307): n is a, c, g, or t
  misc_feature (410)..(410): n is a, c, g, or t
  misc_feature (518)..(518): n is a, c, g, or t
  misc_feature (951)..(951): n is a, c, g, or t
gacaagccaaggccggagcggttaaggaggacactggtctgcactgtggttgcaaggaaggtggatgtgagagacactacccttatggttctctagaagcaatcccatcgcagctagcatcatgctgtcccctcagagagctttactctgcaaactcaacaacatcaacctccagcacgtctccctgggcctgcacttgtcccgcngtcatgagctacaggaggggcctttgagcacacaccctcctccaggagaaactgggggcaaggagagcaggggcccctgcagtggcaccctggtggacgcnaattccaacagcccagctgtgcactgccggtgctgccaggagcacggtccgggcctagaaaacaggcaggacccgtaacaggaggaagagggggctgcatctncctaagaaacaggctgctcctcctcactcagctcctgctcagatattagcaccgatgagtcaactgtctaagtctacttgcgggaactccatggtgatgaggatgcanacactcagcccagtatcatacacctggagcagggctcacaaatggattaagaaggaactggaacctgctcacaggacagcttctgctgctctaatgattaatgctcaggagcttattcttcaaaagatcatggcctggactcgaactgcaacgcactgaacacatgccaggacgtcccttccccaggcttggaggaagaggacgagagggcggagagggatctccctacctctgagctcttagaggcggatgatgggaaaatcgacgctgggaaaacggagcccagttggaagattaacccaatttggaaaattgacacagagaaactaaagctgaatggaaaccactgaaacaataacactggttggaaaacaacgggatgttaatctagctggaaagtgaactgaaaaatcgatttggttggaaacaacanagaataactgat

SEQ ID NO: 592525 - DNA, 1037 bp, Homo sapiens
  misc_feature (311)..(311): n is a, c, g, or t
  misc_feature (402)..(402): n is a, c, g, or t
  misc_feature (490)..(491): n is a, c, g, or t
gtcctccctgcgcggacaccgtcgggcctcgtcgggagaccggctcaaggactcgggctccgtgcagagactctccacctacgacagatgtgcccgctgcctggtgccttgtctccccgtgctagtacccatgcctgtgcgccatgtagtgtgccgtggtcctgggtggcctcgttccagctgcagctcagtcaggctgggggtgctcacatcatgctaatgctgctactgcgtcgctgcacgccgcctaggcgacatcagtctcgccacgcgaagttcgccttgacacgacctgatccttgtgcgctccntgcgcaaggcccgtctccccggctccgaccatcgcatgccagagctgacgagcaccggccaaatgatctcacatggtacgcttaggcaccnacaaagcgactgcgacggacgtgcagaggctggcagagtgttcccgatgcagagcaagcatacgcaccaggtcgatgccggagacganngtccccacgcctggtggaaacactgctgcggccggcggtcctgaatggccgttaatcaggtggtctgtgtcgacgtggatgcttcaagtggtcgcgacgtcttagtgcacgccaaggcaggtagcgtgaggtaccgaggagcgacgtgtgcaaaaggaagtcgagatgaacgggaagtgtctgagcctggagaaaacatcagaattgtccctggttcatgccacgagaggatacttgtgacccacgcgaacacatgatgcaaaatgacgatcaatggcttcggagacataaaaggcttgccgagaaggtcttgacaccggggtcgctgggatcggatagccgcgagcatggatggaaacccatgcctgtattgcaggatggggcgcagaacttgggacgcgaggttttatctctccgaaccccttaagggaaaggctttgacctgtttgtggggcaaaatggttgccaagggccccccgaaacgtaaaacaacgaattgcgcaggaggctccactttcttgttaccacgcgtctggctggtctcag

SEQ ID NO: 592526 - DNA, 272 bp, Homo sapiens
tgggtgactctagattatcccaaatctctcattgcggggggacgtgatcgcggaatgttgtccgggtgttgtgatgccccggtccctgctattggagatggcacttaggcaaatccgggtgcgtgattcaagggtgtggggcgagcgactttaggtcgcgaagcaattggaagtggttccaagaaaagcctctaagcttcagtcatacgagaccgtaccgcaaaccgacacaggtgggcgagatgagtattctaaggcgcaatgagagattg

SEQ ID NO: 592527 - DNA, 535 bp, Homo sapiens
tgtgacgccatcgtgcaaccagcgccccatccacccagcacggtcccgtcccgtcagcagcctcggcccgggctcaggctccaccaccacttcgcccgtcaccaccagccgtccccagcgtgcagcccatcgtcaagtcggtcctccaccgccaccaccgcaccccccagcactgctccctctggtcctgggagtgtccagaagaacatcgtggtcatcacgttcccgccgaacaggggagggcaaaggaggcgccccacgcatcccgatccttctgcacagttgcctcacgcaccggcatcgtccccgtccaccagctacagcaggcagtgccctttgtaggggggaagcaggaggctggggacagtccccctccagctccagggactccaaaagccaatggctcccagcccaactgccggctcccctcagcctggctccgtgatgctccacctgccagcccccggataccacacatgcagacacgacacacgtgacgacaacatgcagcacgctaagcggaaggaagttgaga

SEQ ID NO: 592528 - DNA, 626 bp, Homo sapiens
tcctgcttccccgccgtcgcctgccgccatcatgagtggaaatcgtgcacttgcaggccgggcagtgcggctaccaaatcggcgccgaagtttggggaggtgatcagcgatgagcacggcatctgaccccacgggcgacctaccacggtggactagcggacctgcaaggctggaacgcatcaacgtgtactacaatgaggccaccggcggcaagtacgtgccccggcgccgtgctcgtggatctggagcccgggctaccgatggactccgtgcgctcggggcccttcgggcagatcttccggccgagacaactatcgtttctcggtcagagtgagtgctgggaactactgggccaaggggcactacacagaaggcgcggagggtggtggacatcggtgctaggagtgttgtgagaaatggaggctgatgagctgtgacgtgccatgcagaggtttccagctgacccacatccgctgggtggggggactgggtctgggatggggtaccctcctcatcagtcaagatccgggaggagtaccccagagaggatcatgaacacgtttagggtggtgccttcgcccggagtgtcagacacaggggtggagccctacaaggccagcctctca

SEQ ID NO: 592529 - DNA, 125 bp, Homo sapiens
ggttttttttttggggggggggggttttaggtttttgttttttaaaacggggcctttttagggggaaccctttgccccaaattttgtcccggattttttgggccccttaaaaaggtttattggga

SEQ ID NO: 592530 - DNA, 150 bp, Homo sapiens
  misc_feature (2)..(2): n is a, c, g, or t
  misc_feature (13)..(13): n is a, c, g, or t
  misc_feature (25)..(25): n is a, c, g, or t
  misc_feature (32)..(32): n is a, c, g, or t
  misc_feature (46)..(46): n is a, c, g, or t
  misc_feature (59)..(60): n is a, c, g, or t
  misc_feature (71)..(71): n is a, c, g, or t
  misc_feature (73)..(73): n is a, c, g, or t
  misc_feature (88)..(88): n is a, c, g, or t
  misc_feature (91)..(91): n is a, c, g, or t
  misc_feature (99)..(99): n is a, c, g, or t
  misc_feature (113)..(113): n is a, c, g, or t
  misc_feature (116)..(116): n is a, c, g, or t
anacgggcacgtncacacacgtgtnctcgccnctcgaacacgcgcncacggcgcgctcnnccctctctcgngngcccctcgcgggcgnctngggacatngtacgacacgacgnttnttggggacacggacgggacgactgacggacgggg

SEQ ID NO: 592531 - DNA, 903 bp, Homo sapiens
gaccattatctcacacacacacacacacacacacacacacacacacacacacacagaaaagaaaaaagaacacgcgtagcgtgggcgctaggaagacctgtgtgtgagtaccatgtgtgccatttaccttgaacaagctactttcccactctgagccgttggttccctcctttaaaatggaaataataatagtgcctactatcttaggatgccctataaggatttgatgagatgatgtaggaagttgccctgtatcagagctatgcactgatatatagattctcacgtttccccttcccagcctgggttgtctcaacaagtgctatgtaccttgatgtgctctggaattcccctttgtctcgtctgtaaccacatgtttctggacctactcaatatagtgtgatgataacaagtagccaacatgatgagtgactaatagtgatgtgaagtgtgacgtgttagtgcactcactctacattatcccctttgagtgtcccaactatcatctatgctacagcagaactacggaacgacgaagcggtcgctgtctgcccaaggaatgttgtggggtctggtagtgaggacccatccagggcctctctgggcttatatctctcgtggctctagtgagacgacgctaacggggagaccactttgacagggccagggtactactgacacctctggtccaccgtgtctcgtgctggcgctctgctgatacgcctgcatgtgtgacgtctgggcaaagccagagctcgtcttgaggcctatagttttctacatagtggcacgaggaaactgacagaccagatgttctagagtacaagtccgtggccctagccctatgacttgccatgtgcaacttgagtgagtctctgtgtctctcagtgtttcagtttcccc

SEQ ID NO: 592532 - DNA, 1081 bp, Homo sapiens
ggtgttggcggcgcgttaccgaggatctattgtggggtgccgtgtccgtggctagactctggcgacgggtgcggctatgagtctgtgcgccggggccccgggaggggtgccgggcggtatctacagcagtggccatgctctggggtgtgggccttgctgtccactggctcgcgtcgttggtgagcgcacgaggtacactaccgtgtgcctgtctggaattgcacctaggagctaatgaggctcctgcatggagctagccagaccgctggcaggcgaggcatagtcaatacttccagcccccgcagtgtctactccaaggtatgcatcgggctcactagggtgccgcgccagcatatgcgtatgtctgccggagaagctcagactcttgggggtcacaatgcgccattggttagggttaggcatctgcgcaccacgccgagtcagggatactgtcctgcattgaactggcatcaggcaaataatgcgagcctggtggacgtgggatcggaaactcagcgggcacgtcaatcacgagcagggcgggcctatctgcagacgagatacgatgagggttgccgtgccctgtctgacatgagccgaataagccgagctattgccctacttccctagtcgtcgggacgccaaacttacacccagagccaaagtctgtggagccagtggggacttgcgtccaaatgggggattggctgggggagggcaccggtggaccggagagcttggggctgactggagcgttggcctccggcctgaggcacccagtttgagacgtagcacttctcttcggcgctacgggggcttcctggaccccctacctggtcagcatacggacagagccccctgttccatggtccttccacatgaaatccgcggtcgtctaagcttctactctggtacaagatggccaaacgaatctttgggtcggatgtgcttcgaaccgggacacgggtccgatgtgtggatggttaaagcagccttcgagtggttagaaggatacgacaagcgggcagacaaaaaaagttagatggctcgcagacgagagaaacacagtaaaaacttaaag

SEQ ID NO: 592533 - DNA, 421 bp, Homo sapiens
cgttcctggcactactgaagttgcacgaggacagagacagactctgggctccagagccagcactgatgtacttccggcgtctgggggagcacatattcttgatcttcatggtgctgggggccatgtctgtgatctccttctgcatcctgtccgctatgccccgatacatagtggtgcccccagagaggacattgttggcatattacttcttacggatgtctatgtcgcacttcatgatggaattgtaggttgtctcatgaattccagcggactccatgcccatttaaggaaggctcgcgaagagggtctcagggtcccggaagctgcctttgccaatggttattaccttgcccatcttgcagctttatagctcttttccagggaggaagacgaagctgtgtggccatctcattctccatat

SEQ ID NO: 592534 - DNA, 375 bp, Homo sapiens
gtgtattagcgtaccgctcgtgcagttccagacaggaatggttgaggcagaattcttaaaggcttcgtcctaacctgaagcatctgggctcttacccagactgacatttcagaattctgcatttgacagtttgtcttggattggttgctgccagagtcttcggcatcttgatctgtctggttgtgagaaaatcccagatgtggccctagagaagatttccagagctcttgccattctgacatctcatcaaagtggctttttgaaaactatctacgagccgaattacttctactgcgtgcaaaagtagagacattaccatgcagtccaccaagcagtatgcctgtttgcacgatttaactaacaagggcattggag

SEQ ID NO: 592535 - DNA, 912 bp, Homo sapiens
agccgcaggcctgtaggctgcatggagcccagccggaatggcatggtcttgaagccccacttccacaaggactgtgcagcggcgcgtggccaggtggttcaaccagccggcccggaagatccgcagacgtaaggcccggcaagccatggcgcgcggatcggctcggcgccccgcgtcgggtcccttcgcggcccatcgtgcgctgccccagggtttcggtaccacaggaggggtgcgccgctgggcggggggtttcagcctggagggagctccgggggttgcgccggagaattacgacaaaggcagggtgttggcccgggcaccccattcgggcattttccgggttgcgattcccggaggaaagggcctgaaaacaatgctccgaacggggaagctcccctgtgtcatgggccccaactcttgttcacacgacggggaactgaaagggagatgtacccggcattcacgaaagcttacgaattgcatcttccccccacaggggaaagcgcccctttggggtgcccccccaaaaagaaacgggtgcgaccgaaccgatgtctaccaatggctatgaaaaagcaaaatctcttggaaaaactttggggcaccaacccccacaagggcatttagaagccggggaacgcgggggtgtacaaatttgcccaccaggttccggggggaaaccactggctccttaattacgacgaacgggcgggcagcaaacagggctctcgggaggtttcaacttccaagcttggacgcggaaaagcgggcgcaacaagacattttttctccaaagcgggccccttttccggcgcataaggctccctccgcgggataatttggcccctggatcgcccaaagccggccgccggcgcattcatacacggggcaaatacggggggccaaaaa

SEQ ID NO: 592536 - DNA, 145 bp, Homo sapiens
gcagccaacaggcattccaggcagatggtagacattgaggacctggagggacctcagagacagagtgccacattacaggatgatcagacatacctgtgcatgttgtatggagaaacagaggaagacattggaggaccccatccca

SEQ ID NO: 592537 - DNA, 172 bp, Homo sapiens
ccgcagaaaccactaacaacacccctcctaatactaacgaactgactgcggccccatcacaatcatggcaagccaacgcgaataatccagtgaaccactatcacgaaaaaaacactaactctctatactaaactcacctacaaaatctccttaaatgatgacatacacagac

SEQ ID NO: 592538 - DNA, 1425 bp, Homo sapiens
  misc_feature (440)..(440): n is a, c, g, or t
tcctggttggccacaagaaaatttttatggggggttaatggagtgcgggaaaaagggtttaatcccttgggtgtggaagaaaaaacccttcccccggggatcctggcgggttctatgttctcccgtgggtgggggttccgagtcgtcgaaacctcctatgaccttttctgggtaggggcgccactggttcttctcccagggttgctccctaacatggctgtagacctgggacacgtgtactctctctgggggagatctcccacttggtctcaggctgtaaggcgcctcagggatacgccatcgcaggcgcacagcagatcaacactaggtgagatgcgctaacgagtatgagagacgggtgttgtaggggcgtctctcaccactctccacgcgaccatctagagggtgcgacctaagtatacatcttgccctaacacagngagcaccaatctagttcaacgagctctccccgcgggataaacacgtcacctattatagaagacaccaccccagagcggcaaaagggcgagcgagagtagcacgcagaaacaacgcgttcgagaagggcgggcacaagatctctctacataaaggcgcaaaatcaacaagggcgcgacaacacctctaggatagaaacataggacaggcagaacaaccaacacgcctcaactcagacccagcccgcgccaacaattagaactataggcagccaaacaaatagcaccccctattgtgaggggcacacccctctacaaaggggggccacacaacaaggtgatagtggtgcataccacccccaaagaaagcataggagatcaaaataccccccgcggacaagatctccccgcgggaagaatatgaaacccacatctatcgagagacatacctcgaaagaatacaggaaccccacatatccatcattgtgtagagcacaccatagaacccacagaggaatgcagacaacacaccaacaatctatggggacaacaatacaacaacaagaggagcaacaccagtgaaggagaggagcaacaacaccccccaaagatgagacgtaacagccaaacagagtatgagaacaaccactacccaccacaaaatatgtaggccaccaaattataggggcccactaccaacaggaagaccaccccggagggagatagtggagaacacaccgtcaggaggacccatcctgtaaggaaaaactactacaccacaaagggggccgtccaaccacccacaccacaagaacgggcaaaacaaatgtgggcggccccaaaaaaccacagaagaggatacgttcagccgataacacatgagtaagaaccaaccccaccccatgtagaaccaccacgagcgcgacaaaaatagaaccctgcagaacatcaggaagaaacacagcccaatctaccccaggagcaaacc

SEQ ID NO: 592539 - DNA, 925 bp, Homo sapiens
  misc_feature (729)..(729): n is a, c, g, or t
ggctgcggaataatctcccatatgtaacttactagtccggaaaaaaaagaaccatggggatacgataggtatggtcgtgagctatgatatgaatgggttcctagggttgatctgtgtgagcacaacctatatatttacagtacgcgaatagacgtagacacacgatcatattatcgactctccgctgaccataatcatcggcttgatccccaacctggcggtcgaaaggtatttgaggctagacatcggccacaactcctacgtgaagcaatatgaaagtgatctggctgcagtgctgctgagccctaggatgcaatctttctttccaccagtagggtggctgacgggcgtggtatgagcgaaatcatcactagacatcgtactagacgacaggtagtacgttgtagcgcagttccatgtatgtcctatgcaatgggagcggtattcgcgcagtcataggcagggttcattcactgttgtcccctattctcgaggctacaccctagtaccagaaactgagccaaaagccatgttcgctaggcatattcatgggtgtaaagtctaacttggttcccagagattttctcggctatgcggaatgccccgggtgactcggactaccccgatgcgtagcaccacatgatggatcctatcatctgtggctcatcagtgctctaacagcggatgtatagttcatgaatggagagcttgctcgaggaagtctaaagntgagacctcttagcgggggtttttgtggcccgactacaaattgagaacggtatatgtgcacaggggtggccccaatggttagcacctgccgatttaaggaaagaaaaaggggggccagaaaatcggcgcgccagggagaaaagaggacgaagaaaacggggaggtgtgaacaagcgaggaaagaagaaaaaaaaag

SEQ ID NO: 592540 - DNA, 175 bp, Homo sapiens
gattatgcgtgtttgctgtagagacagggcttctccatgttggtcaggctggtctcaaactcccaacctcagatgatccacccacctcagcctcccagagtgctgggaatacagacgtgagccaccgcgcccggctggatatatcacagtttaatcatccacctgttgaaggacc

SEQ ID NO: 592541 - DNA, 115 bp, Homo sapiens
gaactctaattcattgctggtagctatgcaaatagtaatcgctacttaggaaaaactgtttgacagtttcttacaaaattaaacatactctacaggctgtggcagtgtgcttccg

SEQ ID NO: 592542 - DNA, 534 bp, Homo sapiens
gtttatggtatgcacagaatagaagtggtgtgagaatcagaggaggtagacagaggttaatcgatgggattttgccttagcatttggtatatgatcaataggagggtagctattaacagatatcctcaacgagcagtatgtctgtttggctttgcaggagagggacctacgtcattaaattgtgttgttactgtgtgccaagaaggctccatctaatcctattgtaacatttcaagagtgtaaacataaaaagagctaagcatactcacaaagagaggacagcattgaagagtgatctgtatgaaccactggaaacacgagaaccacatttcgggtctttagaattctactgaagggtaccagccacgtttcttcacaccactccttctcccttaaaatatggactattcctatttcaaaatgggaggtgagagaattggagagtgatgattttttagtgggcaaaggccgttttccaactcattcctaaggatggcaaacataatacttcagagtgatgacggaggggggcag

SEQ ID NO: 592543 - DNA, 146 bp, Homo sapiens
  misc_feature (51)..(51): n is a, c, g, or t
  misc_feature (60)..(60): n is a, c, g, or t
  misc_feature (72)..(72): n is a, c, g, or t
  misc_feature (75)..(75): n is a, c, g, or t
  misc_feature (83)..(83): n is a, c, g, or t
  misc_feature (92)..(92): n is a, c, g, or t
  misc_feature (101)..(101): n is a, c, g, or t
  misc_feature (118)..(118): n is a, c, g, or t
  misc_feature (125)..(126): n is a, c, g, or t
tggtctgatccagtttaatttgttatgtagccagtgtatgcctcctcatanaacaattanctgaacctatgnctnctacaaancatgaatgnctttgttancagagcgccaagctgtnccatttnntgtgatgggttttgaataaa

SEQ ID NO: 592544 - DNA, 321 bp, Homo sapiens
atagcacactcctgagtgtaaaacaacggccagggagtcctgaacactgcccaaggctgtttcctgagctaaaaccgccgcccattaacccttacggaaggccaatgggggcttcggggcataaaaccacgtacaggtaataaaatagactcaggaacgcggggctaaaagatccaaaaatggggccaagactctaactagaaactgtctctgtcgcccctggagaactcaaaaccccgaggtaaaagtctgttttttgctcctcccaggcccccgtggttccagctacagtgccccgtccttttgtgtcatcatcatctt

SEQ ID NO: 592545 - DNA, 134 bp, Homo sapiens
gagaagggtccactgtgaacatgctgttgaacatggtctcactctggtcctgtaggatataggcgagcgccgattccttaagaggacgcgcgatggtctccgcttgccctcggtccgatcgaaaggaagtcggg

SEQ ID NO: 592546 - DNA, 711 bp, Homo sapiens
  misc_feature (227)..(227): n is a, c, g, or t
cctccaggcgcttacatggagaccttgagcttatccggagcccttgccctggagtttaccaagggccaccaacggcctggggcctaccctttttttggacagccaagtgccccggagcctacccctgcacttgcccctatggcgcccctgctgggccactgattgtgccttaaacactgcctttgcctgggggagtggtgcctcgcatctgataacaattttgggcncggtgaagccccatgccaacagaattgcttttgatttccaaagagggaatgatgttgccttccccttttacccccgcttcaatgagaaccacaggagagtccttgtttgccataccaagctggataataactggggaagggaaaaaaaaccgtcggtttttcccttttaaagtggggaacccttccaaaaacaaggactggttgaacctggccccttcaagggtgcagtgaatgatgctcccttgttgcaggaccatcctcgggttaaaaaactcaatgaaatcagccaactggggatttttggggacatagaccccccccgggctttatataccctgatattatttgaaaggggccgatttaaaaaaaaaaaaagaattttaaccctacctggggaaagggttcatgttccctgggagtgaaaatttttaccttcctccaaatccctcttgtaagtccttttctttattaatatttccgtgga

SEQ ID NO: 592547 - DNA, 1066 bp, Homo sapiens
  misc_feature (60)..(60): n is a, c, g, or t
  misc_feature (78)..(79): n is a, c, g, or t
  misc_feature (226)..(226): n is a, c, g, or t
  misc_feature (383)..(383): n is a, c, g, or t
  misc_feature (520)..(520): n is a, c, g, or t
  misc_feature (550)..(550): n is a, c, g, or t
  misc_feature (585)..(586): n is a, c, g, or t
  misc_feature (596)..(596): n is a, c, g, or t
ggaagtgacatcgtctttaaaccctgcgtggcaatccctgacgcaccgccggtgatgccncagggtaagacatgtggnncggtatcccccttttggggggcaaacaaggggctttcgccggaaaagaaccggttttacgttgttccccgggtttttcacaacgggccaattccaatcccgaacgtaatttggggggaatttgcaatttaatccctggaaaagtgcntttcaaatttgggtggggcaggcaaggacaattgtggggctccaaaggcaggtatgcgagccaggatccggcaatgtcccgttcggcggtgaagggctgtggtgcgtgatgggcaagaacaccatgatgcgcaaggccatccgagggcacctggaanacaacccagctctggagaaactgctgcctcatatccgggggaatgtgggctttgtgttcaccaaggaggacctcactgagatcagggacatgttgctggccaataaggtgccagctgctgcccgtgctggtgccatngccccatgtgaagtcactgtgccagcccanaacactggtctagggcccgagaagacctccttttnncaggctttangtatcaccactggagacaaagtgggagccatcgaagccacgctgctgaacatgggcaacatctgccgcttcttcggggggctggtcatccagcaggggttcggcggggtgggcatctacaaccctgaagtgcttgatatcacagaggaaactctgcattctcgcttcctggaggatgtgcgcaatgatgccagtgtctgtctgcaggatggctacccaactggtgcatcagtaccccattctatcatcgaccggtaccgagtcctgggcttgactgtggagacggagtacaccgtcgcacttggtggaagagtcgactgccttgttggctgacccatcttgctttgggggtggtgccccttggctgctggcaacacaggtggttcggcgggtggtggcggcccacctagggtggagggcagtgaggatgtgggtagtccgccaggatatggatgggcgcgcgttgctgcg

SEQ ID NO: 592548 - DNA, 1149 bp, Homo sapiens
  misc_feature (60)..(60): n is a, c, g, or t
  misc_feature (78)..(79): n is a, c, g, or t
  misc_feature (226)..(226): n is a, c, g, or t
  misc_feature (383)..(383): n is a, c, g, or t
  misc_feature (520)..(520): n is a, c, g, or t
  misc_feature (550)..(550): n is a, c, g, or t
  misc_feature (585)..(586): n is a, c, g, or t
  misc_feature (596)..(596): n is a, c, g, or t
ggaagtgacatcgtctttaaaccctgcgtggcaatccctgacgcaccgccggtgatgccncagggtaagacatgtggnncggtatcccccttttggggggcaaacaaggggctttcgccggaaaagaaccggttttacgttgttccccgggtttttcacaacgggccaattccaatcccgaacgtaatttggggggaatttgcaatttaatccctggaaaagtgcntttcaaatttgggtggggcaggcaaggacaattgtggggctccaaaggcaggtatgcgagccaggatccggcaatgtcccgttcggcggtgaagggctgtggtgcgtgatgggcaagaacaccatgatgcgcaaggccatccgagggcacctggaanacaacccagctctggagaaactgctgcctcatatccgggggaatgtgggctttgtgttcaccaaggaggacctcactgagatcagggacatgttgctggccaataaggtgccagctgctgcccgtgctggtgccatngccccatgtgaagtcactgtgccagcccanaacactggtctagggcccgagaagacctccttttnncaggctttangtatcaccactcaaaatactccaggggacacacatatgaacatcctagagtgatgtgcagcatgatcaagactggagaacaaagctgggagccagacgaagacacacgcatgcatgaacatagctcaaacactcatcccccgttctccattagggccatggatcaatccagacaaggtgttcggacaatggccagcatctacaaccctgaagtgcttgatatcacagaggaaactctgcattctcgcttcctggaggatgtgcgcaatgatgccagtgtctgtctgcaggatggctacccaactggtgcatcagtaccccattctatcatcgaccggtaccgagtcctgggcttgactgtggagacggagtacaccgtcgcacttggtggaagagtcgactgccttgttggctgacccatcttgctttgggggtggtgccccttggctgctggcaacacaggtggttcggcgggtggtggcggcccacctagggtggagggcagtgaggatgtgggtagtccgccaggatatggatgggcgcgcgttgctgcg

SEQ ID NO: 592549 - DNA, 155 bp, Homo sapiens
atgaatacaaagatgaggctctaagagaaatggtggcatgaagaccctctcccatctttgtagaattaagataacttatgattttctagcttttgagctaacgtaactatagtaaagattaagctcatttagtgtttactcattatttttttttt

SEQ ID NO: 592550 - DNA, 378 bp, Homo sapiens
  misc_feature (21)..(21): n is a, c, g, or t
  misc_feature (74)..(74): n is a, c, g, or t
  misc_feature (352)..(352): n is a, c, g, or t
gtccatacgggcgttgttctngattcccggtcggtaacttaaagggaaattttcacaatgtccgggagcccttnatgtcctgcaaataaaggaggagggatgtccttaaggttccttgcagcagggaacccacttaggtgggcaccaatcttgacttccagatggaacagtacatctataaaaggaaaaggttatgggcatctatatcataaatctcaagagggacctggggagaagcttctgctgggcagctcggtggcaatttttgccattggaaaaccctggctggatgtcaggttttatatcctccagggaatactgggccaggaggggctggtgctggaagtttgcntggctggccgactgtggaggccactt

SEQ ID NO: 592551 - DNA, 352 bp, Homo sapiens
  misc_feature (12)..(12): n is a, c, g, or t
  misc_feature (199)..(199): n is a, c, g, or t
cattgccctaanagaagtggggccttgtgctacccagtcaatgagtggccctcctctttgagaggtcacaaagttcatcttgttgttcaaaaactccaccttattaaaaaaaatacaattagactttttttttctcccccaagacggagtctcgctctgtcccgcagaatggagtgcagtgccatgatctcggctcatngcaacctccacctcccaaggtcatgtgattctcctgcctcagcctcccgagtagctgggactacaggggcaagctactgccctcggccaatttttgtatttttagtagagacggggttcaccatgttggccaggctgttctcgaactcctgac

SEQ ID NO: 592552 - DNA, 1522 bp, Homo sapiens
  misc_feature (1522)..(1522): n is a, c, g, or t
ggcggatgacgccggtgtcagcggttgtggtgccccggggtgccctggtggccctgggatggggaaccgtcggtggactaccgcgtggaggttgcggcagtggccatcctggtggaccgagggtcagcggtccgtggactgcggtccgtggccgaggtccggaacggagtcatcgcggagtgcaaggccgagcgataatgagtggatgcaccgtacacctaagcttggtgctcgcttgggttcgtagagagctagtgtaagcatcaagctcccatggtagggaagatctatcatcgtgtcgtccactgtccccgacttaaaagggaaatccagtagaatcgagttagaattactttataccatgcgtggggaccgtctcgtcaagtggcattggagggtctatagcaaggcattacaatcgcgcaagattgtccgaggaacgccaagaagcactgatgaccagaggctagagtgacaagcgaggagcgttttcgagaagggacaattttatgttgttggcctactcctgagagggaacattaccgacactgggtcactagcggtcgggagcacattgagtaggtagttcaagatgctagcgtcgcgataggcggaaagcgattgggtacccaccacagtgccgaatacgcctgtatggcgcgggacccaattcgattcgctttgtggtacaacagccgtccgtccccaaattgaagatgactccgccgcgaacatagacaggccaaatgtaaaaacggccttaagcattgatagttagcgccggaaatagccaagacagcaacagcttcacgcagggtcaaaagagcctccccccgagagacaatgcgtttgagttaggccccatttttgtgcgcacgtaggggcactaggaaccctttgtagggcgccaggaactttgccctgtgagcagtacacattagggtagtggcagataggtcgataaacacagtcgcccatttccaaagttccagctccgtttgatcttagcacaagcccaaatcagtgtggtcgcccaaccgtttggtggacagtttccacgagtgcatgtcccgagaggcgaaggccccttggtgtggaccacctcaaaacggaacaagagtcttatggcaatccaacgttggcactcatgtgacgtgtcgtgtcacatttcgaggaactattcagaccatttggatatacagacagcactttcaaatgggcacaactggtttatgggcattatggcgaagcgttaggcgcaacacacgcctctttggggagaaccaacgacactgtttcctgagcacaccatagatgagaccgcaaaccgaattcttttaggaatttcggcccaaggttgtcacgtgtgagtcaggataccccgttaaccacagggattttacatcacgttaggaacgatcaggccagcgttggaagaaacctctccgttagggaaaacgggagaattaagacatttggtacattttgacaatccaccaagcgtatacttcccgcaattatn

SEQ ID NO: 592553 - DNA, 114 bp, Homo sapiens
tcatcgatggccacctgagtatcggagctggggggtgcactcctataatctcagctactcaggaggcggatacacaagaatcactggacccggggaggtagaggtggcagtgga

SEQ ID NO: 592554 - DNA, 308 bp, Homo sapiens
cacgctaagcggaaggaagatgtagattgcttccttcatgtcactttctttttagatactggacagccagcccctcagaataaacgtttggtctgtaagccctgatccactgcagaccttcctgcatcagataccacagaaaggctggacccattgcccccttctggtctcgtgactgaggactcttcctgcccagattcagagcccgaaggcctggaggctggaaaagaaacgactgccctcccgtgggacacactgcctccttggccgtcgtgtcctcttttacggagcctcaaatcccaatgctt

SEQ ID NO: 592555 - DNA, 360 bp, Homo sapiens
  misc_feature (4)..(4): n is a, c, g, or t
  misc_feature (40)..(40): n is a, c, g, or t
  misc_feature (62)..(62): n is a, c, g, or t
  misc_feature (130)..(130): n is a, c, g, or t
  misc_feature (134)..(134): n is a, c, g, or t
  misc_feature (298)..(298): n is a, c, g, or t
ccanccccacatcagggttaccttgagtattaaatgagantatgtatataaagacccatggncttttatacatggaaccttaatgtccgcctaggggatgattaaacaaacagcaaagtataaaatgaancccnaaatagagcccactcatataaaatgcattaaccaattataatcaatttcatgaaaaataatgattttgaaacgtaaagatcacaaggaatatgaatcaaatgttattcatattttatcttaactataatgagatacttttgaaggcttttaagagaaagagtcncctcagagatttttactttaaatcagtcatttcagctgctgtatggaaaatggaatggagta

SEQ ID NO: 592556 - DNA, 553 bp, Homo sapiens
tttggctccattcagggccaaacacgagcgtggtgacgggcggcatctacttgggctctatcatgaagggtggggccgtggctgctgatggacgcatcgagccaggagatatgtggtacatggtatcagtgcccatcctaggcgggggtgtggatagagggcagggaggtgtcctaccatctgtaccctgctctttcagaggccccttctgggtggggggaagactccctgacctaccaagtggagttcccttttcatcctccccagcacagttgtttatcccagtcggggtcctttcccaggtaaacgagatcaagttggagaacatgagtaatgacgatgcagtccgggtacggcgggagatggtgcacaagccggggtatggatggaatggggcacggggcaaggggctgggtctgacctatacgcatcctgccttcagtaggacacccttgtttgcaggcccatcacccgtgatgtagccaagtgcggcgacccaagtccagggtgttgcttcacatgggccaggagtaaggggatgggagactcagac

SEQ ID NO: 592557 - DNA, 674 bp, Homo sapiens
tgtgatttattcatttaatcccagctaaagggcagaggcgccatctccggtgactgaaagggctgcttgccgggttcatgccatgctcctgccgcaggcactatgagtagatgggactacaggtacccgccaccacaatagtctaattttttatatgcctaggagagatggggacttaccgggttcaccacaatgataaatgactcctgagctcatgttgcgtccgtctcagacaatgaaagagtagggattacgaggcgtaacccatgatgcccgggcactacagggataactttgaggctaccgcgtactatattgtgtgtggcaggtaatattcactcaccgactggagtgcggagggtatgtaaatgatcactgacatgttcaattgcgagactgaagccgtcctgcttcctaatattctggctatctgctaccattgggcgctgccctcatggccatgaaattttttttttgttgtagacacaggggctacctatgtgggccggctttaataaaacctcccgggtcaaggattcttctgctaaagattaaaaaagtccgtggggggaacaaccggggcgggtaaccaagaaatcttttttgggcgggacccaaaaaagaaacccagcttaagttgcctttatgaggggtaacattaaaaagaggtatct

SEQ ID NO: 592558 - DNA, 325 bp, Homo sapiens
  misc_feature (8)..(8): n is a, c, g, or t
  misc_feature (23)..(23): n is a, c, g, or t
  misc_feature (29)..(29): n is a, c, g, or t
  misc_feature (176)..(176): n is a, c, g, or t
  misc_feature (185)..(185): n is a, c, g, or t
  misc_feature (223)..(223): n is a, c, g, or t
  misc_feature (231)..(231): n is a, c, g, or t
  misc_feature (253)..(253): n is a, c, g, or t
  misc_feature (294)..(294): n is a, c, g, or t
gagagatnttgtttcatatgaanaatatnttgtataattaaagaaatttcttggctgggcacagtggctaacgtctataatcccaggacttcgggaggctgaggaggaaggatcacttgcacccaggagtttgagaccagcctgggcagtatagggagacttggtctctataaaantaataaaanatactaactgagttgggtcctgtggttccggctgcttnggaggatnatttgagcctggggagttcaangctgcagtgaaaactgtgatccaagccactggcacttccancatgtttaccagagcaagagacccctgtcct

SEQ ID NO: 592559 - DNA, 739 bp, Homo sapiens
atctcaatttgaattgtatctcccagaattcccacgtattgtgggagggcaccagagggaggtaattgaatcatgggggccggtctttcccatgctattctcgtggtggtgaataagtctcactagatctgacgggtttatcaggggtttccgcttttgcttcttcctcatttttctcttgccccttgccacgcaagaagtgccttttgcctcccaccataattctgaggcctccccaaccatgtggaactgtaagtccaattaaacctctttttcttcccagtctcaggtatgtctttatcagcagtgtgaaaacggactaatacacatggtaattccatgtttaactttttgaggaacagccaaactgttctccacagtggctgcaccattttacattcctgccagccgctcatgaagcttccaatttttccatatctttgccaagatttattattgtctgtcttttgattgtagcctttctagtgggtgtggagtggtatttcattgtggtttgatttgcatttccctagtaattaacggtattgataatcactttcatgaacttatttgccactttgtatgttttctttggataaactgtcttttccggtcctttgcctattttacaatggtaccattgtctttttcattgaattataatacatatcatgtattctggatactagatccttattatatatatttatttgcaatatttctctcattctgtgtattg

SEQ ID NO: 592560 - DNA, 132 bp, Homo sapiens
ttgagcggactgagcggctctcatcattgtattctcagtacccaggatgcctcagtaaatgcatattgacggaataatgaatgattatacaacctgggaaaaaaaagtatattcacatatatagagaccgct

SEQ ID NO: 592561 - DNA, 292 bp, Homo sapiens
gtagggcctcaacgtgggttcacgtgatgtttccccagatagactcaggtcaaacgctgttgttagagccctgcagagccgcgggtctcagcccttgttggtatggcgaggtcctgtagccggcagtcggcctcccaaaatgttgctggctttttccagcggttggcaaactagacccactgctgggctgatggcctgttgttgtaaatattttttttttctttttgccaccacacccggctgatttttgtatttttagtagagacagggtttcactatgttgctcaggaag

SEQ ID NO: 592562 - DNA, 132 bp, Homo sapiens
tctgctgcggttactctcgacggctcccctacggtggacccgcgccgtgggggacgtacgggcggtgccggacgctggggcggctgaccgctgacgtaccggaccccgccagaccggaccttcctggaccga

SEQ ID NO: 592563 - DNA, 330 bp, Homo sapiens
tttcaggatgaagacattgaaggctgtgaaagtcaaaggaggctcggcgcagtggctcatgcctataatcccagcactttgggaggcctaggtgggcagatgacctgaggttgggagttcaagaccagcctgaccaacatgaagaaaccccgtctctagtaaaatacaaaattagttgggcgtggtgacatttgcctgtagtcccagctactcaggacgctgaggcaggagaaccacttgaacctgggaggcagaggttgtggtgagccaacatcatgccattgcactccagtctgggcaacaggagtgaaactctgtccccccaccaaa

SEQ ID NO: 592564 - DNA, 1481 bp, Homo sapiens
cccggccgggtgggggtgtttggttagagtaccccccccaccaccactcaatgggaagtgaggacgcgtgtgttatgagtttggttaacaacctagaggtgttgtggtgggtggttggggtggaacaagcacacagcccttgcgttgtgggggtagtagctggtcagtgtaaagcggagggatggtttggtggagagacgatcagttggggggggggagaccacaacttcagtcctcgtcggagcgtaggcacgtcttggggtgtggtgtaggaggaagaagagcagacgccctggtgtggagtataatgactgtgtttgttgtgtcgccctcccccgtcccctcgctgtggtggtgagtaccactcccgccgtcgcgagggtagtttagtggtgtgctgagattgaagtgaggaggtccagcttctcgcccgcccggcgtctgtggtaagaaaacttcggcaggaagaggatgttgtgtagaaaaatagcatatggtggggtgtgttgtctcgcccgacacagcgtgggtgtgatgattatttttgttttctactatcaaagaaccacccccacaacttttgtggggtcgacgaaagtatgttataatagtaaggatgatgcagccccgtccagagctgtggtggttattaagaagagagctgcacgaccaccgcgtctcttgtggtatgaggtttttggtgtgggggcggcgcgccccgcactttgttgtctcgctctcggcggctgttgtgatgagagagagagtatcgccccccccccccctcctttcttgttgggagctgtcacacgcgctgtggggagaagagagttttttgtgctctctgcgcaggatattattttctctgtttgtgttgtttgtgttttggtgtgttgttgtgatgagagacacacagatgttgtctctctgtgtgtcaccccgcgcgcgcgcgggagaggtccactcgggcggcgcgcactgtgtgtctcggtgtctctctctgtctcacacactctctcgcccctctctctcgcgcgtgttgacacggcgcgtgttgtctctctctgcttgtgtctcccactctccgcgcgcgtgtgtttggtgaggagcacacacgcggagcgtgccgccccgcacacacccgcgcgcgcgaattttttgttgagatttttggagagagacgagaagagagagtgtttcacccacacgcttgggcccgcgcgggtgtgttgtgtgagaaccacctccaccctcccacagtgggcgtccacccctccctctcgcggttgtccccacacacagtgtggcgggagagaaaaggggtgggagccccccctctcccccccccacaaataatttttttctggcgcgcggcgggagaaaacacacatttttttggggggtgtgttccacacggagagaggccccacctcactaaaacccccctgcggggcacaaaaagggggaccccttttcccaga

SEQ ID NO: 592565 - DNA, 1607 bp, Homo sapiens
ttgtagtcagcagacgagacgctacgtgtcgtcgcagacgcagtctagatcaggtcgagtgcgctccgcttcgtcgagcgctcaatcgacgcgttgtcttcgtccacgtttgttgcttagtgagtctgcttgttgcggcgcctgtatgttaccctgccgtgtgtttattactagaacgctgggcgatgttttctgtccttcttctgtgtggagctgggctgacatcgcttccgtgtcgtgtggtggccaacacaaaggatggggcgttgccccctctcctcctttaggcgtctgctgttgtgtctggcccccccctcccggtgatcgatacagattttagggggccacatattggtgcgcgcgccgcacatgttgctgcagccggctcccgtcctgcgtcgccccctccagtgctgtccccggtctgtgggggtagattataatctttgcccggtggcccgttgtgtcacggtggttgttctcgccgtctcgctgtgaggagcaggtgttgtttacacgcctctgcgagaggaggccgacgggttatcttatggattgcgaccaccaggaatattggtgggccttctttgtcgcgcctttttctcggggccccaagtgtatatatcgttttccccccggcggggcacactccaccccccgggggggtcctaaaaaccccccgtttgtcagaatagtgtgggcggaaccacaaaagcccccctataagccgggccttgggtaattgtccaaccgggtgcttgggtgcaacacccaggaagttgtcccaggtgtccaaaacacttgggttgtagagacattttctacaccaccggcgtgtgagactatatacggggccccccgcgatgttgacactttcgggagaaccccctcccaggatgtgtccaagaatacccacaggcacaagtgtggttccgccactgccggacacgcggtgttaaactcttcttccacagagccacgatctctctattctctcccgagaggattgaggtctctccccgcgccccgaggtgtttcacaacacgtcgtgagttgctcgccccacgctttcacggacccacattgcgtccaaagccacaatatacctgtgagaattggtggaactccgaagggattatgagccccctcggaatgtgaactctcttctttgttaaaaggagaacactaatttggaggaccgcaatgcccacaaaacacataatttatttcttatgtttgcctctgtccgtagtttctggttaatttaaaacttggtgttggcttgttcatggaaccccgcggtgaacactgcccgctaaactctcgtgaactgcccttggtaagtgccacactgggggtaaaccagtcctcgttgagtggcgcatgaaccctggagcttattccgccgcctgcccccagtgtggggggagataccctttacccatggacttcaccagaattaaagatggccccataaggaattcccagacccaatatttctttcctgccggtttattttatgttttatatattatctataatatctgtatatgctgtgtcatactcataattctggaaatgaattaagtgatatattcctggtttgt

SEQ ID NO: 592566 - DNA, 381 bp, Homo sapiens
  misc_feature (13)..(13): n is a, c, g, or t
  misc_feature (17)..(18): n is a, c, g, or t
tgacgagatttancgtnnacaccaggagctaaaatatactattataatagtattgcattgaccatgatgttggtctctcacatggaaacccgcgttttgatgtgagagaaggggagatgagagtcccatgcagtgtgggctgcttagtagaaatgctcagctcagtgggaaagggcaggctggggcagaaatcaagacgctgccagatatttgacaggccagggcttcggagccagaggccctctctgctctgttgtcctctcacatcaaaacgcaagggcaggctggggcagaaatcaagacgctgcccaagatatttgacaggccagggcttcggagccagaggcccctctctgctctgttgtctctcacatcaaaacg

SEQ ID NO: 592567 - DNA, 289 bp, Homo sapiens
  misc_feature (90)..(90): n is a, c, g, or t
  misc_feature (244)..(244): n is a, c, g, or t
cccagcagagcccccagggcaaggccccacccacctgccacctgtcctccctgggacacttgtaagtacaaagctccccagcctttgagnctcaaccccccaccatctgtctgtcctcagggaccctccagtagggggaccattggggacatcacagaagccactgtccagatggggctcaggcaagtgggtgtgggatgggcaatctgaaggatagacctggaaagtcccctctgataccccnaagccagccagccgggtccccaaggggtcaggacagaaccaacta

SEQ ID NO: 592568 - DNA, 114 bp, Homo sapiens
  misc_feature (1)..(1): n is a, c, g, or t
ngactatagaggatcccgctgatcctgctaggtcaggagctcaagaccagtctggaccaacattggtgaacccccatctctaataaaaatacaaaaactaggccagtgcgtgct

SEQ ID NO: 592569 - DNA, 838 bp, Homo sapiens
  misc_feature (454)..(454): n is a, c, g, or t
gctgaccagcaccatggcggtgtggcaagaacaagtcgccttacgaccaggcggcaaaaagtggagtcaagaacgaaagtggttgatccatttgtctaagaaagattggtatgatgtgaaagcacctgctatgttcaagtataagaaatattggaaagacgctcgctcaccatgagacccaagggaagcaatacatagcatctgtatggtctcaagcggtgtgtcgttggaatgtgagtcttgctgatttgcacgaatgagtgaagttgccattctagacaaatctcaagctgattactgacacgatagttcgaaggtaagaaactgcctagtacgtaacattccatgtgctatggcatcttacctcgatgagcaaaatgtgtgcctatggtcagaggagagatggcagacacatgattagaagcgtcacgatggcatgtcagagacttaccgnatggttgtactggactatcgtcccgttctgtgttcggttgaactagaataacgcacatgaatgcgagattacggcaatgacctcttgatggcctcagctaccaacaggtccgccgaaatccggacatgaagatgatggaatatcatgagccgagaggtgcagacaagatgacttgaaagaagtggtcaactaaacttgattccatgacatgcattggaagagagagcatagtaagaggtctttgccaatctattttatcctctccatgatcgtcttcgttagaaaatgtcaaatgctgaagaaggccaagtttgaattgggacccgctcagtggagcttcatggtgaaggcagtagttctgggaaaagccagctggggacgaga

SEQ ID NO: 592570 - DNA, 872 bp, Homo sapiens
tggcgaaacatgaactgaaaggactgcatgaccatccggtgaagatcgccacccgggggggtccacaccggaaagaccctcgtgaggaacggaaggggccgccccgactgctccgggccactgttcccgctacagcgaacccagagaacatgcatagacacacaccacccgctaacgtaagagaagatcgcatgttagtagggaccaaggcctgctgtattgctcaaagcgccaaaatcatggaatgctgccactcggtcttttcgtttaatgttctcattccttttcgcgcatggcctaggatggtctcgacaagagatgagatggagacttagcgggtctccaagacaagaactacgtaatcacactagtcggtatgaagacaattcgatgtccatagggaagcggggagctgcattccccttctgggctgctctacctgctaaatctcaggatgaacagagccaggcggaaagctatggggccaagcagtgctgtgtgcttccccgcagatagagaacgatgcgttgatcacaatagggcctcatgggtgtaaccgcatggcagaccccatgggctggcgcagcggcctgttgccgtgctgtcattcaagtaacgtgcttagcgtctgataacgtgttctattctgatacacgcgtgttgtttttacaacaggtaagtttttgtttcagaaatatgtattgcttttgtcatatttttatgcaaattgtattgtcaacatgggtcatttaaagtcctgtatgaaccataacctctgctgtggtaccttgtacatgtattggattctgattcttattccaagtgtggcaatgtgccccttctgtatctttatacaaggggaatagtgcttt

SEQ ID NO: 592571 - DNA, 238 bp, Homo sapiens
  misc_feature (107)..(107): n is a, c, g, or t
  misc_feature (150)..(150): n is a, c, g, or t
  misc_feature (186)..(186): n is a, c, g, or t
  misc_feature (219)..(219): n is a, c, g, or t
ccaggttggtgtcaaactcctgacctcatgatccgcccgcctcggcctcccaaagtgctgggattacaggtgtgagccaccgtgcccggcctaatctttgtattttnagtagagacagggtttcaccatgttgtccaggctggtactttnagccttcacaggctgtgggccatggctgtggtttgnaatggttgggaggctgtgtggtgtttgggggtntgtgggtctcccataccct

SEQ ID NO: 592572 - DNA, 445 bp, Homo sapiens
  misc_feature (5)..(5): n is a, c, g, or t
  misc_feature (35)..(35): n is a, c, g, or t
ttttntgggtgttttttttttttaaccactaatgnacaaatctgtaatttacttttcttgctttctaattttatttcatcttggaaaattaatcaacaagttcttctcatctcatctttggctttttcattgttctttgtgatatcttgactatggaatgttatgtataattttttactaagttataaaaataagtaaatttagtctattacaagatgattgcaaaaatcattctccttagaagtggatctcctagagtttaattaacaagggaataaaggatatggataaaatctttactaaaactttgaactaggccaggcatgatgtttgcttatgcctgtaatcccagcactttgggaggccaaggtgggaggatcacttgaggctatgagttcgagactagcctggacaacatagtgagaccctatctctaaaaaaaaaa

SEQ ID NO: 592573 - DNA, 132 bp, Homo sapiens
tatgtagacatgagtgcattaagttcctgaagcacccgatctagctcacagagcccggtacccgagacaccgctggaagaggcgaatggcggggccgccggggctgcaggcatttggggaccgaggcttgca

SEQ ID NO: 592574 - DNA, 379 bp, Homo sapiens
  misc_feature (5)..(5): n is a, c, g, or t
  misc_feature (35)..(35): n is a, c, g, or t
ttttntgggtgttttttttttttaaccactaatgnacaaatctgtaatttacttttcttgctttctaattttatttcatcttggaaaattaatcaacaagttcttctcatctcatctttggctttttcattgttctttgtgatatcttgactatggaatgttatgtataattttttactaagttataaaaataagtaaatttagtctattacaagatgattgcaaaaatcattctccttagaagtggatctcctagagtttaattaacaagggaataaaggatatggattttgggaggccaaggtgggaggatcacttgaggctatgagttcgagactagcctggacaacatagtgagaccctatctctaaaaaaaaaa

SEQ ID NO: 592575 - DNA, 155 bp, Homo sapiens
gctcagacaagagtgtgcctcagatgtttgagttagacttagtgaaagagaacaggaagattgaggaaccattttctagtaggagatggggctgagcaaagggtcaggctggggtgaatggtcgtgaagttgggtaccgaccgatcgaacatgtc

SEQ ID NO: 592576 - DNA, 101 bp, Homo sapiens
cgcaaagcatgtgggcacggtgggcaaacgcggagtggcagagcagcacgggacaggcatggcatttcatcatggaaaggagcccatgtcaagcagcctgg

SEQ ID NO: 592577 - DNA, 1106 bp, Homo sapiens
agcggaacgtgtaagggcaccggtgttggacggagtgcccctcagccggttacctcctgttacaggcccagcaatctaggggccttccggagcctcctgctacgctcttgtctggggcttccagtcatcggcggatcgattcaggtccgtctgcctccatggcactgggctctctggcgccctcgccgtttcctcctcgcggcgacagtttgccaggtgaagcagttaccccggctcggtcagtgaccgagggctggcatccaggcagacatcacgtatctcatcaagtgctccgacatgaggctacggggtgacgggctcgtggaggcagaaagaacgcaccaagaagaggcatagactggagaatgcatgaatgagaatgatcactcgcggttaatgctgactcagtttgtagacactacagacccagacataggcatgtcagaaacaatacactaccttacctcagtgtgagaaaggcctcattcatatattaacgtaatcatgctcgctggacaggtacacctcgcatgctgaccttcaatctattcgagcttgtgttatgcattcacgagcaattccttatgggtggacatggtttaactcatacattggaacgacacggagattggcaggcgctagggataggctcggaacgttgcacactccacagtaattatctcctccaattctgacgccaaggcagaacagatgtgcgcttgggagacaaaattaatacgcggagggcaaaatggccccgctcatagacagaggccacaggaagaactcttgataccgttttctatagaggaattcaaaccccctccttcgaagagttagagagccacatagctagcattcaatgtgagggagtagtgccgatagtatgtgccaaagagaaaagggaagttctttgagaatggctcctaggttttcaaagaatttccatctatttttttgcgcgttttcctatcgcattcacaaagcggaacggagagggaagtttcagacggaaagtttaaacattgtgacaagagggggtcaaaaaatctcttttttttaaaaaaggtaaggcgtcacaataaggcactggcgaattcctatgg

SEQ ID NO: 592578 - DNA, 101 bp, Homo sapiens
actgaggaggagctgtgctaagccccacccagcgctaccagtgcccgtcttcctgtcccatctgctcagagagaggtggggccgagactggatggacgagc

SEQ ID NO: 592579 - DNA, 795 bp, Homo sapiens
gcctgtgatgccatctggaatattgatgagccctcacgaacttgtaagatttcagtccatccaaagatccagcccgcgtgatgaaaatggggagacttcggttattgtcaacccattgtggaagaactgctggatccgtggcctggcgacccagacacttctggggatggtaccagggtgtgcaccgaccatgacctgcgatctatcatttgcttcaagcccctggcaactcccccagagctctccatgcccagagagtggccatctgacaactagaggaggtgctcttcttactgagggggctgaagaaaaatggcaacagctgacctagaagaagataggctcctatctgtagacttgccagtctactcccgacccctgcccaccctagactgttttctgagccctccggacctgagactgagttttgtctttttcctttagccttagccgtgggtatgaggtgtccacgggggaactgggtggcttcactccgcccattcccaagagggctctccctccaccctgcagccgggagcctctgctgtcctttccagccgcctctgctcctcgggctcatcacccggttctgtgcctgtgctctgtttgttggagggaaagactggcggttctggtttttactctgtgaactttatttaaggacattcttttttattggcggctccactaggccctcggccgctcgcaccccgctttactgattgtacacattcaatcaacccaactttttcagaataaaggcccaaacctaatccttactacaaaggagaaata

SEQ ID NO: 592580 - DNA, 724 bp, Homo sapiens
taggatgagcgcatctgcatctcgttgggtgcaagaagaaacctttgtgggaaagacataaagaaagaagccgagcttggtatgtatatacaaggtttggcagtcttgggtctaatagtccgcgtggtgccggtctgtccacatgaggaataaaatgccaagccggcgttcatcgagggaaacttaagggttttatgttccttccgttgtataagtgttagagagccatggcccagtctgccttgttggcgggtagttgagacgggcccacactatcctggtggaaattctgttatacgtcgaggggtttaattgcggtcatattagcaggggtgtggggtgaagggccttaaaacccaaaaaagcaacctgcgcccagttaaaaaggtttttcttcctgtctggcctagggagcctcggatggattaaaattttttggggggagggaggaagatttttaggtttttttaacgcagttatgtaggccaaggacctgtgggggctatgttctacagggttctcccatgagggtgctttaaatgaggggtatttgtgggtgttgtcagaacatcagctttttcgggttccctgccgggtaaatgggccccccctaatggttggcttagttcgtttttttttggttcaataggattaaatgccaaaacccatatcaaatgttggccaagaagaacattttaaagaaattaaaaaaacagtaaaaaag

SEQ ID NO: 592581 - DNA, 183 bp, Homo sapiens
agcggagctgggggcaagacggtgatgaataccaaacaccaagacctcccgcctgccatcatcgatgtggcccccttggacgttggtgccccagaccaggaattcggcttcgaagttggcctgtctgcctcctgtaaactccctccatcccaacctggctccctcccacccaaccaactttcc

SEQ ID NO: 592582 - DNA, 345 bp, Homo sapiens
atccggtcagtggtcctctcaatagttcccagatgctgggactgttggcactggtgccaccacacctggctaattttttaaataaaagttttgtagactgcagtctggctatattgcccaggcttcaagtctacttcctctttcttttcttttttcttttcttttctttctttctttcgttctctttctttcttcttcttctttttttttttccagtaggggggaataggtagcattgggttgcttggaaaagttctttgggtgattcctgagattttgacgcacctgtcatctgagcagtgtccagtgtaaccattgtgtagtctttggtccctcattgccctc

SEQ ID NO: 592583 - DNA, 165 bp, Homo sapiens
tgtatgtgtcatcgtcatatctgtgtgtgtatgtagagagaccctgtctgtgtgtgtgcagaggcacactccgcgtgtgtgcacaagcgctctctctgtgtctctgtgcgcaagcgctctctgtgtgtgcactgtgacactcccacagggatattctatagacta

SEQ ID NO: 592584 - DNA, 531 bp, Homo sapiens
ctctcaactaacatcagaaacaatatgagtatgtacattgctatttatgctattcaatattatattgaatgtcttagtcactgaagttaggcaacagacagacttaagtgtcgtatagatttaaaaggagattcaaaattgtggttgtttctaggtaatgcaaatatatagaaacttcaacataatttgtaaatcactttaacaaaattgctgaataccgatgtatagtaacaattaataatgtgccattatagcaatgacaaccaattacctccaatgtgctttttaattttggtattactttttggggggctggaaggtgtttacaatcacttttaatgcaatctttgctccattacataaatactatttggtcagctcgaatgtgtcaggtaacatagcagatctatttctgttaaatgtcattctcttgttggtttatatttgtgcttttaatctcaatttttctatttataactttttaacttttgtatagaagcatgtcatactattataaaacatattgaattt

SEQ ID NO: 592585 - DNA, 465 bp, Homo sapiens
  misc_feature (30)..(31): n is a, c, g, or t
tccatcgaaagcattggaggcccagtgcannatgtcacgcctgtgatcccagcactttgggaggccaaggcgggtggatcacgaggtcaggagatggagaccatcctggctaacatggtgaaaccccgtctctactaaaaatacgaaaaattagccaggcgtggtggtgggcacctgtagtcccagctactcaggaggctgaggcaggagaatggcgtgaacccggaaggcggagcttgcagttagccgagatcacgccactgcactccagcctacatgacaatgtgacactccatctcaaaaaataataataataacaatataagaactagctgggcatggtggcgcatgcatgtagtcccagctactcctggggctcagtcaggagaatcgcttgaacttgggaggcggacgttgcagtgagttgagctcataccactgcactccagcctgcacagagtgaga

SEQ ID NO: 592586 - DNA, 971 bp, Homo sapiens
  misc_feature (1)..(1): n is a, c, g, or t
nttgtctctggcttactgtactagtccgtggatttggtcgcattctatttgtcgcccacatggttcctctgcggcacgtgtgggtatttcactgtggcggcaacgcgtttttcccgccctcggtttttgccaacaccctggcatttccccacctccggtgggccccacgcccctctggagcgcccttgcgaacacacaggggcccgttggcccgattctccgccgcttggggccctcgctccccgcgctcacttgtgatgggggccttctaccacgccccttgtctggcttttacattcggcgccgatcatgctgtgctctgaaggcccatgccactctttctctcgcatactggcccctggacaacactcatgggtcaccgggggttctttctgtgatgcaaaacacgcgcggccggcgcccccttgttttttcagtgcgtgcttggaaaaccctccgtcggcacatagaggggggggcctcgcccccccgtcgcgccaagtaatgcctcctggccttggtggataacacagtcatcgccgcctcctttgtaggaatgtcccagacgccggagggtatggtctcacgcggacgggcgcgcgcccgcgcttctgggtgacccgcgcgggaatccccccctgcccttacaagggggcgatggaatgattaacaacaggaatgtggggagcccacggcagaactcgcccacgaaggttggttggtcccccagaggacggtcgctggcaagaataatctattttgcaagagagtcgtccctgtctgcagagctgcgtctcagagaaccgctttcttgacgcgacgaggaaattctgaagggccgcctcccgacgcgcatcgtaaatagaggtccttcttgcgatcataggattcctttgtcccttaccaacccgaatgagcgcggcagtgtctttacactcgccaccacccctgggccccaaacaaacaaaaca

SEQ ID NO: 592587 - DNA, 302 bp, Homo sapiens
actcgaagctctatgcgggcgcatgcagcaagatcatccggggcacggcatatctttccagcggctctcagtccaggtcagagtattcagtagagctccactgactcagtacagaggcaggagccaaggccctggctaatcgtgcagtagaacgcacacaccgggggcagtcggtccgtctcattagaatgcaaagggccctggacccatgagtactcatacagatccttgttttcacttgggactttacttggatcctggcactgctctcgggtgaggttgaccacttccagcccacagtg

SEQ ID NO: 592588 - DNA, 1361 bp, Homo sapiens
ggcacgccctcgctgcgcttccagtccttcttccctctccccgtctcaccgtgcacgtgtcagctactcgagtgcgtcttggatgcctcgcggccctgccaactatgctgccttcgtccagtccttggccgccagggccgcagaagcgcgcgggcatctagcactgggcagacaccgattgtccgcctgactgggagaggatgagaggagctgtcggtgctgtcgctcatcttggtcctgcttctacacatcagcctgcaccccaagtaccgtctacgcatgtacggggacattggcggtgaacgcatgctggacaacgcggtgctcgtcatgtgccagatgcgttctgatggtcattcgctcaatgttccccgtatcttgagccttgtgcaccacaagatgaagtccactactgccgtctccttcacaccaccaccagacgaacgaatgtgacatgctacacctggcatggacgctgcgcctacaagctggcttggatgtgcaggcccgacggacgcggcaggaaacgacgcgaggaacgcgccgcacggatgccttggaacagccagcctgcgccggcacgcgcgcgccgacgccacgcagcgccgagcgtgctagcaccgcacaggccgctcggcagcgcccacataaaccacactttgcacggcacgcccacgagcggcacgcgacgcacgctcaacgtactcagcatggcacgcttcaagccccaggcagaactcccgcggcagtgcacaccctgtggcgcacgtgcgcgaagcggcaaggagccgagaaaggagctgacacgaccggaaccgcagatgaccgccagcgaacaccacgcgacgcagcagcacaccgcagcactgtcccagaggccctaaagcgggcccccctgggacagacggccgagcgacacaactacatgcagacacgcaccccgcgctaccgggacccagggacacgctccggccacaacactcgggcccacacagcaacactaccaggtctcctactcattacacgcacgcgcagtcctcacggcaataacagcgaactgacacggacacaaagagggcacagtgcagtgacaccgctccagggcgacagaccaggaccaccaggcgatcgcaggacaacgacccacgcgagaccacaaccacgtgcactccctgcgcggcgaactacccgccacgtatcacgagggacccccgtgagccgttctacgaaacagtgcgccgaacactcccaccacagctaccgcttacgataagtgaacaccaccagagcgccacaacacgcatgacgccacagcagaagagaacaaagccacccaacccagccacaaacaacagcagaca

SEQ ID NO: 592589 - DNA, 233 bp, Homo sapiens
catccaccgttcaaacaagatgtatcacctatagaaagaaatgagcagcttaggataatgacgacagcaacccgaagacagggaaatttaggtaaaaaccaacacagttatgacgttcttatacgttaacgtgtccatcgtgcttggctttctctcttacgccttgtggccgatcaccgtggtccaatattgccaacgtgtcttgtcctggcttactgcaacagccctttgtg

SEQ ID NO: 592590 - DNA, 258 bp, Homo sapiens
gcgtcgaccaaggtgggaggattgcttgaggctaatcattcaagacaagcctgggcaatagagtgagaccccacctcaacaacaacaagaacagcaacaataaataaataaatagctgggtgtggtggtgtgtacctatagtcctagctactcaggaggctgaagtgggaggattgcttgggtctaggagttcacccagtgaactatgatcacaccactgcactccagcctgggcaacagagcgaaactctgcctctt

SEQ ID NO: 592591 - DNA, 423 bp, Homo sapiens
  misc_feature (45)..(45): n is a, c, g, or t
  misc_feature (148)..(148): n is a, c, g, or t
gcgagaaagggtcgcctgcgttttgggaggtgggatggcgcaggnccgggaaccgtcctggcgcgccagccagcgcttagataagtccaggtttatttatggggtgctgtcacgggcggcgcgggctccgggcgccgcttgagcgtgnccgaggcgccgctgctgaccatgaccgcggggtagagcggctcgaggaaggctgccaggaagcggtagaagaggctggcgccacccgccaggccgtagaaggacaagccgccggcgtcgcagtcgagcgccacgcccagcgtgcggtggtaggcgccgtgcagcacggtctgcgcgttgtcgtgccacaccgataacttgagcgagtcccactccaggcaccacgagaaggggttgcggcccagcaggtagaccacgctgcggctcgggcggccg

SEQ ID NO: 592592 - DNA, 264 bp, Homo sapiens
caggctgaggacgggtgcgagaggggtgagaaattctcattctcgagtacagtatggggtacagtgtacatggcttgggtgatgggtggaccaaaatcctagaaatcacctctaaagagcttattcatgtaaccagaagccatctgtaccccaaaaacttgaaataaaaacacaaacttagacggccaaaatataagttggattctcactttgaatctcacaaatctagtattacaacattaacaaggaacacattaactccta

SEQ ID NO: 592593 - DNA, 107 bp, Homo sapiens
catgatcatattcgctgagtcctgatccagtctgtcataccacgagaggaaaatgatcatttaatttaccttcagctacctcatctgctgccttcattattgcatta

SEQ ID NO: 592594 - DNA, 386 bp, Homo sapiens
caagtttagctaagacctgctcgaactgattccacttttgaaatctctgaccttatttcatttccattgtctgtctcctcagggtcaagatcttgtggctgggactatcttgagtctcctataaaaactattcttgccgggtcgcggtggctcacgcctgtaatccagcacttggggaggccgaggcaggtggatcacgaggtcaggagatcgagaccatcctggtcaacatggtgaagccccgtctctactaaaaatacaaaaattagccaggcatgatagcacatgcctgtaatcccagatactcaggaggctgaggcacgagaattgcatgaacatgggaggctgaggttgtagtgagctgagatcatgccattgcactctag

SEQ ID NO: 592595 - DNA, 901 bp, Homo sapiens
aaaagaaacgcgcagacatcaaaagcgcgaaggtcctcggtgtcatggcaaaggagtaaaacccaccacgggggtctcaaccccgagccggtacaccaacagggtggccccaacagggtgtctcggtgggagggcacaaagggccaaaccactgttggggttgggccccacctgacacagctcgtggtgccacacgacgtgagatgagagtacacagaatgttcaaagagccagcccccgtgccccttattaggaccgcatttctgccggcacaaacaacatattgaacccgtgtggactctgccccttgcggttatcgacaacgccaccccaatacagctgggtttgtgtaccacagcacgcgggcctcaaatcggggggacgacaccaccacccgtacattctgggtgaaaaacacaatagtcgatgcgcgagatagcacaccacactggtctaaaatatatgcgcacccgcccatgcgtgcctaaccccaaaaaggcccccaccttcgggggaagtcccacgggtgggagggacaccccgtaaggtcacaggggagttctgacccccccggcgaaacatggggaaacccgtggcgatcaagaaaacacggggacaattttcgatgtgggcgacgttgtggggcggccaccacggtgcaccctaaccttggccagggtggtgaccaacaagaatatggctgttacccccggggaggccgggacctgcctggtggagacgtggagtatcgccgcccggcacccaccccacggggagcccagggaccaaacacgctggcccaggaagaaaacaaataaaacaaaaagcgaaaatgttttaagttttccggccctacccacattacaaccccccgggaaataccttaaccctccaaaaaaca

SEQ ID NO: 592596 - DNA, 356 bp, Homo sapiens
tcggagctataacgaacaggacaaaaattggttcgggtgttgtctatgctactagtatatcactcatgaagttcttagaatacaagtcaatacaagtaacagtcttgttgcaccgtgggaaaggtcgtgaattggaaaacccctgcgggtagttgttgggatattataatgctgttgacggtttggtaagtgtggttttgtttgctgtatgatttttttctctcttgctaccagtatggctatgccagacaaaccccccagtcccgggagctaggaagtgtttaggacgggtctggaatacacaccttggtagtacgccggctccagggctgagggctcgatggggctcctggtgg

SEQ ID NO: 592597 - DNA, 257 bp, Homo sapiens
atcagtcagagtggggcatggttggtgggcacaggcagattctgatcaagccgatggttgcctggcacaaaaaggggcagtgatcaggagcacttcttgagacatctgaaggatcccagcttcccagcttcaagtatcccttccctccttcacctcttctgtccccgaggccagacacagacatactggaaaatatccagagaaggagaccatcccagaccatgtcacttaactccacaggactctgggacgtgctc

SEQ ID NO: 592598 - DNA, 102 bp, Homo sapiens
cggcgacggcggccgcagttggtggcccaggaggacacggagcttcgggacctcttgtgcagacgctggagaacagcggggtccttaaccgcaatcaaggct

SEQ ID NO: 592599 - DNA, 286 bp, Homo sapiens
gcgtgtgtatgtgcatctcggtcatgcactcctgctgatctcctgctcagctgccagtgctagattgcaggcacgcgcgccagcctgatggttttcgtatgttttgggtggagacggggtttcgatgtgttggccgggccggtctccagctcctaaccgcgagtgatccgccagccttggcccaccgaggtgccgggatagcagacggagtctcgtacactctttgctcaatgagtgcccaggctggggcaggagaatcaggcagggaggccgcataccgagctcg

SEQ ID NO: 592600 - DNA, 407 bp, Homo sapiens
ttcacaggtcacatggtcacctccatgcacagtgctctggggtacaacaagaatgtcgaagaaaattatgccagcatccaaagggaagcgacacagtgcctacagactcagttcacaccaggcctcagaagagccacacgttctgaaaaagtcttggacagcccgggtttccttaatctctggtaagtaccggcctgcttggcgcatgcaccaaacggaagtgtagtctgtttcctctccccagcctgctcgcagaaatgtgtcattcttcagctccggaaaaccttaaggtcccaacccattcgcttccatggtcacctgtctgtaactgagagctcaatccacaatttaacctgaatctgagcgtgccccacagtacaggctccgcccctttctatagggaccca

SEQ ID NO: 592601 - DNA, 462 bp, Homo sapiens
cacgagggcggccggccctcgacgtccagtcgaacccgcgcgggtttgggtgcccagacccggaattcggtcttctgctcagtcatggtgtcgctccagcagcacgacgggcagttcggcgaacaactgcgcggccgacgtcggcccgtccacgacgctgccggtgagggcgtccttccaggtgccgtcgggcagcggcaacaccgtgttgccccaacctttttcggccagccggacggtccagcgggtgaccgccaccacgatgtcggcgccgcgggtaaaggccagcacgtgatcgcaggcgtccccgtcggcgagcaggggggcgtagtcgccgtgcaggaaggtatccggatgggcccgccgcacccgcagggcggtggtgaccacccggatcttcggatgctccaacgcctgcagcgcggcgcgccgcgcccggtagtcgactgggcggcgattgtc

SEQ ID NO: 592602 - DNA, 1439 bp, Homo sapiens
  misc_feature (499)..(499): n is a, c, g, or t
  misc_feature (823)..(823): n is a, c, g, or t
ggccaacgcccgctgttcggtttgccgagtcgcagtcgggatgttggcaggaccgccgtcgatcagggcttcgcagacatcagaggcgaatctcaactgtgcgaaagatcgatagctggtgcttctcaaccttctttggtcttcgtctcggtgctgcgttgctgcttaccgccccagatgagcatcgccctgttgcctggccgtgggacgtctttgctggacatcgccttccgagcttcgtcttgtgtgggaccctgcgcgcgttcgtcagcttgtcatcacttctcggatggccagggcgccgcaattcgcgtgtgagcacgtcgcatgccaagtgcgcaatcgcgtcagacgcgacgtcgttgcgtttcctcgaatacgtggtgagactttggcccttcccatgggaagactgtcacttgtggcgtactctcacccgctcgtcatgtcccgagaacggagacgcgtagtcagagccccctcccagacgcgtgtcgtntgtcccggacttagcttcccccctgtatatcgcccgtctgtggtgctccgctctcttcgctatggtgcatgtacatcgcgtgggagtccaggtccttacccccaacgcggcccatgacaggcggggtgagcccctggcaccttgtgctcatcccgtgcctgatgacccccggctcgggtggcttcgaccagttccgcttcggtcctatatggtaagcctttctgacgtgtctggttttccacggggggaggcgtcgcgataagagcggggttctacccaggtttttcccctcttgcccattttggtctccttaaagcacaagcncctcaaatgtactccccggcttcgcaacggagggcgcgggcgtcacccccgcccccaagcaaggattagggattccttggtccttattccggggtaagacgttagcacagactaacataatacccttggcccctgttaaaacgttgctgtggcgaccaacccccgggggccgtgcgcattgcgaggtccccttggaccaggcgcacgttgccatcctcgttggaagcccaaccaggaggaccctgctttgtggcgagtcacaaggcgtattttaccgacgtgccccctctgatagaagagttctccgatgcggggggtttgcttccaccttggtccccacacttgtgtgtcggtggtggctcccctgtgtaggccttggggtccgtgcctttttctgccgcttggagagttgcgccgggcatccataccaggtcttttgctcctccccgtgcgcgccgccaccctggtgcccagtccgggcgcctttgcacccgagagggcgagaagaggaaggccaggtggcccatcattcccctgtgtgcaccctttccacaggaactggggggtgtatcggaagggggcacggcatttggccctcagggcagtttccccacgg

SEQ ID NO: 592603 - DNA, 263 bp, Homo sapiens
acttacccccggttacagagcggggtcagcagatgggcatcaggcgaacatgttctgttcctggtacttgcgccggctggcacagtgggggcagcccttcttcgccacagcctggcagctctggtggaagacggtcttgcactcggcacacctgactgtggtgtcaaactcaaaggggaagatgatgtcgtggtgctggcagatctggcagatgaagccgcgctgtgtgcacaggtcgcagtggtagacatgctggtaggcag

SEQ ID NO: 592604 - DNA, 396 bp, Homo sapiens
tttttgtttccgggaggtggtaatttgtggcccacccagatggagtggggcatgaagttttggtggccccccaattaagccttttttgccttcttcttgggttacagttacagtgggggccctttggttttgggctttttttaccaagggggtgggggccccttcggccatttttccgtttccgagtacgggggatggtttggtttctttagccgagagggcaaggtggccttttccttcaaggggggttcttttaagggtttttttccggtgccccggggcctacccttttggggggaatttttgggggccttttttaaccgccccgccccggcccctttccccgcccccccccccgctttccgggggggggatttaaggttgggtccgttccca

SEQ ID NO: 592605 - DNA, 309 bp, Homo sapiens
aggatcacattgccatttttagcaaattggtatttatacattgtttctaattttgtgcttcaggaacactagagcacaggttttccttgcttgcccatctctgttgtcactccgtagtgactggctgccggtctctttcccatgtcctcttgtggcttaatttcctcatgttgacatgctaactgccttccattagccttcttttgggagtatgcaaatgtttgctagtgtttgtttgtttccatacagtggcttctttgaattcccctataagtgagtccggttatttaaaatttcggtaaattcaat

SEQ ID NO: 592606 - DNA, 879 bp, Homo sapiens
  misc_feature (334)..(335): n is a, c, g, or t
  misc_feature (339)..(339): n is a, c, g, or t
  misc_feature (359)..(359): n is a, c, g, or t
  misc_feature (362)..(362): n is a, c, g, or t
  misc_feature (370)..(370): n is a, c, g, or t
  misc_feature (381)..(381): n is a, c, g, or t
  misc_feature (384)..(384): n is a, c, g, or t
  misc_feature (387)..(387): n is a, c, g, or t
  misc_feature (422)..(422): n is a, c, g, or t
  misc_feature (427)..(427): n is a, c, g, or t
  misc_feature (439)..(439): n is a, c, g, or t
  misc_feature (442)..(442): n is a, c, g, or t
  misc_feature (453)..(454): n is a, c, g, or t
  misc_feature (457)..(457): n is a, c, g, or t
  misc_feature (459)..(459): n is a, c, g, or t
  misc_feature (470)..(470): n is a, c, g, or t
  misc_feature (475)..(475): n is a, c, g, or t
  misc_feature (477)..(477): n is a, c, g, or t
  misc_feature (480)..(480): n is a, c, g, or t
  misc_feature (485)..(485): n is a, c, g, or t
  misc_feature (497)..(497): n is a, c, g, or t
  misc_feature (502)..(503): n is a, c, g, or t
  misc_feature (508)..(508): n is a, c, g, or t
  misc_feature (516)..(516): n is a, c, g, or t
  misc_feature (548)..(548): n is a, c, g, or t
  misc_feature (835)..(835): n is a, c, g, or t
ccctgggtttattaagctcctggctccgctctagacctcagcggttctggctgccagcctgggcagcctgggaagcctgggaggacggtggcttgcggtctgtcgtgaggcagtgcggacggggacctctggattctgctggatctgcccgggggttacctttgggggctgggacccagtcgaggggacacaaccgtcctggcagtggttggttctgcttcccctgcagaaaagcagcattttcggaagctgaagaataagctacccagcacaccaccttgttgtgtgaccttgaggcaggtggttctgtctctctgagcctctgtttctctcnnagcngagcagccaccatggctganggncagatgcncttctcctgcnacnacncaagccgcctgcgccgagaccccttccgggactcnccccncacctctcgccngcnaggatgaaggnnttngnaaggaccccancccananganttganaaactcaaggcnaaaannggatntgtttttntttttttttagcatgaaaaggcaaacaaaggncgggcatggtgccccggggccccactgccaccgccaggtttggggtgcctgccgagggcaggacccccccacccttccctggggagccctggaaagtgtgtgtgaatgtgcacagcttcaagccagaggagttgatggtgaagaccaaagatggatacgtggaggtgtctggcaaacatgaagagaaacagcaagaaggtggcattgtttctaagaacttcacaaagaaaatccagcttcctgcagaggtggatcctgtgacagtatttgcctcactttccccaganggtctgctgatcatcgaagctcccccaggtccctccttactcaa

SEQ ID NO: 592607 - DNA, 288 bp, Homo sapiens
agcatgacaacaccgtgggacgtggcattgcaggctgagggtgcagtaatgtgcataggtgtgaagctagtgtttcccaggcacagtgggaagcctggtctcagtagagcagagtgggccagggttgaaagggggatgtgtgtggcgggagaagtttgggtcaccatatgtgagggcatttctcctctgtgataacatttactccacaaaagttgacatttgattaaacatatattttcgtattacaaactacactatattgtgctacagtccaaatgcgcatacctt

SEQ ID NO: 592608 - DNA, 454 bp, Homo sapiens
tgtaagtgtgagagagggataagaagtgtagttctgttttggaattctttattggttttaacggatactctttgtgaaaaatttaagtaatattttagtttaaatttgattttgagtcaaggcctactgccacttttgggatgggagttggacctacataccaagtgataagttcaccttaacatttgctttcagaatggctttgatttagctgtgtcaggtaacagaacagggttagactcttgttttgttattggcttgaagattaggatcccaaaggggttggaggcagggaatatttgaaaattcagattggaatttcaggccaaaagctcaagaccaccagcctctcctcctgcctggaaaaataagcctttgtgaaagattgatttaccatgtacaattgtgattgtgaacgttgttgagtaaacctccagactttctctaaaaaaaa

SEQ ID NO: 592609 - DNA, 784 bp, Homo sapiens
ggagcgggacgtggcgccgtctagccaggcctgggctctgtggcgggcgccgcagtccggtccccggcgctcctcccagcgcagacttcaaggtgctaccatggacccttcccctgtcttgaaccctgagccggcaccatgcacggacgcctgaagggtgaagaccgtcagaagagcaggcggaggccaaaggggctagagcgagaggggaagctgaaggctatacccatgtcagcccaccccaggccgttatccagaggcgcaaggctgtggagctgcatgacgtcccgtgcgttggaatggacaagccagattctggggagccaacccttgattttggccactcttctgaaccgtgcagacgaagagggtgctccaagacagttggaggacctcaaggaagtctcctggaagagtgtgggatgctctgctgacaggcacgacactggggcttcctggacgagctgactgtgcggggtgaacccccaagtcttaatgttaccgtgggacaccggatgctggcttggtaggacggtgcttgagcaaaattgaccgagagtggaaggtctggggccccggcttccctgcaggtggattgcgcgggacctttcacgttggtggcgcactatcggggggttgtggccacaagggcagcggggcccttgagaagagtaagcttcatgaaggttattaccggattttcaagttgtttcctggattacgctggcttggccggtggccccaggggatgcacggggcctggactggtgccacacggccggta

SEQ ID NO: 592610 - DNA, 125 bp, Homo sapiens
gactttcgaggaaatacccccctacaaccctgccctttagcagggcttccttgccagcgttgggagttcctgacttaagccctcaccaacccggaccctcacttcattcctgaagggctaccaac

SEQ ID NO: 592611 - DNA, 188 bp, Homo sapiens
tttggccccctccccgggcccccggggcccccgccctggtttgggccgtttctttgcccatggccccaaaaaagtttttgggccctttagcccccctttttttcttgtttcaaatgatggctgggatactggtttcccccccctttgcttggggcaggggatggctttaattaatttcttttccttta

SEQ ID NO: 592612 - DNA, 1101 bp, Homo sapiens
ggaagatggccggctccttggcggctcggggtccgccagctgtgagtgagccccgagcactggctgtcgcggctgaggcagatgctgcctctgcgtctggccctgtcctgtgctccctcattacctgtctgccatggctggagcgaacccgagatgcgtggagctgggcttgggcacagctgttgagtggcaatgtcatggccagctcctcgagacatgtgaagatgacagtttcatggcttgtggaccaggaagaaactgtgctggaagggacaattggatcaagatgagtgaggccccaaccagtatttggcaggctgaggagactagacataaagtaggtccatgtcgggagctgccagaagaggttaatggagtatatactgtcctttctctcaccgtatcacggaaccacaaaaactgcgtgaccttgatctgcaaaagcacgatggtagtcgacttatcaaaggtgtacgccccagtcagatgtaatcatggtccccattgaaggggcgtgtccaggaacgggaacacaattccagtgggagaaggccaggtaccatatccttatacctggaaaccccaagacactcagacaactatctcagcacagtgcagtgcgtatacatgagtgctaatcagtctatgtatagtgtcaccgacgggctagtaacacaagaaggagacatgcaaatgcatggataacaagtgaaccgtctgcgagaacattgaacttaaaccaggcgaaaagaaagtggaataccggaccaatattggaggaacaagggcacctaacacttagcgcgcaaaagagtagggagacaatccatggaacaggaagataaccacagcgggaccgtatagacaaagagagagcatggaaaaggggaagggacacaagaaaacattacgatgaccaaatgaccagcataaagtccacgcttacgaccaaaaaaccaacaacaagtaatgaccaaacatgtcaacaacatacgaccggtaagatacacgccgtaaacaagaaaataggtggaaaaaacatgacaacaccaagagaacacaagtggacgacatccgagattactacgctcacccgaagcg

SEQ ID NO: 592613 - DNA, 788 bp, Homo sapiens
gtgggcccctgaggagctttgtgtcgtcttgaacgagcagcccaggtcctagaggtaaccgttaggcgggatttatgtgcactggctgcatgagctggcaaccagacagcgtcccttggtgagaaagggattgctgaggcacctgtcacaggcctccaccggccagtgcgcgacccagcagaggcgtactacaccagcgtctgatcctcttgagcatccttctgtgtaccacttccatgaggactcattatgggggtcatcttggaaaggggaggagcttctcccagtgtgagacccaaaagactctggaggtcatctggcggagagtctctgggagaccagaaccacacataacaagccccagcttggcatcacaaaggcccaggagacctccagagtaaaaaccaacccctgacctaccaccagacaggctcctaccatgtatgctgccagcacagtaggtcccggacagctctggagtactctccatcggaggcccatgcccgtaccaatccaactgccttatggaaacggtctctctccaaggtcagcactggaagggacacgtatcgataagtgtatgaacatgccacatgggacagcctggctgcggcttcaaacaagcaagtccatacagacatggacctcaagacaaaactcacgcccagaacttgcacgtacagaatgagcagccttggaggcagggggagaggggcaggagagaggccggaaacaagcaaagaaccaacacgcgaacacccagacactggacggagaggaaccaagat

SEQ ID NO: 592614 - DNA, 128 bp, Homo sapiens
gaaaccctaataacggaatgataacatgttagctatcaggattgaatcttagaattcatctatccttcatcatcaaaactccctgaggtgagcttaattaatttattgattgattgatttaagtctct

SEQ ID NO: 592615 - DNA, 164 bp, Homo sapiens
ttgtcccttgtggcatgtgttaatgatttgagttgattgctggccatggctgctgtgttgcaactagtaatcccacaagtgtttggacttacattgctgttgatgacacgagcgccctggacgtcggagagtcaatctaacatagataacacctatctcatccc

SEQ ID NO: 592616 - DNA, 771 bp, Homo sapiens
tcatcggattatagcaataagacctgacgattaccaagaaggactaacaatcggaagactgaccagtgactttagtccttgggagaacttgagcccacggctgtcttgctgcctgtgacttactggtgtggaaaatagcccccaggtaggacccttccagtgatgggccaaaagcgtctttcacccggaatccggcaccagtggcccttctgtgacacagtgtttataaaaaatggttaagttatataataagagtgaacactctttgagattggagaattatgtgagatttccaccagtttttagctgggttccatactgtccctgcttgttttattgcccggccagcccaggccaatggcctataaatgctgtggcttatattttgataagaaatccaaaaacccttggttaaaagatgccactcacgaagtctggaagtattctgaaagcactccctttaccctcccgttgacacggtttgagtctcctgcttgtaataggtgaacttgtgccccatgggtacacattaaaggaacactgctgcccacgggcctgggcggacacgctcacagtgggcacggaatgtgtgctgggtctcacgccccccattgtgcctgcttgctgggccgttagtatagggccaagcctgcctgcggcgaccctggctgctaggcccttctctagggaccgctgcgactcataaagacccagaagcataaataaacttttccaaaatttatttggctctttcgttaaaaactgtgccaa

SEQ ID NO: 592617 - DNA, 446 bp, Homo sapiens
tgattgtaatcactttgcgcgcattctcgtctctgctgatgtcttttattcctttgaatgctctgatccctttatagctggcgctctcagtctactaaaaaacaatttttcctgtcgaagtataccccgcaccccgtggtcacgcctgttccccagaactttgccgcagggcaaggtaggccaatcactctgagcgtcgcgagctctgagaccagcctgtacaacatggtgaaaccccgtctctgctggaaatacaagaattagctgggtgtgatggtacacacctttggtcccagctactcgggaggctgaggcgggagaatcgcttgaacctggaaggcggaggttgcagtgagctgagatctccattgtactccagcctggctacagagcgagactccgtctcacaagaaagtaaaaaccactacgtgtagacttgattcctc

SEQ ID NO: 592618 - DNA, 996 bp, Homo sapiens
ctggggtgtatgtttcgtgatgatggcgatgatgacagtggtgatgatgatggtgataatggtgataagatacgagatgagactgacaactgctgcgactgacactgactgacacatgactgacgactcacgatgacaccgacgttgactgacgattgactgccgactgaacactgacgactgaccccgatgaccactgactgacgatgacactgacattgactgacgactgacctgcaggtgaacttgaccttacgactgacactgtccctgccgcattgacacttgacacatgaccatacatgcacactgcacacttacatgcaacatcggaggactggacacatcacccattacatgcacacatcggcctcgaccacttcactctgacacctcgcaccccacttcggacactcggccccactctactcgccgaattcacgcacaactgcactcggacagactctgccaccctcggactcgaccaactggccgacatgcagcactccaccaattgaagcaacttggacagactggcactggcacggcactgacaggattgcaccaacattctttgaggtcatggcaccacttgggaccccttaaaattgaaactggcaaacatgggcattgcaaacgacgggcaacattacaattgccaaaattggggaacatcgccatcggcagcctggagcacatttgcccactggccggttgggcaaccacttgaggcactggacacactcgactctgaccaacttggccttgcaggaccttgggaaaacattggtattgggaagcacttgaaagcaattggtgcaattgcacgaactgtgaaccatttcggaaacatcggattggacccataacaacatatggacagatcgcaaaataggcagacattagtcaccatgggaactgacaactgacaccattgcgcacatcacacacttggccgaactcgaacctgccgtaggagttgccagcctacacaaa

SEQ ID NO: 592619 - DNA, 1631 bp, Homo sapiens
  misc_feature (287)..(287): n is a, c, g, or t
tggtctggaggaatggggacaccaaaactcattgtggcagcagaggttgagacgaagctttcacaaaagagtgtctaagcaacagccaacctcagttttataaatctccagaaacaccgtggctagtgttgtggattttgcaaacctctccccaactcaagtttcaccgaaaaatctcaggtgaacaaagaggttttggaagttctccacacgtgagtgggtggctcgggtgaaatctcaggctcttagagacaaattcggactctctctcattacacacgagcccntattctcctatacacgtgaactcgtgtgtcaccccgacgaaagagagagtctctatacacgcgtggaagcaccccagcccagacaacacacatacttgacacagagacacacgtgtgctcccgagatacttgggagcgccttctccacaccgtgtgtgctgacacacactgtgccacacgacagcgcgacaggggggcggtctctacaacggcctattcagccgaccgctgtgacacccacgtggtggcgtcactcagagaatatcacccccccctgttgcgccctcatatgatgcggagtcgccacccgcctcatcatctcccaacacacctctgcccgcacgacgagacatattgtgccgtgtatataacagcagaacaaagacctgatatactcctctcccccatgatcatatcgtcggccggcacgttgggcaccgcccaatcttctcgtctggacgcaacgcggttccctcccccgttgcccctcgttcgccaccccgcacgccacccgccccgcgccctctcctcgcaccaccccgccggcgccccggcggccacacacaatcctcccactcttcgcgcgcccactcaccaccctagcggccgcgcgctggcccccttgccgcctcgccgccccttcttcttaccccccttcctactaatcttcctcctcgccacgcccgcctcttcgtcttgggggcggcacccccttcttgtggccccccttctcattagcagccccccccctcttctacagacacacgtcggcgtcgggcggccgtcgttctcccatcgctgcgcacagcgggcggcccacaactctatccgcaagccacacaccccagcaggcgccgctgcgcacccacctctccttcgtgcgggccggccccccgctcgagcccccatctctcgttggccacaccaacacacagcaccgccttgcacaacccacctccttctcatcccacaccccccccttgccacaaacgcgcgaccaaccccgcctgccgatcaacagaccgcggtccctttaccaccacccaaccaacaggggccacatccccctcggcggccacctctaacacaaacaacttctctggtaacgcccacaaactcatctatctaccctccgtctctccccaccaccacctccactacacaccgccacctattaccccccctgctacatgccccgccaagcaactccacccgccagttatcaagccacgctccagcccgcaccacctcctcacgtcccacacacgccacaacaccactacacgaccgctcctcgcccacacgggccgcagatacaacacccccgacaataagacacgacga

SEQ ID NO: 592620 - DNA, 88 bp, Homo sapiens
ggagaatctagtgtagcagcctccaggaggattcagcacaacactggggagtcacccttccctcgggccctctcctaccaacaactgg

SEQ ID NO: 592621 - DNA, 251 bp, Homo sapiens
atgacatctcctcatgagaaaactctgagtgcagcatggccgggggtgaccatgtgggcgttcagtagggtgcttccaggtagatgtggtggtcactcagagccgtatgtagacggcagccagtaccttctcgggcacatactggcggcgcttcaggtcatggtccccatcaggtaggatctcaggctccatgatgggcacaaggcctttctgcgtgggagatacggccattgggcccaagcgtggggtac

SEQ ID NO: 592622 - DNA, 734 bp, Homo sapiens
gatggccagaagcacaagtccaagcaaagttttttttcttaaatgccttttaaaaaaaaaaaaaaaaaaaagttgtgcagttatcagcccagaaacatgatatgatagtttccacattaatctagcttaagggtatctggagcagttaggggaagcgtgtaagctgggtgtagacgggcttatgctcataatggacattggtgtgagttctgaattctggaagcccgttggtgaaccactatcattcctattcagggaagaagacgatataacataggacattccagtggaaacgtgtggtataaagggatagatacacttaagaagaaagtgcatgtgtggttaacaaaagattttttgggatgaaggtaacaaaaatcgtgaccaatggatgaagaaattacatcttgctaagaaatactctaattgaccctgtaggaacgctagaaagacacgtaatttaagagggagaaataatttaaccaaaaaaagagtcaaactacaccccggggggggcaaacattagggacacataaataaacgtggaaaccacaatgggggggcaatacagaaaaagcacattagtggaaagacacaagaaaagccgtggacaaggacaaaacacagcaagggactcaagcagaaattaccccatggggagagagaaagcgacaagaccaaaacaacgctaaccacacaagggacaaaacacgccaactgaagaagggccagcg

SEQ ID NO: 592623 - DNA, 304 bp, Homo sapiens
  misc_feature (304)..(304): n is a, c, g, or t
ttagagatggctggtgggggcagggtgccgtcagcttggctgggtagacagagagttttttgtggtgagggaatacagctgctctaggcctttggggtaacactgcccagtcatcagcccaaagagattcaaagagcaccaccagcagctatttttataaatcaatcctgaatccaagctgagcacatggatttagagtgaacagttgtcatgctctattacaagctgggtgtttggtagacaacattaaagttgctaagcaggagactcccatctgtactgtgcagtgtgtactttacttgcn

SEQ ID NO: 592624 - DNA, 241 bp, Homo sapiens
ttagcagcgtggaaacattttaagtgtgatagattaagtgcagcaaaagatatttcatgtaacgaagttgttcttccaatatcaaagaaatatcagtaggctgggcgtgtggctcatgtctgttatcccaacattttgggaggctgagtgctggtggatcacctaggttcaggagtttgagacctagcttgagctccacagtgtcacctcgtttctactatatatatacaagacaaattag

SEQ ID NO: 592625 - DNA, 387 bp, Homo sapiens
gactccccctcctcttctgccactgctccagctcgtctacttggatggggttgcccgctatctgcgagcatgacagagtcttcctcacaaggaatcggcttgttgttttacagctgtctattgctccatcccccctgacgatccctaggtggagatggggcatgaggatcctccaggggaaaagctcactaccactgggcaacaaccctaggtcaggaggttctgtcaagatactttcctggtcccagataggaagataaagtcccaaaaacaaccaccacacgtcaagctcttcattgttcctatctgccaaatcattatacttcccacaagcagtgcagagagctgagtcttcagcaggtccaagaaatttgaacacactgaagg

SEQ ID NO: 592626 - DNA, 479 bp, Homo sapiens
gaggatcacgatgtccgttagattggtatgttttgcagggctggtacccgttgttcctttttatgtgtagtgcttttttcaggagttctgtaaggcagtcctggtggtgacaaaatctcagaatttgcttctctaaatgattttatttctccacttatgaagcttagtttggctggatatgaaattctgagttgaaaattctttttttacagaatgttgaatatgggcccccactctcttctagcttgtagagtttctgcagagagatttgctgttagtctgatgggcttcccttggtgggtaagtcaaactttctctctggctgcccttaacattttttccttcatttcaaccttgctgaatctgacaattatgtgtctttggagttgcccttctcaaagagtatctttgcggtgtcctgtgtatttccccaatttgaatgttggtctggtcttggctaggttgggggaaatacacgg

SEQ ID NO: 592627 - DNA, 126 bp, Homo sapiens
ggccctgaagtgcctggatgccccctgcctcccagtgtcctgcattacttactggaggctcagtcaccacaacctcaccctacccagccctggcctgcgtttctcggacaccagccaacctcctcc

SEQ ID NO: 592628 - DNA, 204 bp, Homo sapiens
accgcacacaccggtagtttttgtatttagtagagacgaggtcaccgtgtagccaggatgtctcgatctcctgactcgtgatctgctgcttggctcccaaagtgctaggatataggcgtgagcaccgtgcctggcctaaagggggatttattaaggagcattaactcacacaatcacaaggtcccacaatagtgcatcgcaagc

SEQ ID NO: 592629 - DNA, 196 bp, Homo sapiens
ctggcgatgtgctcagtgcattgccatgcgtgggtggtcgggttattgtcgttcttttatcataactgcgccagcagcgcccatggaaacttcgttgattacccctgagcagttgtcggcaatggaagggcaaatcaagagccaaccaacaaaatgcgcttgcgcgaacccaagccacggatggcgagatggctgg

SEQ ID NO: 592630 - DNA, 402 bp, Homo sapiens
tcactctagagatccccccgggagccttaaccctataggaaatatttttgggggggaatggccaaatcacctgttgagtaatactcattgtgtttgtgcagtggttcaggggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatggga

SEQ ID NO: 592631 - DNA, 130 bp, Homo sapiens
tgcaatggcaggagaaatcagagtgttgcggcagaagtcggaccatgtgtgcctacagccaaagcccagccattaaaaaacagctggacagacatcttccttccccacctacgctggcctacagcacatg

SEQ ID NO: 592632 - DNA, 984 bp, Homo sapiens
gtgtgctagcggagggagagctcagggtggcttaatccaggagagcccgtgtcatggtcccgcccccagccagtggtgaaagcaaacgttcatcctaaggtgtgcacgcccaggccctgcgccctttacagtctaggccgcctgccatgggggtgcagccgtcgtccagtgggctgcggtcagacgttgcactgcgtgcccacaatccagaattcctgcaaagacgaagttgggatgcacaggaacccaagcacatacacgaggaagaagatgcggtcagcagtctcaggccagcttctctgtgagccctttacgtcctctggagggctctgatggggagagatacagggcaacaggacgctgttacttcaatggtccccgtcaacatgagcggaagagcgaaccccatggggtcatcatcctgtatcgcttccttatcttagattctcagttgatgaaaatttgggtctggcccatttcaggcgcatcttcagtcgaagaaacaccctcttaggctgtgcaaggcatgggttatcaggggattgaggtcacctgggacttcagggaggctcagcttgctccctgccccagatctgtttcttctaagggaggaggacagtggtggagaccaggacaggagagccagtaaggtggatgcaaggggcctctatcgcaactggacctccgtgccctcaccccagccctaggtgtgcacctaaggctcattccttaccccccagccctgcccactttcagcaggatgaggccctgggtttgccgtgctctcggtgtaccccatctcggggcaggggctgggggcccgctctttggccccaggttgccccgggccaagaagccagcaagaagcacaagtctctatggtgttgaagacaacgcgtcagcaagcaggactcgtgaagtaagtaacctgggggacggccgggcccatggagatcgtcaaggggcgaacccggggatatctgg

SEQ ID NO: 592633 - DNA, 142 bp, Homo sapiens
atgcgtaatatgtatccgagcggtacaaagcgttttttacttctcacttcaattaatgctgcgcttcgctggtgagtgcgtactttttctacctgtacacattcctgcattcatgtattttgttttttttgactaaagctat

SEQ ID NO: 592634 - DNA, 101 bp, Homo sapiens
tgagctcggtaccgctatagtcacggttggtactagttcacggttggctgactagtccacggttggctgctctgctacgtacgaaaccccgacccagccaa

SEQ ID NO: 592635 - DNA, 997 bp, Homo sapiens
  misc_feature (6)..(6): n is a, c, g, or t
  misc_feature (11)..(11): n is a, c, g, or t
  misc_feature (32)..(32): n is a, c, g, or t
  misc_feature (393)..(393): n is a, c, g, or t
  misc_feature (399)..(399): n is a, c, g, or t
  misc_feature (728)..(728): n is a, c, g, or t
  misc_feature (800)..(800): n is a, c, g, or t
  misc_feature (994)..(994): n is a, c, g, or t
taatanttaanagattttattctaatagctanaattacagtgcttgtttgtcgaaatgaaaactgaaaacaagtatacaaaacagttgattactaatcgtgtattgaaagcagtaagaggttccacgacaccaaatagaccagttctgaggtttccccaagataaatttaacagctccagcttcagtgtttatcaaaatacaaaagaaaaaagtagaggttgtctttttcgatggcaaatcggacccttgcaggctgagggagagaaagctacatcacacacagaggtggggtgctcccgaggggctgtgggtctaggtggaccgcctgcccggcttgcacgcgctcctgctggtgaggccccagacatcctgccaaagtgtctgagcgagcncgagtnttggggacgacggacccactctggccacacggcgaccgagggacagaaggggccctgcgtcccataggctgcctgaaggtgggtagggcggcctgcggcaaagtggggtggctgtgggctcccagcctggcccctgggaaccgtgggagcacagggacaagcacatggctatggaatgcagggtgacccaaggacaagcgagttgcggggatctctactgtgaccatgcagaattgatcgcagtctgctgcgccaccaccacctcatgttcccgaggggaacagctgggctggcgactggcatccaggccgtaactgcaaatctatgcnaggcggggtctcccttctgtgtgttcaaagtgttctcgacttggattcttaactattttaaaaaatgcactngagtttgggttaaaaaccaaccaccaaaataggatttcaacacagctctaaagccaagggcgtggcaggctctcccaacacagcgactcctggagccaggtgcccatgggcctacatcccctctcagcactgaacagtgagttgatttttctttttacaataaaaaaagctgagttatattgcataatgagttncat

SEQ ID NO: 592636 - DNA, 357 bp, Homo sapiens
gaaaagagctctactactagtagaattagtaacaatgagagtaaacaattgttacccactctaagaatacagcagaagccagcgcggtgtcgcgcctgtagtcccggcactctgggaggccgaggcaggcagattgcttgagtccaggagttcgagatcaggctggccagcatggcgggaccccatttctgctgaagatacaaaagattggccgggtgtggtgatgcacgcctgtggttccggctactcgggaggctgaggtggaagccacctaagcctgggggatcgaggctgcagtgggctgagatcctgccactgtactccagcctggggaactggagtgaggccctgtctcaa

SEQ ID NO: 592637 - DNA, 418 bp, Homo sapiens
gacatctacaggatcccttccacctacgatcccacagcagcagcccactattcctgctcaggcaccacatattatgtacaggatgccgatctctttgtaggtttagttagaatataagtcaacgatttacgaacataggtcacatggctgagtaagcattagactgtaaatctaaagacagaggttaagccctctttttgccagttccgaggtgaatgtcatgtagaattgcaaattacaaagaagcagcttcaatatctgccgggacttctcccgcctatataattcctgcggcgggagaagtagattgaagccagttgattagggtgtatagctgttaactaaaagattcgtgggtatgtaatcccaccaatctagtgaggatttagcttaattaaagtgttagatttgcattcaa

SEQ ID NO: 592638 - DNA, 715 bp, Homo sapiens
  misc_feature (6)..(6): n is a, c, g, or t
  misc_feature (11)..(11): n is a, c, g, or t
  misc_feature (32)..(32): n is a, c, g, or t
  misc_feature (393)..(393): n is a, c, g, or t
  misc_feature (399)..(399): n is a, c, g, or t
  misc_feature (673)..(673): n is a, c, g, or t
taatanttaanagattttattctaatagctanaattacagtgcttgtttgtcgaaatgaaaactgaaaacaagtatacaaaacagttgattactaatcgtgtattgaaagcagtaagaggttccacgacaccaaatagaccagttctgaggtttccccaagataaatttaacagctccagcttcagtgtttatcaaaatacaaaagaaaaaagtagaggttgtctttttcgatggcaaatcggacccttgcaggctgagggagagaaagctacatcacacacagaggtggggtgctcccgaggggctgtgggtctaggtggaccgcctgcccggcttgcacgcgctcctgctggtgaggccccagacatcctgccaaagtgtctgagcgagcncgagtnttggggacgacggacccactctggccacacggcgaccgagggacagaaggggccctgcgtcccataggctgcctgaaggtgggtagggcggcctgcggcaaagtggggtggctgtgggctcccagcctggcccctgggaaccgtgggagcacagggacaagcacatggctatggaatgcagggtgacccaaggacaagcgagttgcggggatctctactgtgaccatgcagaattgattgttgtttgttgtgctatcattattttatgtttttntggggaacagttgggctggtgattggtatttaggttgtaact

SEQ ID NO: 592639 - DNA, 232 bp, Homo sapiens
gatgcatgataaaaaacactatagctagactagaaaatctacaaatgtgtctacgaacaaactacagtcaaaaagtgcactcccgatttcttcatagtactgattctgaagtagtctacatccatgagtttttactggaattgaatgaactttagtctaataatattctatcaagtaaagtaattaaagaagtcctagcttcctatgcatatatctataagaaaacggaact

SEQ ID NO: 592640 - DNA, 104 bp, Homo sapiens
gaatccggctctctggggtggcgtccgactgatgctgttcttgggctggaagatctcgttgtagtcctcggcgttctggatctccgcgcgggactcgcgctcgt

SEQ ID NO: 592641 - DNA, 116 bp, Homo sapiens
tctagaggatccctaatgattgtccaccgctcccagaaaaaacacactcacccccaatccaaatgaatcatctgcatagaaaaccagagtcagcaggcctagggaaggagcggtgg

SEQ ID NO: 592642 - DNA, 464 bp, Homo sapiens
ccaaggaatttggttctagaagcaggaaaaggcaaggaaatagatgttcccctagtgcctccagagggaatacaagtctgctgctaccttgattttggtccacaaaacccatttcagacttctggcctctagaattattaaaaaaataagttgtgatgtaataggaaactaatacttgcctatgggaaaccgcagcaggagatcaaagggagggagggaagaaagtcaagtcattcatatcaggctggttgtatccctcatctcacagtcactgctcctttcaaggtggccttctctactccttcccaaattcagtaaccatgccctcctcccctcatgccttctactgctactctgctgttaccagcccatattactgtgctatcttttttaataccccctacacccaaacctttgtaaacaattttatttgaaaataaattcttaaattatcctaaaaaaaa

SEQ ID NO: 592643 - DNA, 442 bp, Homo sapiens
  misc_feature (108)..(108): n is a, c, g, or t
catggagcatggaatgagtctagtaattgatgaaacacacttttggaaatagtgatctacccaaatattgtgtatctagacagaagattatcactgctgctgctatancataaacaaatgatatagcattgagattaaaataacgcttgccacatattactaagtgatggatttaaagcatggcttctcaaatgtttcttgttgatgtacaactgttttcaaataaatcacttggaactatgttatgtcaccaattatgatagaaaaaaaagggagaacgagaaaggaacttgcttagtgaaaggaaataatctgtatctcacaattacttaaaacaaactgggatgcaaacattttctgtagattaaggctctgatcacatttcatccaataaatctttctgcaaagtttgtgcatgtttgttcctgtttataggtcgagc

SEQ ID NO: 592644 - DNA, 449 bp, Homo sapiens
  misc_feature (404)..(404): n is a, c, g, or t
  misc_feature (412)..(412): n is a, c, g, or t
ttcttattaatataagaaggcaggaatgtcaggcctctgagcccaagccaagccatcgcatcccctgtgacttgcacgtatacgcccagatggcctgaagtaactgaagaatcacaaaagaactgaaaaggccctgcggccgcgtggacggatgagaggccaccatggtgatttgtgcttgccccaccttaactgagggattaaccctgtgaatttgcttctcctggctcagaagctcccccactgagcagcttgtgatccccgcccctgcccaccagagaacaaccccctttgactgtaattttccattaccttcccaaatcctataaaacggccccacccctatctcccttcctgactctcttttcggactcagcccgcctgcccccaggtgaaataaacanccatcttnctcacaaaaaaaaaaattggggggggggggggggggc

SEQ ID NO: 592645 - DNA, 1427 bp, Homo sapiens
  misc_feature (288)..(288): n is a, c, g, or t
  misc_feature (290)..(290): n is a, c, g, or t
gggaaaatcgaagattctggcggatgaagttacttagaccacagagctggttgcatttaccacataccgagatcgtcttacccagtgagaagaaagctcatgaatactaggttcaccgcgtctgtgctgtcgaaaagtacgcctatacgctgaagaatcataaaggggtacatgcctgcgcaaatttcgagatcgcaaagtgatgactaacttaaccacatacaagactggtcatactgctgacaactaacgtaatcctcgctgattgtgctaacccacattggtccntngtaataaagcgacacttacacagaatcacgcctacacaacgtggagtagagttcccttcctgtaagtcctagggaaagtagaggcgtgctttttctgcgaccacgagttctcgcacttgatgcagctagtgttgggtaagcacaactgtcattcccgccgttccctagttcgcaacgacgtttgaggacgacacgaaccccggttggaaaagcagctcctcctacgtacattgcacatgaacgtacattccaatatgtccgccaagcagacacgtgactaaattgaactccctaaggaaaaggggtggcatgactttaatagcgcaactacacaaggattgaggaacctgcgtgtgacccttctttgaagccgtatccaattacccgttacggaaattggtgcttgcaagggcgttttaagtcgccccattctctgttggcggaaaactaggccccctcccggtccccgtggtcagtcgcaagttcccgaagggcaaaatcggtgggtgtataccaaggaccgttatagcctagcttggactcgaaaacacctagggcccagtgtcattccataagggtagagtgccgttccatatttcgctcccctgttaagcaggccatgaggggtatttacctggtccgcaatgttgtaacacaccgggcccaagaagtgtgcgttatacaaatgttaacttgggttccattcctctgatatacgatgtggtgtgtcctcccgcagcttgttcccctgttgttttcgccaccaaagcggacacgttgtagcccccacatccttgttcccaacgcttacacaggcttattccgactctcggacaaatttggggttgccacggaggcgccccctgttggtattgacccccaagtccagaaacatccgctaatattatatcgggaagcataacggttgggaagactcgcacacgcacaatcctcctgttcaaaggcccatcactatatggcagggtggtcaaaccccccatgtctattagtgaaggaggctacccatcaggagacaaccccggagcatattatctaccatacggcgaaacagcacacattatgtatgtgtgtgcgccgcaatgagagaggaatttggcccggatttcccagaaatcg

SEQ ID NO: 592646 - DNA, 316 bp, Homo sapiens
ggcctgtctctggactcctgcacattccgaaccatggaaggtaggcaaaccacatgatctccagctgttttatctttttagatgtatcattgtcaagttggtatggcaataaaaatgtctttcaaaagttgaaaacaaatgtccgtctttggcccaatctcacacacaaatacccagaaagttggaagttaaggaaggtaaattctcagtggtggaattgtaggttattttaattcactttattgaattgctttttattttctaatgtttggcattgtgtcatttaattaaaataaaacatcatatatgttttaaa

SEQ ID NO: 592647 - DNA, 616 bp, Homo sapiens
  misc_feature (19)..(19): n is a, c, g, or t
  misc_feature (79)..(79): n is a, c, g, or t
  misc_feature (124)..(124): n is a, c, g, or t
  misc_feature (437)..(437): n is a, c, g, or t
atgggcatccttggtgggngaccacctggataatattgcccatatggtggccaagggagcagctgtaccatgaatatcngaccatgtccaggatcagtgtactcaatgcactggaggaggcatngacaatcctttctataaaaaggaatgctatatggttgtcaacccattcaccacgaccagcctacgaagcccctggacagggctgtcttctgggttgagtttgtcatgcgccacaaaagggctaagcacctgagatcacttggacataaccttacctggcaccagtaccactttctagatgtgatcggcttcctactctcttgtgttgcagtcactatagttcttactgtaaagtgcctcttgttcatttaccgattctttgtaaagaaagaaaagaaaattaagaatgagtagagctcattgacaatggactncatgaatgaactttcaccctcattctaatttatgaaccaccttctaaatactgatttgatttttttttaatcaaggcagatcttctttggaaatttttactgtgtaagaagacatgtaaatctgtggatactgatccattttcaaaaatctcatattttttttaaatttcaaactattt

SEQ ID NO: 592648 - DNA, 86 bp, Homo sapiens
cccacgcgtccggacccacgcgtccggcccagcagagtcaggtgcggacgacttgtctgtaggagcagcggcggcttgaggacccg

SEQ ID NO: 592649 - DNA, 202 bp, Homo sapiens
gtgtgtctggtctacagccagaggttatactcttggcaatgagtcttcatgttatagttgaggaaaatggtaactgagaagtggagtgaatgaccgtatcggctcagccagatccatgccagccaggttcagaactatttgcatcccccctgttaaaagtccgcctgaatattgattagtgcaggaagaatgtaattcaatg

SEQ ID NO: 592650 - DNA, 851 bp, Homo sapiens
aagtgacagcctgggcacggtggcttacgtctgtaatcccagcacttagggaggctgagagggtggatcacaaggtcaggagttcaagaccagttggccaagatggtgaaaccctgtctgtactaaaaatacaaaaaattagccgggtgtggtggcgggcgtctgtaatcccagctactcaggaggctgaggcagagaatggcgtgaacccgggaggcagaggttgccgtgaaccgagatgcgccactgcactccagtcctgggcgacagagcgagactccatctcaaaaaaaaagaattataaaagtgacattgattggtgtgcaaaaggacaaggcattcaataaatgctgtgggggactattggctattcatgaagaaaactaattgacatgggtatcgtcctttatgaatcttgtatataaatcacattttgtgtgggaggtgaactgtaaaaattcatattgtggacctataacttgtcatgagaacatttcgacaagtagggagggattttggtgaacttatcaggtccaagattgtggccccgtcatacgactaaaagtttagaaccattaaaattagaaccttgcctgtgaaggaggaactgaagggttcaactgcgggtaccacttaggagacatattctgtgacccgtgtaatccataagtttctagtttaccctgtcggtgatccccttctcggcagttttcgcgccctatcctcaggcttttccctaccagtttggcgcacctttgaaagctggcggggcctgctggggggttgtgtcgcggggaaccccccctgctgggggggtttacgggcaaccctcggcgcccgcggggacctgg

SEQ ID NO: 592651 - DNA, 452 bp, Homo sapiens
  misc_feature (101)..(101): n is a, c, g, or t
  misc_feature (104)..(104): n is a, c, g, or t
tgagaatgatggtttccacttcattcatgtccctacaaaggacatgaactcatcttttttatggctgcatagtattccatggtgtatatgtgccacatttnctntatccagtctattactgatggacatttgggttggttccaagtctttgctattgtgaatagtgctgcaataaacatatgtgtacatgtatctttatagcagcatgatttataatcctttgggtatatacccagtaatgggatggatttctagttctagatccttgaggaatcgccacactgtcttccacaatggttgaaagacgaagagacatacaaagcattcaccaagaccaaagtttctcttttgttcctattaaatagctttaattaaaacacaaggaaccctaaaagcagaaaataccattgcatttcattatattttaatggcaaatgatattatacaaaaaa

SEQ ID NO: 592652 - DNA, 426 bp, Homo sapiens
  misc_feature (304)..(304): n is a, c, g, or t
  misc_feature (338)..(338): n is a, c, g, or t
  misc_feature (370)..(370): n is a, c, g, or t
  misc_feature (422)..(422): n is a, c, g, or t
ttgacatagcctggctctgttacctaggctggaatgcagtggcacaatctcgggccactcaatcctctgcctgccacattcaagtgattctcccaactcagcctcctgagtagctgggactacagacatgtgccaccatgtctggttaatttttgtatttttagtagacagggttttgtcatgttggccaggctggtctcaaactcctggcctcaagggattcactcaccccagcctcccaaagtgctgttactttttcttcatagtacttaccataaatttaaaattttgccttatttatttnttttccttgttagcctgggccttttcaccaaccncacccccaaaatgaatgggaagtttccactanggacaagggttttttgtacatctttttcaacgttaaaattaatttgcttcanggtc

SEQ ID NO: 592653 - DNA, 345 bp, Homo sapiens
tgagatggagtctcactcctttgcccaagctggagtgcagtgatgtgatcttggctcactgctccgcctcccaggttcaagggattctcctgcctcaacctcccaagtagctggggttacaggcatgcatcaccacatccggctaatttttggatttttagtagagatggggtttcgccatgttggccacgctggcctcaaactcctgacctcaagtgagccacctgcctcggcctcccaaagtgctaggattacaggcatgagtcactgcgcctggccaatatttgagaaatattgatcaagaatagaatatctctggtcgacgcggccgagaatttagtagta

SEQ ID NO: 592654 - DNA, 160 bp, Homo sapiens
gagtattcatctacatagaccacaaatacattgcaagaccatacctattattctgcgcttcaactgtcatgtcctaggcacagctctaaacctccttattcgacccgatctgggccagcctggcgaccttctaggtaacgaccacatctacaacgttatc

SEQ ID NO: 592655 - DNA, 142 bp, Homo sapiens
ctctggatgtaaaaaagcaaaagtgcaatggcactttggtaaaacacacagttgttcaacctatgaaggattacatcctttgggcaggttttattcccaggatatcaaaccccttgtccatgagagcagctactgtttcaca

SEQ ID NO: 592656 - DNA, 172 bp, Homo sapiens
tcacttctcacaatgaggctcctgcttaacttcttgggcttctaattcttttggtctctttgattccattgggataatgttatgactcagtctctcactctctcctgtcccctcacacctcggagagacccggctctcatatttctctcagatctagacaaagactctcgca

SEQ ID NO: 592657 - DNA, 234 bp, Homo sapiens
cccactatgaatatagatagaagaatataaatatatatacatatatacataatatacataaatattcataaatatatatatcacataatatataaatatatatacataacatatgtatataaatatataaagatatgtacacaacaatctatacataatatataaatatatatacatacaatattaatatatatacacacataaatgaaaggtattaccctgggtagtcacaga

SEQ ID NO: 592658 - DNA, 723 bp, Homo sapiens
gctgttcaagttgtctcttcaattagatgctcgcataatattgggtgccgaaagcccgggatagggggaactcctccggaagacctctcactctatacctaccacggtgaccgacgtacgtcccatgcaaagagacattccctcgcctctctaggatctcagactcagctccgcgagctagtccggcctcatgtcttatggatattgaaatccaacaagccggtcacggacttcgttcttggggagacagccttccttcaggtgttgggtgcaatgcccgggacgcccgccttggccatttggccagccacacaagccaggagctccaattggggacgcccactgaggatcctagtggttgcatctgttccttggtatctttcttttccccccaggtctttccttgttctaatcatgggcaaatttcccgaccgttccatcgcctctttcttctgtctgggcattgtgtcctactaagaatagcctcaaaaactcttcaggctatgcacccagtactaaagaggctaaacgtctaattttatgttgctgtaacacgtgctggccccagtataaattagaaaatggcgctcagtggccagaaaacagcgacttccaatttctctattagtgggacttagacaactctctatggacacaatgggccaatgggatctgaaggtacccgtacttccaaagcatttgttacatacgatctctccctag

SEQ ID NO: 592659 - DNA, 640 bp, Homo sapiens
  misc_feature (57)..(57): n is a, c, g, or t
  misc_feature (504)..(504): n is a, c, g, or t
aatacccaatataatataaccaccacacaaccacccagaccaacaaaaccaccctcnatgagtggacttagccatggctcttcacaaacagcaactcttcgtcctcattgtagagatggcgatactaaggcataccttggctagcctggacttcacttctgcaacattttattgatgaaagcaagtcacaagaccagactgattcaaggggtggagaaatagaccctacttcttgatggagggaggagtacagctaccttgcaaacggatctggacaaaaaaaggattgaaccattacagaagcatgacctacaatccacccccatccccctcgcacccgcctgactcctggatccacacatgtctaccaatacccgaactgccactctcgacttcactcccgatgctatccccctcatagcgatcgctgcctccactcccaccctaccccgcaacaccgcatctacagccaggtcagcatctctatacatacctacccattanttaatggcgtttccataggtctttgttcgactatagcgaacgataagccaccactcacacattctccgaaccgacgcgagcatctcatcactctacgccctccacagagcgctttcgtacaggcatctcttctatc

SEQ ID NO: 592660 - DNA, 341 bp, Homo sapiens
ggtcgacgagggagtgtatagaattgatcccaggagaaacaaggataatcggacgggcatggtggttcatgcctgtaatcccggcactttgggaggccgaggcaggtgaatcacctgaggtcaggagttcaagactacctggccaacatggtgaaatcccgtttctactaaaaataataaattagccgggcgtggtggtacatgcctgtaatcccagctactctggaggctgagacaggagaatcacttgaacctgggatgcggaagtggcaatgagccaaaattgtgctattgtactccagactgggcaacaagagtgaaactttgtctcaaggtcgacg

SEQ ID NO: 592661 - DNA, 205 bp, Homo sapiens
  misc_feature (73)..(73): n is a, c, g, or t
  misc_feature (178)..(178): n is a, c, g, or t
catctaaaggaagacagagcatcaagaaatgcaggtttggagttcccgtcgtggttcagtggttaacgaatcngactaggaaccatgaggttacgggttcaatccctgacctcacacaatgggttaaggatccggcgttgccgtgagctgtggtgtaggtcacagacgtggcttggancctgtgttgctgtgtctgtggtatagg

SEQ ID NO: 592662 - DNA, 302 bp, Homo sapiens
  misc_feature (3)..(3): n is a, c, g, or t
  misc_feature (16)..(16): n is a, c, g, or t
  misc_feature (62)..(62): n is a, c, g, or t
  misc_feature (65)..(65): n is a, c, g, or t
  misc_feature (139)..(139): n is a, c, g, or t
  misc_feature (176)..(176): n is a, c, g, or t
  misc_feature (278)..(278): n is a, c, g, or t
gtnccaaacgcctggncattttcttacctgctttgacaactaaataacctttaattttcttnttnctttttaattgaaatcaagtaagaaattttattaattttggaattgaaaaaacatcctttgttgtttccaaganttaattaaataggaggcatttggcggtattatgtggntaaccctttaattttcatgactgacatgtattatcctaaagttatttgacttgtcccctaatttctctccacgttcccaaatggtcttatttcaaaataggngtcatttttctcctggaaaaaata

SEQ ID NO: 592663 - DNA, 342 bp, Homo sapiens
  misc_feature (48)..(48): n is a, c, g, or t
ctatagaggatctcccaagaagctggtgctgttgtgtactcagcaggncgcatcctgggggctacgtaaccaaccacatatacacctgggtggaccgcaggccgcagcatttcccacccttgggctgcccagcccacggtggtgccctgaggcagcaggagggtgaccggaggagcaccctgcaccttctgcaaggaggggatgagacaaaggtgagtggggtggggaaaggaggccagcctctcagacaccggtattctccctccgaacccagaacagcagagctgctttggaggccgcaagaagaggctggttctgtccaggctctgtcttccctcaagt

SEQ ID NO: 592664 - DNA, 1499 bp, Homo sapiens
  misc_feature (140)..(141): n is a, c, g, or t
  misc_feature (194)..(194): n is a, c, g, or t
  misc_feature (234)..(234): n is a, c, g, or t
  misc_feature (280)..(280): n is a, c, g, or t
  misc_feature (289)..(289): n is a, c, g, or t
  misc_feature (303)..(304): n is a, c, g, or t
  misc_feature (316)..(316): n is a, c, g, or t
  misc_feature (917)..(917): n is a, c, g, or t
  misc_feature (941)..(941): n is a, c, g, or t
  misc_feature (967)..(967): n is a, c, g, or t
  misc_feature (974)..(974): n is a, c, g, or t
  misc_feature (986)..(986): n is a, c, g, or t
  misc_feature (998)..(998): n is a, c, g, or t
  misc_feature (1038)..(1038): n is a, c, g, or t
  misc_feature (1087)..(1087): n is a, c, g, or t
ctggctggctgtgtggtgctggggaccctgtgagcgggaagatggcgtgctgtgcgcagtgaggcggacggggcccgcagctgccgtggtggcggccgggggaggcagctccggtcaggtgaccagcaatggcagcatcnnggagggaccctgccagtggagacccagcctcagaacccacctggcccagcctngcacccaatgcctggcaggtcatcaaaggtgtgctgtttnggatcttcatcatctgtggccatcagcatgttgtgttccgcctgangggcctggnccctcagtgaccanngcgggccccggnaggagccccacgcgttcgccagcctgaaacctgttccccaaagacactttaatgaaccttgcatgttgtacattctcagagcacgagcactttacagacttcaacgccacgtcggcactcttctgggaacagcagcgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacattgtcccggatgatcaacaaatacaagcgcagacgatttcagaaaaccaagaacctgctgacaggagagacagaagcggacccagaaatgatcaagagggctgaggactatgggcctgtggaggtgatctcccattgggcacccaacatcaccatcaacatcgtggacgacacacgccgtgggtgaagggcagtgtggcccctcccctggatcaatatgtgaagttcgacgccgtgagcggtgactactatcccatcatctacttcaatgactantggaacctgcagaaggatactacnccatcaacgagagcctggcagctgcngctccgngtctccttctgnccactctcgctntggcgctggcagctctatgctgcccagagcaccaagtcgncctggaacttcctgggcgatgagttgtacgagccagcagatgaggagcnggactcgtgctgaacggtggccctgtctggaagaacaaacgcctaactggtggcgctcactatcatcagtgatatattccgtaacaagatgccgtacttccgagattagctcggcactttcaatctgaaaatgcatattcccaagctttcgttggaaaccagccctggcagtccccttgggacgggccctgttctggtagagccatcccagatcattccgtatccggcacgttcgtccacaacgtcattcaagagggggacactcactacataaaatgactcttgcgacacaaagggagacccaaactgtcgctggtcccaacagtcgacgcccgttctccaaatcatgggggggtaccttcaatctgaacctcatacgaagatccacacacaggacattgggcacgatccg

SEQ ID NO: 592665 - DNA, 87 bp, Homo sapiens
tgcagtacaactaggcttaatagggacatgtagttagcttttaattcctgtttggagaaaaaaaacgttagaagcttgaattcgagc

SEQ ID NO: 592666 - DNA, 1527 bp, Homo sapiens
  misc_feature (140)..(141): n is a, c, g, or t
  misc_feature (194)..(194): n is a, c, g, or t
  misc_feature (234)..(234): n is a, c, g, or t
  misc_feature (280)..(280): n is a, c, g, or t
  misc_feature (289)..(289): n is a, c, g, or t
  misc_feature (303)..(304): n is a, c, g, or t
  misc_feature (316)..(316): n is a, c, g, or t
  misc_feature (945)..(945): n is a, c, g, or t
  misc_feature (969)..(969): n is a, c, g, or t
  misc_feature (995)..(995): n is a, c, g, or t
  misc_feature (1002)..(1002): n is a, c, g, or t
  misc_feature (1014)..(1014): n is a, c, g, or t
  misc_feature (1026)..(1026): n is a, c, g, or t
  misc_feature (1066)..(1066): n is a, c, g, or t
  misc_feature (1115)..(1115): n is a, c, g, or t
ctggctggctgtgtggtgctggggaccctgtgagcgggaagatggcgtgctgtgcgcagtgaggcggacggggcccgcagctgccgtggtggcggccgggggaggcagctccggtcaggtgaccagcaatggcagcatcnnggagggaccctgccagtggagacccagcctcagaacccacctggcccagcctngcacccaatgcctggcaggtcatcaaaggtgtgctgtttnggatcttcatcatctgtggccatcagcatgttgtgttccgcctgangggcctggnccctcagtgaccanngcgggccccggnaggagccccacgcgttcgccagcctgaaacctgttccccaaagacactttaatgaaccttgcatgttgtacattctcagagcacgagcactttacagacttcaacgccacgtcggcactcttctgggaacagcagcgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacattgtcccggatgatcaacaaatacaagcgcagacgatttcagaaaaccaagaacctgtctctcctgtcagcaggttcttggttttctgacaggagagacagaagcggacccagaaatgatcaagagggctgaggactatgggcctgtggaggtgatctcccattgggcacccaacatcaccatcaacatcgtggacgacacacgccgtgggtgaagggcagtgtggcccctcccctggatcaatatgtgaagttcgacgccgtgagcggtgactactatcccatcatctacttcaatgactantggaacctgcagaaggatactacnccatcaacgagagcctggcagctgcngctccgngtctccttctgnccactctcgctntggcgctggcagctctatgctgcccagagcaccaagtcgncctggaacttcctgggcgatgagttgtacgagccagcagatgaggagcnggactcgtgctgaacggtggccctgtctggaagaacaaacgcctaactggtggcgctcactatcatcagtgatatattccgtaacaagatgccgtacttccgagattagctcggcactttcaatctgaaaatgcatattcccaagctttcgttggaaaccagccctggcagtccccttgggacgggccctgttctggtagagccatcccagatcattccgtatccggcacgttcgtccacaacgtcattcaagagggggacactcactacataaaatgactcttgcgacacaaagggagacccaaactgtcgctggtcccaacagtcgacgcccgttctccaaatcatgggggggtaccttcaatctgaacctcatacgaagatccacacacaggacattgggcacgatccg

SEQ ID NO: 592667 - DNA, 287 bp, Homo sapiens
caggaattcggcacgagctcttgtgagggccggtgggggtggggggagcgataacttaagcaggggccagagttccaggagcatgagggaacgcctgccttccgtgtcatgttcgtttttctacaattctcaactatagcctattgaacttctggtgacagtatcttgcgcaagatgagaacagctttaccaggaagcagaaggaaacttgttcttggaatggcactaagcagatcgcagcaaagttaaatgccactgaataaacacaaccaatgctgaaagaaaaa

SEQ ID NO: 592668 - DNA, 486 bp, Homo sapiens
  misc_feature (1)..(1): n is a, c, g, or t
  misc_feature (192)..(192): n is a, c, g, or t
  misc_feature (197)..(197): n is a, c, g, or t
  misc_feature (209)..(209): n is a, c, g, or t
  misc_feature (247)..(247): n is a, c, g, or t
  misc_feature (292)..(292): n is a, c, g, or t
  misc_feature (309)..(309): n is a, c, g, or t
  misc_feature (318)..(318): n is a, c, g, or t
  misc_feature (381)..(381): n is a, c, g, or t
  misc_feature (390)..(390): n is a, c, g, or t
  misc_feature (425)..(425): n is a, c, g, or t
  misc_feature (439)..(439): n is a, c, g, or t
  misc_feature (467)..(467): n is a, c, g, or t
  misc_feature (475)..(475): n is a, c, g, or t
ntttcgtcattaagggttactatcaaatccgtatgccgtgcgggcgcgcgccccttacatcagtatcggcaccacgctcgccaccggcgccaccaacgaccttgcccgtttcgcgtgccattctcccatcgacttctcccttccttgcatcatctctttcatctgcgagtcattctcgtttttcgcgttggnccttngcgcctgtgccntcgccaccatcggcattttcttcagttttgcctttttncgttccacctttagatcctttttgcgttcattaagtttattcagncataactataattattncctcgactnccgacataggttatcatcgcaaactttagccgtgttaaccggtatgcatattcggtcacattnccttttcanattttacatttccatttcccattttgaaggaattnccggtggtaaccangaattgcaaatcgtttattcggtatagnttccaacngaaccttcctc

SEQ ID NO: 592669 - DNA, 312 bp, Homo sapiens
cctgtttttttccagggcctgcttttgggggcagggaccttgtgaacccctcatttttatgcaaggggcatccctaaaacctgaaatgaggaaaacttcaagggttttacagggcccttgttttttaaatccaaattgataataatgttctccaaacccagtgagaggtttgaaggctggcttttgaaaaatccctgatgttttattggaacaacccctgagctacggaaagcttttctgtgatgggctaggccctttatatttgtgtgaaaacaaatttataaaaccggttaataaacttatccaaggtca

SEQ ID NO: 592670 - DNA, 1059 bp, Homo sapiens
gagcaggtcaggaccttttccatgagaaatatggggagagccttgggcatcaagtagcccggtccaggtcccctacaacgcggatcaagagtaacccgcggtctccgaggtatcatcgaggggctgctcccgcaggaatcccgcatcccgagatgccctgttaccttgcggctcccagaacgcatggtagcaggattcttgcatgtggatgacatagtatctaagttctacaggtcagcacagtgccttttcctaaaggactccatcaccaaatagcctgatgaagatgacgccaacagacctcggggaggaaggtgagtccatgcggggcatgcgacgtgaaaggagactcttactaaacgagagaatacgggtgaggccctgggactctgaaccaggacggtgctggtcccttataaactacatccgggagcgagcccacgagcgcgggtggcagggtcacgggttctgagctgatgaccatcccccgtatcccggcaagccccataccactgtacgatcactaacaccgtgtgatcgaaagaatctgaaaggcccctgaggaatcgtagttccggatggtacaatcatttaaggaggtctcctaacacccactagtcatgaaatctgcaatgagtggctatggtgcctgctcaaaagaagagagaaatggtcgcgaaagcagcgaagtagaaaatggggtgctcggaagagggacgaggttccggttgcgtgcatcctcccttggttgtgcctaattccgcgatcggctaaccaggactcacgtagccatgggacacccggaatccactcgtggtaaagttggccgacattggcatccggattcaacaatgtgggcgctaacccaaaggtattgcgaagcgatctatgcttgtgattgggcctggaggggaagaacggagatggtgggagaattggccgcgggagaaaaagcacactgtgacacaagagcatcactcaggcgcgacaacgacagcagagacaatcgtgagagaggaaggagacacaagacaacatgcgccaacagagaagaaaagt

SEQ ID NO: 592671 - DNA, 279 bp, Homo sapiens
atctaagtccacgattggaatacattgtaccaaataattagcttatgatcttaaaaatgtcaaggtcatggaaagtaaggaaagactaaggaaacgtcacagagttaagaaatataaagtcatggcaattaatgcaatgtgattgtgaactggatttttttttataagccattattgggacattggaagaaatttgaatgtgatctgaagaattaatggtacatgaagtataaattttaattcatggttttggtggtatatggtgattatatagaataa

SEQ ID NO: 592672 - DNA, 131 bp, Homo sapiens
gtgtgctgttgtgcggtcatagctcagtgtatgccttatcctcctggctatagcagtcctcctgccgtcagcctccctagtggctgagaccacaggcgcatgccacctgtgagtttctagagatgaggtct

SEQ ID NO: 592673 - DNA, 147 bp, Homo sapiens
aaggatcctgtgggctgatggttttgataagatgatgagtttggggatacgtagttgcctttccaatacctggccattagcaagaaatgctaggctgaatgcaaacgtcgctgtatatactagagatggagactatgatcagatatt

SEQ ID NO: 592674 - DNA, 1119 bp, Homo sapiens
gggctcctcagattccagacacaatggaggagaacagcgagagtctggtgcactcgttccccgtagtgacgatgcggatctgtgcatggagactcgagagcatcgacaccgacgtggtgtggggacccaacccgtccgggtacgtgtgtatgattgaccaggcaagatgcgtcacggagaaggttcatggaaaagttagatgacttgtatcggatatgtcatgacaaggagattgataacgcatgtgtagtgaagcgatcatccagggtgctgtcagatgcttagttacagcatagctccttaatagtaaaagtgagtcgcatgcatgagaattagctgacaggtgtttgctataagtttactcgataccaatcggaaaggtattcaagatgcttgggaaaaaggaggtagtaataagtatcatgaccaaggaaggattctcgattgcagcatggtaagaatatatcagaaagaagaagatgatttgatgattgggtaagataagaaaaaagtgaggaagtcaatgagcgttctctgggtgctaggaaaagtgtacatgtgaggctggaagggcaacagaattggacttgcccttggaatgggtaccttattttcgtaggcccggtgaaaagattcatgggcatagcaaagctaaagaggaagtgtggttagcttatccccgtggggttaagtatcgaaatagccgggggtttcatggacagggctacatggattagcacatagtctggcccagaaatcttccggcggaagggcttcctttgatgacgaagaaattgttcgcaatggtcctgattacttcagaagcacccttttgggggccaacgtactatcacggcataaacttttctgtgagcacccatattaagggttgagggcgccgctaagcggaaaacgaggcacaggtagttgtgaaaaacctttcagtggtttcctcatgggagaaaatcaaagtagcaatgtgacattgggggggaacaacgtatggcgatttgtaaactggtgtatagagaaggtcagggagggaagggaaacgtgaagtgggttaatggatgaagtcacaccttgatggaaagaggtatgaagaatgtagagaaggtg

SEQ ID NO: 592675 - DNA, 348 bp, Homo sapiens
atattcaagggagagcaagctagatccttccctaatatagtagaatagtcatgctaggccacaagaatcatctacccctacaagtcctagcaggattctcacaatgtttcctctgccctgggaccctctgtacctgagtttctgctgctcttctccctcttcccgctggcatctgctgcccttgtctgatgaccctcctgggtgatttccaccatgctagccccaagcccatacttcatttgcacaaaatcccagtcacacaaggttgctgtgcagagcagacttttcccaaaggtttagactgatgggtgcaggagttgctgctcagtgtggagggaacagactgca

SEQ ID NO: 592676 - DNA, 878 bp, Homo sapiens
gatcccggtgtcagtggcgacagccgcatgcggtgttggtgggcgctatgcatatcacccgcgaggctggagcgagtgcttgcaggtatcttgtagaagtggaggagctcgccgatgtagcgtgctggcggtacgaagccgtgcacgtacttgttggatctgggactagctatagaggaatcataatcgatagggtctgagggcctctgaatggaggatcttctaggcgcttcggtctgaaagatgtgagtaggtttgcttacgggaacatgtttatcaagatgccctcatcgctgagactaaaggaaatgattgaataaagatcgaagatcatctggatagaacgaaatagaatagaacgtgcggaatctaatttaaagtgagggtcaagcgtctttattgaggcccaaggcagatcggggagctgaagggttttaacattgaatccccactcaaccagtgatgagcttaatagctctcaaggtcatcttgaaaggatgagactcaagaagcaagatgggggaccagcaacccccaggtcatggaggagccaggacctccaacttgacacctgtaaggacaggatctgccctgtaaggggccagccgtcaggaatctggcatgaaaagctctttgtagtgcttggtactctgtgatggcaggagggaaccttcagctgtctggtgtggactggacacagggttcggtggacacaagatctattgacgggcttggtagcacagtgggtggtggggagggtgtgggggggtaaaatgactggcaaggtttcagaatggttgtgtattggccggcaagaaggggggggatggggtttatcgacttaaaggggaaggtaagggggcggatggaaaacaggg

SEQ ID NO: 592677 - DNA, 809 bp, Homo sapiens
  misc_feature (4)..(4): n is a, c, g, or t
  misc_feature (83)..(83): n is a, c, g, or t
  misc_feature (87)..(89): n is a, c, g, or t
  misc_feature (92)..(92): n is a, c, g, or t
  misc_feature (108)..(109): n is a, c, g, or t
  misc_feature (114)..(114): n is a, c, g, or t
  misc_feature (126)..(126): n is a, c, g, or t
  misc_feature (140)..(140): n is a, c, g, or t
  misc_feature (146)..(146): n is a, c, g, or t
  misc_feature (154)..(154): n is a, c, g, or t
  misc_feature (162)..(163): n is a, c, g, or t
  misc_feature (165)..(165): n is a, c, g, or t
  misc_feature (171)..(172): n is a, c, g, or t
  misc_feature (185)..(185): n is a, c, g, or t
  misc_feature (198)..(198): n is a, c, g, or t
  misc_feature (201)..(201): n is a, c, g, or t
  misc_feature (206)..(206): n is a, c, g, or t
  misc_feature (210)..(210): n is a, c, g, or t
  misc_feature (229)..(229): n is a, c, g, or t
  misc_feature (232)..(232): n is a, c, g, or t
  misc_feature (241)..(243): n is a, c, g, or t
  misc_feature (263)..(263): n is a, c, g, or t
  misc_feature (284)..(284): n is a, c, g, or t
  misc_feature (291)..(291): n is a, c, g, or t
  misc_feature (294)..(294): n is a, c, g, or t
  misc_feature (296)..(297): n is a, c, g, or t
  misc_feature (304)..(304): n is a, c, g, or t
  misc_feature (307)..(307): n is a, c, g, or t
  misc_feature (320)..(320): n is a, c, g, or t
  misc_feature (334)..(334): n is a, c, g, or t
  misc_feature (338)..(338): n is a, c, g, or t
  misc_feature (340)..(340): n is a, c, g, or t
  misc_feature (342)..(342): n is a, c, g, or t
  misc_feature (348)..(348): n is a, c, g, or t
  misc_feature (358)..(358): n is a, c, g, or t
  misc_feature (402)..(402): n is a, c, g, or t
  misc_feature (424)..(424): n is a, c, g, or t
  misc_feature (443)..(443): n is a, c, g, or t
  misc_feature (471)..(471): n is a, c, g, or t
  misc_feature (474)..(474): n is a, c, g, or t
  misc_feature (477)..(477): n is a, c, g, or t
  misc_feature (479)..(479): n is a, c, g, or t
  misc_feature (516)..(516): n is a, c, g, or t
  misc_feature (578)..(578): n is a, c, g, or t
  misc_feature (580)..(580): n is a, c, g, or t
  misc_feature (635)..(635): n is a, c, g, or t
  misc_feature (698)..(698): n is a, c, g, or t
  misc_feature (807)..(807): n is a, c, g, or t
tctngggaatctacaaataggaaatcaaaggcagattactgggtctgaagagtgtctacattgttaaaaaaatcttgtttttntttnnnttnggggaggtagattttnncagtnactctggaatantgtgaaaaatgttntttaanaatatatntgtatatnntnctgcanntgtttcatagatntgttttttaaatnatnttggntgtnctgattattttttttttanttnttgtacttnnnagttgatgggaacacgcagnagctcatactcaatattaggnactagtnatntnnttcaggngtnctttagttttttnttagctgtattgtncatntntntttttnaatgtttgcntttatacaaactgtgtatattatgtatggggtgtcagatatgtncacatcactgttatataatagncacatcattgttgtacatntgaggataagttttagtgcgagaaagtntcnttncnttgcattccatgtgttcaatctagttcacaatttgtnaactcttcagattattttccagtacattcctcattagattgtgggtttcaagtttccatttncnatttgaatgtttccagaaatctctgtcttaaccaaacctctctctccaggcacgnttctgcacatgagtctgatctgtgtagagtagtatcatcaaaaatgccaaattttgatcaggnatatacctggactactctctttcaaaggcaattgaacatcgtgataaaggatagcatctattcaggtcatggaaggatatggtcagttgaacttgtgttgaactttggngg

SEQ ID NO: 592678 - DNA, 793 bp, Homo sapiens
agcggggcgttcaggccaccatggccgtgctgctgctgctgctccgtgccctccgtcggggtccaggcccgtgtcctcgagcgctgtgtgggcccagtgccctggcctggtagtccagggttccccgccaggcccggggagggggcgtgcgtacatgtgccagtcaggcctccggtggcgaccgtcgctcgaggctggaggccgagctctgctgagcgttacgatggagactgcgtaacccctacctttgaagggatcaacggattgatgttgaaacgacatttcgttcaggactccaggtcatgactctggcgacttttaggtggtactttctacttttgaactacctcaatggttgaagcacgaagacataaggacgcaagggactagtgtcgactggggaacggctgcctgaccaggacgaagaggagaggagacgccgtgagcgggacgagcagatgtaccgatgagcggctgcgcaccattgctggtcatcggcgggtgtgtcatgagcctccgtgagagtgctcgtcagcatcagcggaggcagcatttcctggaacgacttggtccagggagatgctggccaagggcgaggtgcaggcagcggtccaggtggtgcctgagagcggacgtggatgagaagtcttactgtagcctgggagccggtggcgttcggggcggccctcggatagccctgatgtacgaagtgcaggttggacaatgttggctcgtttgcagagcagcttcgagccactgaagatggctggatttggggccatgccaggatcca

SEQ ID NO: 592679 - DNA, 292 bp, Homo sapiens
ctccatgatggctgagtgtgtaaaagaaagaccaggtggtctggctagtggctcacccctgaaatctcagcactttgggagaaaagaccaggtggtctggctagtggctcacccctgaaatctcagacaccctgggaggccaaggtgggtggatcacttgagatcaggcgtttgagaccagcctgggcaacacggtgaaaagccatctccactaaaaatacaaaaattagctgggcgtggtggcgcaagatctgcaatcccagactacttgggaggtctatcagcgacgtag

SEQ ID NO: 592680 - DNA, 799 bp, Homo sapiens
  misc_feature (425)..(425): n is a, c, g, or t
tttgttctttcttcccttgctttttgtctacactccttaaggcaaactacttgggaggctgaggcaggagaatcacttaaacccgggaggcggaggttgcagtgagctgagatcgcgccactgcactccagcctgggcgacagagcaagaatccatctcaaaaaaaaaaaaaaaaaaagtaacaagactcttaacagctgtggagatctgtgcctattctgagtgcttctccactacttcctgatactgatttagctctgtgtatatatttgttgaagtaatgcttagatcttagttgtattcatccagtgccctcccaatcatgttttgtgtggaatagcaaatcactttctgcttgtattccaaaaatgttgcagaaagacttgccaccctgctggggactgtccctgccccctgaccacttntggcctgccttacactcgattattttgggcaaaaagtgcaaatcaagactgagatgtcaggccaggtgcagtggctcatgcctgtaatcccaacactttgggagccgatggatcactcaagcccaggagttcaagaccagtctgagtaacatggcgaaaaaaacctgtctttacaaaaagtaaaataattagtgaggcgtgatggcatgcgcacacctgtagtctcagcttctcgggatagtcacagctacttgggaggctgaggtgggaggatcacctgaggccagggacacaggtacatcaaggctgcagtgggctgtgatcacaccactgcactccagcctgagtaacagagtaataccctgtttcaaaga

SEQ ID NO: 592681 - DNA, 512 bp, Homo sapiens
gaggatctatagatggcaagtaagcatatgaaaagctgttaaactccataagtcatcagggaatgcaaattgaaaccacagcgaggctatgacttacttatctcaatggctaaagaaaaaatagtgaaaataccaaatactgatgaggatacaaactggatattttatacattgctgacaggaatgtaaaatggtacagccactctgggaaagagtttatgaatttcttatcaagttaaacataattttttaatcaagttaaacataagacccagcagttgtgctcctggacattcattccagagaaatgaaaacctatattgtacttgtactcaaatattcataggagctttatttgtaatagccccaaactggaaacaacccagatgtcctacaacaggtacatggttaaacaaaccatccataacttggaatactggtttggaatgaaaaggaactaactgttgaaacaaaaacttggttgttcctccaggggattatggggtaccaaa

SEQ ID NO: 592682 - DNA, 384 bp, Homo sapiens
gcggattttagagaaccccggacaacatccttcggtatattcgattacttatacactgaggaggcatggcttgagaaaaaaccttgcgtgataaactcagaattattccacttttaaggatgattatttctatattggtagaattagatgacattgtaactgaatattaagggagtgttctagggcatttacttcttaaatagaagaccttgatattaataaaactaaaaaaaggttatcatttttttgagacaggatctcagtcaccaaggctgcagtgtagtgatgcaatcctggctcactgcagcctgaacttactgggcccaagcaatcctcccatctcagcctcctgagtagctgggacaacaggcgcaggccaccatg

SEQ ID NO: 592683 - DNA, 1843 bp, Homo sapiens
  misc_feature (101)..(101): n is a, c, g, or t
  misc_feature (262)..(262): n is a, c, g, or t
  misc_feature (327)..(327): n is a, c, g, or t
agttcatggcttgtggcgtgtgagttcacgagacctaggtttcaggccccgtctctactgtgcagcgacgactgatgccctggtgcgcgtcggagaggtcnattggtcctactggaaggcatgacagatgtatcccttcagtctgttcgagcaatcgacgtatcgaagcacaaagtagcatctcctgggaaaccctcgttcatgacttgttcttatgcacactgttaggttgcgcacaacccatgcggatgagtgccgtcantctatgatgttgagaacatgatcagcacggaaaacattgagtccacgtctggaccatcgtgtggngcgtgtcattgcgtgctcaccttcaaggactccctatctgcttcaaatcacccatacggttgcaggtctgcccattcgttcattatgttccaagtaacagggtccttcaattatcccttgcgcaattcggcatgcgtggagacgcgcgattcattgcttcttttgttaacaattttcgcgagcgattgcaccaaggaagagtacgctacgttcaatgcaagtttcgcctttggtagaagggcggtagtgaactgcctccattaccacaaccccacaaaagggactttggcgccggaccattgtgtccccaatgtggttcatttgagcgccgaggggggtcctatgggcttgaaggggcggacgagtgggtgggggccacttcacaagggaacaaacttcccgggaacacgggggggacaatatggataaggcgcccactcgcatataatcgcccgatttatggagccctccttaccttgtgggaggctgagatgtgccgactcacacaggtgcaacaacattgtaccggagctgcacgaaatctcctttcgaattctccctaaaagtgacgtttatatcaccgacacatggcgaattcgttcggcaaactttgccttcgtgcaagttacaggacttcctccgatttacagtcgaggcactcccccagtgtgtgggcttgttccctttttggccttcccacgttgcgcccagagcgagaacttggattggaaatttccttaactttgtgccttggtagacggaattacacacttggggttttgaccccatcgtataggcctctaacgcttttacccaaccttagggtcggcgcccaacttcgggtttgtgtgggcccaaggtatgcaacagggcctttaccaaaaccgcttatagaggtgcgccacacttagagtcggagcaggggttgcgcccccagagcagtagattggcgcagagagttataggccgctctgagaactgaggcgccttttaggtggcacatttagtgaggcgcagagattgtcccgaaccgtgttatttcacaaaatagacggctgtgggtgctttgtgaaacaggagcaagcgggtaattcggcgcgacatttaacaaccccagcgccgctggcatctaggtttggtcggacctccccagcaacagatgttctgcgcccgtgtaacacaacgccggcaccctccattaacactatggtggacaacctgcgcacacatggtgcaattgatctgtatgaacgagccctgtgccggcgtccccccatgattaagcatttcgtgcagcggcaaccaccatcacgtgcaccaggcactgaccagtttcgttacacactttcttgtaggcgtgtctcctccacgaaccatgctattgctgtccatcgccgttattaatcacagttaggtgtaccttctggcagacgcaacatgtaatagacagaacagcataatgcaaccacgatatttaatgtccgtgtgacgcaagcacgtccgatacgatcgtatt

SEQ ID NO: 592684 - DNA, 281 bp, Homo sapiens
agtgcgaggcagcctgggcaacatagcaagacttgtatctacaaaaaaatttttaaaaattatccaggtgtggtggtgcacacctgtagtcctgggaggctgagctgggaggattgcttgagcccgggaggtcaaggctgcaatgagctgtgatcgtaccactgtactccagcctgggtgacacagccagaccccatctcaaaaataagaaataaatgaaacttatgtttgtcaagggacattatcaagaaaatgaaaagacaactcacggagcggtggag

SEQ ID NO: 592685 - DNA, 654 bp, Homo sapiens
ggcatagctgttcagagttcccgtagctagacacgatctgcacgtatatagaaaattgagtacaaagtgtatgggtacgtgattagatcctaccactgctaaccaacaaaacagaactcatttatcatatccattttattcactccaaattttaataatacacttcccatatgacatggcctgtggtaagactctcaggaattagaagaggaagaacgagacattctgctgccctccccttaggtgaaggtggtaagcagtgctgatacacataaacaagcatttacaattcggtgtgttgagtaagtacgagatcctagaccacatggaaagagcacctaacttactctagatgggtcaggagttcaagaccagtctggccaacatgctgaaaccccgtctctctaccaaacatagaaaaatcagccaggcgtggtggtgcatgcctgtagtcccagcccctcaggaggctgaggcaggagaatcacttgaactgggagatggaggcggcagtgagcagagatggagccactgcactccagcctgggcgacagaacaagaatcatcttaaaaacaaaaacaaaaaaactaaaaggatattaatatattacactattttagacatgctatttcttcttaaccaaagatattttg

SEQ ID NO: 592686 - DNA, 479 bp, Homo sapiens
  misc_feature (321)..(321): n is a, c, g, or t
agttcgacggagactctctcccttcttgggtctctctattccctgagacaaaacagtattgaaattaggccaatgaataaccttccagtgacttctgcaggttcaagtagagcaaagatccacacgtctctcactggaaatcaaaaactagaaatgattaagcttagtgaggaaggcatgtcaaaagctgagatcagccaaaagctaggcctcttgcaccacttaggcttagttgccaatgcaaagcaacgtttcttgaaggtaattagaagtgctactccagtgaacacaggaataagaagaaagcagaatagccttatngctgatatgcagaaagttttagtggtccgtaaagaagatcaaactagccacaacattcccctaagccaaagcctaatccagagcaaagccctaactctctttaactataactcttaactctctttaattctagagttatagttaaagagagtctccgt

SEQ ID NO: 592687 - DNA, 475 bp, Homo sapiens
taagaaagagaaaaggcacctatggccatgctaccctgaacatgcccaatctcgtctgatcccagaagctaagcagggtcgggtctcgttagtattggcatgggagaaagagaaaaggggtacaaattcattagcatgggggcgtgaggggatcacaaagtgattatgcaaacttttgagggcctgtttgatattatgaaaataaaatatttttaaaataaaagcacacgattagtctatcaactaaattcaacttgatcatttgtaaaaatagaaattggaaacactaccctccagtggtaatatataatatttcattgaccagttttcctaacatttcacataaaaccttgaaactcaaaatagagattacagtaatcattaatttcactaaataaaatgaatgtgggtaaactgaattgtctttagtgggccactgaatagcacgctcactggagaaaagttgccagcaggg

SEQ ID NO: 592688 - DNA, 306 bp, Homo sapiens
tgttctggctgtcatgaagcacaggtgtccaatgttgggctgggacttggtacatagtgttcggaccacctctacgtcgaagaagtaattcacgcccccaacggtctgtagcctggctcttagtacccgcagcggacgtctgtagtagtcatctttggtggccttgttttaactctctgatggcgaagtgaagggcacgctgtaccccctccatcattgaggtctgcgttatagattccacccgggattatcctattcttctccttttggctccaggccagggccccagttcgggtggtcagcagg

SEQ ID NO: 592689 - DNA, 319 bp, Homo sapiens
cgctgatttccagggatgaatttcccttttcggggacccttctggagaaaccaaaacggggggaatttaacaaaaaggggttaaaattaaagcccttttaaaaggggattttggggaacccccgggattgggcaaaaaatccccaaatcggcaacaaatttggaaaaaatccaaaaaaaatttttaaaaaaaagggggaaaaaaatcccccgggggaaacccaaaagaaggggccccccctaaaaaacctttttggcccccaccggggcttttccaaaaaatttttaaaaaaaaattccgtagggaaattagggacttt

SEQ ID NO: 592690 - DNA, 113 bp, Homo sapiens
gcgaatctcaatgcagggtctaaaagactggtgttattgctgttattgtggttgtggtgatacacagttgttgctggaattgttgtgctggttatttcagaaagaagagaatg

SEQ ID NO: 592691 - DNA, 458 bp, Homo sapiens
tcttctccccgtacacataacaaataaaatttcctctgataacaggagcataggtcgaaaaaatgtgttacagtgcagatgagaattttccttagcactttcaactgtgaggtttatgtagatggggtggccaggaaaagcatccctgaggaggggccttgtccatggtgagtggattgactgggaggcaggcatctgcccgtctgaaaatctcttacttcagagagaatggtaaaacactaaatttgagaacctggtgcgatataggactagaagggctgacatggttggcaccaagctaaattgaggggtgaacgtgagagggatcagatggcagaagtacacggggcccagcgggggtctgttagccacggaaaggggttcgggctctgattcattcttaatgcccctggaacgtataatcgtgggcaaatgatgggtatgtatgctcaaaaagt

SEQ ID NO: 592692 - DNA, 344 bp, Homo sapiens
agaatttccttcaataccagtctgaacccctgtacatccataagccaattcttcactaattaccagagcttcaaaagttccaagtccaagacctccacagttctctgaaatgtgtgtgttcatatcatattctgcagcctctggaatgatttcctctctggcaaatttacgaccagtagcttgaaattctttctgctgttcggtgaactcaaaattaaatcctaatcgtggttcacgttgtcgattggcttttgtatgctgtgatctacaatgaaccagagaaatacttctcaggaccgtacagcatcgcgcgaaccccgctgacatgttggctcgcgttgcgg

SEQ ID NO: 592693 - DNA, 898 bp, Homo sapiens
taaaaaaaggcagggtctgacggtgtctccttagtctagggggcaggggggcaatcacagctcacggtagcctcaaacctccggggctccaggggtcctcccattctttctgccagcgtggaacgttgctaggactacgaaggtgactaatttaaacaattttttattgtgggtagaagaagtggggtactggaactccgcggggcctcgaggcgagtggctcacagtgtggtgcctcccagagggcagcgtgggactcatagggcgctcactacacacacgcgtgggcatcgtgaagcagggttgtgcgagggcgtggtgggggcaccgcgtggggcctctatctcaagcgtggccccatctcgtgtgggcccacactgtgtgtcccgcggacgtcgtggggtcatcatacactacgtgtgagaaggggcgtgaaaacggcccctctcacctgtgtggagagagaagacactccgagggaggcgtgtgtctcccctctcttttaatcgccaagggggcctacggagtgtgtgggaggcatcctccagaacgcacggcgtattctcacttgggggaggaatggtaggcgcaccccgggcgcccggggagctcccccgggcgcacttcgggtgagcatcagcacacgcgtgtggcccccaacccacgtggggcagaaatgagctgaggaggcagacggctcaaaggaggaccgccataggagtacaacagggagagggaatgacgccacaaacgcaacagggtggggggtaggagaaagcaatcacagaagaggagcgacacgccaggggtatgaaatacgaaaaaactcacaaggggcccaaagcggggcactaactaaaccactggggggaaacaggaccaaggggggcagcaccgg

SEQ ID NO: 592694 - DNA, 1013 bp, Homo sapiens
  misc_feature (30)..(31): n is a, c, g, or t
  misc_feature (35)..(35): n is a, c, g, or t
  misc_feature (153)..(153): n is a, c, g, or t
  misc_feature (179)..(179): n is a, c, g, or t
  misc_feature (188)..(188): n is a, c, g, or t
  misc_feature (211)..(212): n is a, c, g, or t
  misc_feature (216)..(217): n is a, c, g, or t
  misc_feature (229)..(229): n is a, c, g, or t
ggtcctgcttttcctgcctctgcctacctnngagncaggaaaagcaaggagccagaattaagaggttgggtcagtctgcagtgagttcatgcatttagaggtgttcttcaagatgactaatgtcaaaaattgagacatctgttgcggttcttntttttttttttttttcccccgggaangtgcggggngtgatctcagctcacggcagccnncgcnnctccggggttcnaggtgatcctagtgcctcagccctccgtgaagaatagcgtgggaataagcgggcgcgtgtgtgtgccaccagtgccccagccataattttgtggtacttttaagatatctaaagtgggcgttccatacatttgtgaccacaggctgtggtttcttcacaactctcttgtgacctctacagctgtgatgtgcggcctgtgcccttgtgcgcctctcacacaaaacgggtgggtgagaatttacgacagatttgttgagcgcccaccggtgaccctatacacttacatttttctgtgatacacaagagcgctataaaggcgtgtgaaaacacttggggttgcgactcgttcccttgagagagggagaaagcgcatatatttgggggcggctctaaaggcgctgatgaaacgctgtcaacagtgctttatattccccatctcttcatacacttacactggggcgggcgacacttctccccttatgtcgtaacgagcgctcctacaaaaaagcgcccagggataccttggcgcgcggcctaaacacaggtacaagtgttcactccccactgggagcggaagggcgcttatacaaggggggcgcgccaagcaaccatcacctcctgtggcaccttgaacgcccaagggtaacattggagttcgtggaaccccactcattagagaaggccttctacccctataagcttttgggggcttaacgggagacagagcgctagcagaagccgttttgggggagaaacaccctgctagaccacaaatttataacgg

SEQ ID NO: 592695 - DNA, 377 bp, Homo sapiens
  misc_feature (62)..(62): n is a, c, g, or t
gaaggggaaggagcagcttgctattttcttggagttctgtagcatagacagctggaggaacnattttaaaaatcacctgcttccattatggagtcagattctcccttttattaccatctcttttcttggactccatgacagtctgttatttggatttttaatctgacaaaactgatgtccaagggaaaggaatgtattatttgagggctcaaggttatgtcaattttgctggttctcagtgatccacactgtctgttgggttaggctggcgtggacgaggctctttgggggaatctcagatcagacttagggatgtggggatggagaataaggagattattccggactctctcccctctgcccttctgtcgtcttct

SEQ ID NO: 592696 - DNA, 254 bp, Homo sapiens
tagtaagttcaactcttaatagaagttgggattccacgtgtgagatcacgtggtcgtctttctagtacctggctatattttactttacgtaatgtccttcagtacatcccatttctcgcaaatgacaggaattccttctttttttatttaagaaatagaagtaccactcttgtggcccagagctagaagtagtccacaggtagacacgtacagaacaaatgagtggttggatgacaagcatgtggtgtagagac

SEQ ID NO: 592697 - DNA, 933 bp, Homo sapiens
  misc_feature (30)..(31): n is a, c, g, or t
  misc_feature (35)..(35): n is a, c, g, or t
  misc_feature (153)..(153): n is a, c, g, or t
  misc_feature (179)..(179): n is a, c, g, or t
  misc_feature (188)..(188): n is a, c, g, or t
  misc_feature (211)..(212): n is a, c, g, or t
  misc_feature (216)..(217): n is a, c, g, or t
  misc_feature (229)..(229): n is a, c, g, or t
ggtcctgcttttcctgcctctgcctacctnngagncaggaaaagcaaggagccagaattaagaggttgggtcagtctgcagtgagttcatgcatttagaggtgttcttcaagatgactaatgtcaaaaattgagacatctgttgcggttcttntttttttttttttttcccccgggaangtgcggggngtgatctcagctcacggcagccnncgcnnctccggggttcnaggtgatcctagtgcctcagccctcctgattagctgggataccggggcgtgtgccaccccatgcccagctatttttggtttttttgagtatagagggggttccactctatttggcaccgaggctgggtctcaaactctgtgaacctcagttgatgcgcctgcctgggcctcccaaacggctgatgttcacgagtatgtgacgccaccgcaccctacctctttttctggtaaccaaaggctaaggcttgaccactggtggatggtcctggaggggagggcatatggggcgcttaaggctggtagggtcaaagtttatacttcttaaattttggggggattccctatgtaggatgtctaaaaacgccgggtcctgggtcgctacaggtcaggtctccctgcaggaggggttaagggggcagactcacctgcggggaggaggtcactgctggtagcatatagagcctctccctagctgtgggttatgggggcttggaggtttgcgcaaccctgaaccaattttacgcattagatctggtcaggggatcccttcccattaagggcgttggttcctccaggaaattttgtcccgggctgctggcgtaaatgtcggaacgtcttattgtgaaaaccctttttgccccttaagacctgggcttttcacccgctccgttgctacccgggggggtgacctggggtgggccctg

SEQ ID NO: 592698 - DNA, 231 bp, Homo sapiens
tggtactgtcaactgtgacttgttcaaaactctgctgtttgacaaaaagcttttctcgcgcattaacgaccctggattcattgcgaagatcaacgatcttcgcaagggaggtgagtgtgccaatcaggacttaatggtcggatacaaaagtgaaaagtcagtgcaaaaagcagagggtaaccaaaagccgtcgacgcggccgcgaatttagtagtagtagtaggcggccgc

SEQ ID NO: 592699 - DNA, 459 bp, Homo sapiens
  misc_feature (302)..(302): n is a, c, g, or t
ggctttactgcgaacatcctctcccttcaaaaagggaaatgctcagagactcagtactcctctgcctccaatgtacctgtgtcagtcttgcgtttcttttttctatgtgaattacacttgtatatccaactgggagcactttaggcatcgtgtgcgccatgggatggtcattctgtggaggccttgcttgtgaatttgctgctattttagtttcctcttgctgtaaaactagcattaaacaatcattgttgttaataggctttctttcagaacaattatgtgaaatatatagctgctcttcntgaaaagcagcttcgcatctttttctttggactttgaagctactgcattgaaaaagtgcacctacccctccctgtttgaatgctgtattaatgtagtataattattactggttttgtaaatttttcttataatgtcccctgtctttaaaacatggtt

SEQ ID NO: 592700 - DNA, 915 bp, Homo sapiens
gcaaaagtgaagccccgtagtaaacattatatgtaaccactcattcgagtcgagcgtccccagcccatctcaacagtctccggcgtgatgaagagcttcggtcgtcactccttggcggcctgcctgatccgtccaaagtcgagccacaggacgtattcctaggcacactgcactactgcaccagacgcactcaggccgcctttgtcatcaatcggcccacatcactcgagacgtaaattgagtggctgaatcatccgctaccgtgtcacgccagatggcgcctcaatattctattatctgcctcttacctacacatcgcggcgaggccatatattagcggatcatgctcgtctactcagaaacctgaaacatcggcagttatcctcctgcttgcgactatagcaagcagccttcataggctatgtcctcccgtgaggccaaatatcattctgaggggccacagtaattacaaacttactatccgacatcccatacatggggacagaccgtagttcaatgaatctgcaggaggctactcagtagacagtgccacacctcacacgattctatgaccatttcacgttcatcttagccttcatggtagcagcccttagcagacaactccagctcctattcttgcacgaaacggggatcaaaagaaaccccctaggaatcagctcccagtaccgactaaaatcaccttccacccttaactacccgatcacagaggccgctcggcattacttctcttaccttctctccttaaagaacaataaacaacaataacaacaccagaagctcctagggcgaccaagagaaaacaaagccaagaccacacaccataaacgcccgtccacaaatccagcccgaatgacataacaactcgcgacgacaaaaccccagaacaggcccaca

SEQ ID NO: 592701 - DNA, 92 bp, Homo sapiens
aaccccccccccccaaccccaaaaaaaacggggcacccaactaagggtctttgtttgggtttaataatcccggatttttgtttgttagttta

SEQ ID NO: 592702 - DNA, 89 bp, Homo sapiens
  misc_feature (58)..(58): n is a, c, g, or t
ataactttggatgaaagttcccaggtttggagaacaatggctgttgcttaatttcaantggaatcaaacattttctttcacccacccta

SEQ ID NO: 592703 - DNA, 242 bp, Homo sapiens
taagagaagaaggaaggaaaggacggaaggaatgaaggaggaaggaaggaaggaaagaaggaaggaagaaaatgaagctgtggcagcttcattttcttccttccttctttctctttcttgaaagaaagagaaagaaagaaggaaagaaagaaagaaagaaagaaagaaagaaagaaagaaagaaagaaagaaagaattagaatagtttatccctcgaattccttccttctttctctttcttt

SEQ ID NO: 592704 - DNA, 166 bp, Homo sapiens
tgtgtctggggatgaggagggcctgggttccaatggcagagcctggggcttggcttcagagctgagaaaggcctggactggaatctctcacaaggcctgcccggctggtgcctgggcctaacccctggtaagggtatacctgtctggagggggtaacccccagctt

SEQ ID NO: 592705 - DNA, 918 bp, Homo sapiens
gagggcgggtggagtcgcggagtagtcctcatggccgccccgccggacccggtgagcccgagagaggaagtcccttaagctcctaggattttagatgttgaaaatactccctgggcccggcaattcaatattgtatggttcatataggatctgttgtggcttggctttggacatttttgtgttcactagtagaattagaagatcatgtgatgttggagtaggagggttttatcttggtgaacttgggggatgctggtttcattgtacggtataattaatgcaaacgcaaacggaactccaggaaaagaattgccagagaagaaattaacaacagaagatattatatgaaggtacccaccttcgatcctgaaagaaaacacaagggaagcaaggcagaaatgtggaacaatcttgagcaatagaagtcaatgtaaaccgaagttaggatcaacacataaaacaatttcatgtgcaataagctctcaatccaagtaaataaagttaaaggtgtagtcatttttttttccccacactttgtggtgcgcactgaaaaccttgccagtgtattcctgggcccggtgtcctacctgcagggaatagacttcttgtcaggtgttacaatataggggggacttggtcatcccctttaacaactgttgacacccgcaacctcaattggccgtcgtggcacacggcacttatcacacccttcgtgtacactggaactcggagggtgccctgtaaggaacgaacggtacacccaggtcggcgtgcccacgcaacggtcccttacaagaaccttacgtttattatctatcccatttataacgacgcatcatctcagaggctcgcacagcccaagtgcctgggcacatacaaccacgggctaccatctgcaacaaatgaaagcgacaccag

SEQ ID NO: 592706 - DNA, 102 bp, Homo sapiens
tagaatcgagctcggtaccacacggccacccccttctgatggagggcgggaggagaggagttagacagcagcccatgtaggagtacatgcagcacccagtgt

SEQ ID NO: 592707 - DNA, 260 bp, Homo sapiens
gcagaaggaggtacagcaggagctgccggtgtttcagagtggttttcagtgttctctatgcctgggggaaggggcaagtcaacctcagggcctgctgatagaccaggcacgagcaatgcttgggctcctgggattgggctatcaattgatagcccaaccccgggatgagtggcgtcaactgccccctgatgataatactagcatacgggcattcgatgttggacaactaccgccatctagtctctctggcgtatgattat

SEQ ID NO: 592708 - DNA, 302 bp, Homo sapiens
ttcatgtatgacccaaaaaataggtcgggttttaaaattttttaaaaaaaaaagttccaaagtaaattgaccaatgtttttaaagttatttttgttttataaacttttttgtggtatgtatcacagtctttataattttatttaaagtatatttgtactttcaagtattgatggaaatagactcaaaacagttatttctctccaattaatttccaaaggaaaaaaaaattgttgccttttaaaacatttgctggatatattatatgcaattaatagtagttaaaaatttattcatttggtaa

SEQ ID NO: 592709 - DNA, 183 bp, Homo sapiens
  misc_feature (54)..(54): n is a, c, g, or t
taagacatcctcagacagcggaccccaccacggacagcagcactgctcagagcnagcacgatatgctgatgatgactgagggcgcgggcgcctgcaggtcctgcggcagtgcagcagtgagtcgtacaccttgcactgaatctggcctggtgctctgcacaaggcagttaatccataggccca

SEQ ID NO: 592710 - DNA, 114 bp, Homo sapiens
agtaggctcggtcctctgacacggtaagatgtagccagtggggcaatgtcatgcaatgtgtccatgcaaggcaccccagttgcaagcatgcagtgagaacctctcatcctgggc

SEQ ID NO: 592711 - DNA, 88 bp, Homo sapiens
ctctctggattgtcagtaatgtcctggaacagaagcctgtgggatggccttgggacggagaagccctggggtcagtgtcgtgcacgga

SEQ ID NO: 592712 - DNA, 115 bp, Homo sapiens
gagatcatgccactgcactccagcctgaatgaaagagtgagaaaaagaaaaaaaaataaacgttttaactattggtataaataaaactttatctgcattttaattaacttgagag

SEQ ID NO: 592713 - DNA, 364 bp, Homo sapiens
aaagaaaacataagtttcagccaggcatggtgggtcacacctgtaatcccaacactttgggaggccagggtgggagaactgcttgagcccaggagttcataccagtctaggggcaacatggtgagaagttgtctctactaaaagtaaaaagaattagctgggcatggtggcatgcacctgaggtcaggtcccagcgacttgggaggttgagaggttggaggattgcttgagcccaggagatgaggctgcaatagcatgatcacgccagctgcacttcagcctgggtgacagagcagagagcctgcctcaaaaaacaaatatgtttcaacttttttataataaatatgttcatttaacaactagc

SEQ ID NO: 592714 - DNA, 253 bp, Homo sapiens
  misc_feature (6)..(6): n is a, c, g, or t
  misc_feature (11)..(11): n is a, c, g, or t
  misc_feature (18)..(18): n is a, c, g, or t
  misc_feature (25)..(25): n is a, c, g, or t
  misc_feature (145)..(145): n is a, c, g, or t
  misc_feature (171)..(171): n is a, c, g, or t
  misc_feature (224)..(224): n is a, c, g, or t
gaaagnagaanaaaagtnacatttnagatggaggctgtaaatatctggacattttctatatattgtttatatgttttcttgtttttctcttgttgtttatatcatattttctttggggtttttttaaaatgcctttgtaacagcncatactttcctgctgacatatctgancatctcttacaagcagttgacaatgttaataactaaaaataatctggattatnataagaaaatgggaacttgcctctgtttt

SEQ ID NO: 592715 - DNA, 461 bp, Homo sapiens
gcggacatccccttaccccctcccccccgaatttccatctggtccagccctctcatcttgtaggtgaggaaaccgaaggcctgagggagaactgacttgccaggaacccctgttaaggagaattaacaaagagtggttattaaaggagaactgagttgggagtcagacctggaggcccacacgcttggttaagacattataccaccttgaatctggcatgctgactgagggtgagccactccatcctcgtctgattgtggggtcttgacctcaaggggtttcttgcaggaaaaagcaaataggcttgctttcctagctctgtccagtaccttagggaccctgaggaccggagagattcttggagagccatctggtgtatgtcatgggtgggccttttttgaaggtcagtctgcccagtgggctggctcagcccgaatgaactgtcttgaatctttggagtt

SEQ ID NO: 592716 - DNA, 548 bp, Homo sapiens
tgtcctcggttttctcggctgctgtggtcggtcccgcccacagctggggcggactatgtcgagtggcgcccatgggaaagagggctcagttcgcatgtggaagactctcaccttcttcgtacgcgctgcccccggggtggcacgtcagcatgctgaatgtgtaccctgaagtcgcacacatgggagagcgatcgaggagacccgagttcatcgtctagcccccatctccgtatcaggacctaagccggtttcccttggggagatggtaaccatactccttattccataagcctcatgtgaatcctacattccaactggctacgaagatgaataaagagaatctggaccacgtacccgggccgaccaggagcacatgcattggtttggaccgttactctgcacatggggcagaaaaagtatatgggaccttaagctcaagcttcttgacttgtatcaaatgatgactggctatactggtcctcccatcccttttgctgtggtggcaggagaatggcgttaaaataaataagcttaaaacttaacaaaat

SEQ ID NO: 592717 - DNA, 133 bp, Homo sapiens
gagccggggcgggtttgaagacgcgtcgttgggttttggaggccgtgaaacaacccttttgagttttggctgccggtggagaacgtttagtcaagggcccggccaagaaggaaggcccgctattacgtggtat

SEQ ID NO: 592718 - DNA, 479 bp, Homo sapiens
  misc_feature (187)..(187): n is a, c, g, or t
  misc_feature (194)..(194): n is a, c, g, or t
  misc_feature (199)..(200): n is a, c, g, or t
  misc_feature (266)..(266): n is a, c, g, or t
  misc_feature (279)..(280): n is a, c, g, or t
  misc_feature (314)..(314): n is a, c, g, or t
  misc_feature (324)..(324): n is a, c, g, or t
agtaaataaagggtgaacttcttaattattcgaaaactgcttttaatattaggatatactcttttagctcatcttcgctggtcttgaggcttattataattgtcaaatcaacaaagtttctaatagagaagtagaagaaatatcttttgagatgtaagtagcttggtctgtcttctaaagtaatacnatacctngcttnnaaacttgcagcggttaacttctatattatcaattacgtgacacggcattttctaacagtttggtcnactgtcacaaaanncagtagtttaaacaggaagcaagcaaacggcaancttttaaagntattcagaataagcctgtaggtgtgaaggaataagtgttgcaaaatagttatttatccaagctgtcaattaattgattgaagtagttatcaaaatgtttctgtttctttctttggtatctattaactggtcagtcaaaagctattaaagaatgtt

SEQ ID NO: 592719 - DNA, 249 bp, Homo sapiens
  misc_feature (84)..(84): n is a, c, g, or t
gagctgaggaggagcagtccggtgagcaggctgagtgagcacagcgccacctcaacgcagagcggcagcggttgcaggacgagntgaagcagatggaacagaacatttccagctggatccagaagctgtgcaggacaatcagagacaaaagaaaagctccgagattttgaaatcgctggcaactgcacgaatcagactggaccagttgctgtccataacccagggaggagactgagagcctgcgccgcc

SEQ ID NO: 592720 - DNA, 164 bp, Homo sapiens
agaccctgacattatagcagacaccatagcagacacatccaccgaccgtatctagcacgaaacgggatcagacaaccccctaggaatcacctcccataccgataaaatcaccttccaccctatactacacaaatcaaagacgcccatcggcttactatctcttc

SEQ ID NO: 592721 - DNA, 449 bp, Homo sapiens
ggtacccggaaattcggccataatggccgggtccatagcaaataccctttttaggattcatatttacacgagacatttcctttcaatttttaactggtccaaatatattaattaactttgggggaataataggccatatggaattagaaatcagaaaaccagaatttaaggtctgtaacccagtagccaacccaggttccataaaatagtaaaaggggacctattcttaacatcgggtccaattatgaggggaaaaaatttaattaatatccagcaaacccttgaataccatccttcggtaataccagaggatgaggaaaaaggtcttcctgggttttttcaaggtaccctggtcagtttcttccaacatccggaggatatgcatgttaggcaaacggttgggcctatgaagtccaagtttgaccgatggtggttgttggtaagtctgc

SEQ ID NO: 592722 - DNA, 629 bp, Homo sapiens
acagtccaactcggggtgtggagccccagccaggggtccggccccttgcgcggctcagggcaaatcttctggctaccgggtccacagcagttactgggggggctgggcagggtgaagtgtgtgtcaccagagcctgacacagtttcttctcacagataacagcgctgacctcagttggagggcgctcagggctctagaaaaccccaaccaggggaggagcagcaacaccaaagaagtcccatcaggcaagaagcaacactcaccgcagttgccaccagtgctcagccagccggtggacactatgccaccagcactgcagcagaacaagacagtgctatgcccaaggtcatctgtgcaaacccaccacggtgcacacccagggacacggtgcacacccagggccatggtgcacttccatggtgcacacttaccacagggtacacccacagtggtgcaggcccatagtcactatgcacacccatggtgcatgcccaccaccgtgcacgcccagcaccgtgcacacccaacagcatggcgccacccatcctatgcagggtgccaccaatatgctcacccaagaggctgtgcaacccaaagacacgatttgcaacccagtgtgcacggcacac

SEQ ID NO: 592723 - DNA, 411 bp, Homo sapiens
  misc_feature (8)..(8): n is a, c, g, or t
  misc_feature (395)..(395): n is a, c, g, or t
  misc_feature (405)..(405): n is a, c, g, or t
  misc_feature (409)..(409): n is a, c, g, or t
tactcctnaaaaaatatgcagactataaacctaaatttagatgaaacgaatgtacattttcctgctttttgagactgggtttccctctgtcatccaggctggagtgcagtggcaggatcacagctccagcctgggcaacagagagagaccctgcctcaaaaacaaaaaacaaacaaaaagttccaagcaagaaaatgttcttcacggtttatgtcccaggtagtagtcactcttgataatacacaatctctgacacaattttttttttttttttttgagaccgagtctcactctgtcacccaggctggagtacagtggcatgatcttggcccactgaaacctccgcctcccaggtttaagccattctcctgcctcagcctcccgagaagcttcantttacttacntcanct

SEQ ID NO: 592724 - DNA, 808 bp, Homo sapiens
  misc_feature (776)..(776): n is a, c, g, or t
cagacaccttggagttttataatgttttcaactacgttatctaaacctttggtcgttatatgtctcttgtgtggaactgtacttctttgagtatcctgtattatgatcctttctcttaaatgtatattgataattcgataccaacactggaaggggtacagacatgaaaacatgctactctttgtcattgggatatgttttttttttggagaaagccttgtatctgacagaatttacctggttccatccaaattcggagaactagtctaccttcacgatgctgctgcaaaggacaacctatgaaagactttactatcttcccaagctcgtatttatctataacaagatagtgcataagttaccagaatatctgtatgtactattgtacatgtttatacaactgcatgtttctgtagacactaatctgtgtttaatgattacttgtccactgagcctgtactcgtgctttccataccaagtaaatatgaaataatctactttgcacagtaagcagcacaaacgtataatctcaccttggctgttcggagatttgtacgttgagtataaatgtacaccagtttttgctactttgtgaacgtcactctgtgggaggagtgaaagaaaatccaaaagcacttttcaatgttttgttgtttgttctataaagatatgaaaatgtatttttacacttattttacttagtttggaactttacagagcacactataagcaattgaggatataacaaaactactgaaccattttgcaaccagttntaactccgggggggttcttagtttttacgtta

SEQ ID NO: 592725 - DNA, 712 bp, Homo sapiens
aaaactatagactaatatccctgataaatatagatgcaaaaatcctcaacaaaatactagctaatcaaatccaacagcatatcgaaaagataatccaccatgatcaagtgggtttcataccagggatgcagggatggtttaaaatatgcaagtcaataaatgtgatataccacataaacagaattaaaccaaaaaatcacacgatcatctcaatagacacagaaaaagcatttcacaaaatccagcacttctttatgattaaaaccctcagcaaaattggcacagaagggacacaccttaaggtaataaaagccatctatgacaaacccacagccaacatttcactgaacaaggaaaagttgaaagcattccctctgagaactggaacaagacaggtatgtccactttcaccacttctatccaacatagtactggaagacctaaccagagcaatcaaataagagaaagacataaagggcatccaaatcagtaaagaggaagtcaaactgtcactgttcactgatgataagattgtatacctagaaaaaccctaaagactcataccaaaatgctcctagaaactcgtaacatcgaattcacgtaatcctttcagcgatacaacacaactcactgttaccaaatcagtagcactggttatacactaaacaggcaaccaaagctgagattcaagtcaagaactccttttacatta

SEQ ID NO: 592726 - DNA, 427 bp, Homo sapiens
ggcaggccctgggctggaggtcagggataactggccaggaccgcagttgggggtgaagttcccagacctggctgcctcctgagtaggccctgccagaacggctccctcccgatgtgaggttccgcatgtcctcttctgatttatccagctctctgacctcgaggagccaccaaactgcagactgggtccccagggccagtctctggcagggaaagtggctggtgatgcccagagtccccacagtccccccaaggcccccggatgtgaagatgtgcttggcccgggagccccgtcccactggacgcagtctgtggcgtggcccccacctcactgtttgctccacaacgcaggctagaagcactctggggcctgaaggggccgccctggaagccaacccaccccacactcctttaccctttcccagctg

SEQ ID NO: 592727 - DNA, 103 bp, Homo sapiens
aggagtagcagtggtatagatcttggctacactagtaacctaccgcctacccgggtacaagccataacacctgcctacagtactcctaagtagctagggataa

SEQ ID NO: 592728 - DNA, 804 bp, Homo sapiens
agccacttaagacctttaagcccttgaggggccatccctcagaaccgtgtttgaccccacacggggcaattaccaaccccattcacattaatttgtttgtaatatatttgggggtctccgagactggagattttataacaccacgcaactgttatttccccttgaaagatttctgattcacatatgtctagaatatattcaccacgaaggaatggggaacttattctcccatccaagtctaaaattttcagaagtctgtaaaaatggagaacaccccttgaaagaggccgaaccggtaagggggatatattcttagaaaacctcgttggttaaggcacgctgcactgtgataaaagtggtacttgaagcttggtagtgtttccctagaagcctccctccccaaaatatgcactttaccccggggcttgttacccaatttttgaccgtttttcatccactgtccaaaacttcaacccctttaaacctagatataaatgcttacatgtttaagaaaggaagctaagccgctgggtacctcgggatctctctgaactatttttataactttcttgtgagtcttaagtatttccaaataaaagtggtttttaagtaaattcatagattaaatgtatccttatctatatataaccctgatttaaaccttaattttctaaacatagtattccacttagttggataaatatatgatagaagttaaataggatttttatttcattcttaaggaaaactcatgtttgtaaccaatgatattctaaagatctattttgccctacccggaaagga

SEQ ID NO: 592729 - DNA, 493 bp, Homo sapiens
taaagaggaccaaaacaatacaattgtctgtgaatgacaaaaagttttaaggcaaccaaagtcaaagatacaattgacaaggaaatttgttacctctgtggcaatatagcaattataattactgctaataatgtacactaagtcatataagaattataggagtttcccataattttagaacaaataccaataatatacttatacaaacacagcccaaaaaaaccaaacaccatttcatattcaacaacgttctctgtataatttttataagaaataagcaaaattatgtcatttttaaactttagggaacataatattttaaaggattaggtaagaaaaatacataatttataatttgattttggaaagtttgatggaactttgttccacagaaagaatctcagtcaaatatcaaagatttaaaacacctgatgtcacaggtcattgtaaaataagtcattaatttgaccaaagtaataaagatttcaaaaac

SEQ ID NO: 592730 - DNA, 954 bp, Homo sapiens
  misc_feature (663)..(663): n is a, c, g, or t
ttccgcggtgcccttatatattgcgcacgttcctccgttttagcgccgcctttgcacccacctggtgctgcggaactctgcgttactgaccccctcgtgtaattcccatgggggtttcctctgggaccgccacccccttttactggccggccacagtggcccttccacacaaaggtttggtacttgccacgccccatacaaggtgcttgccccaggttgacactgccgcccacatcaagtgctgggtccacgaacgccacttctttcacaaggcaacgtgtatcccaagcgacgcttgttcggtggcaccgaaaattatctcctcccgcggggtttcccccccgaggggattcttccaccacatttatgggtggaaaaaagcgagcgccacacttatttcccggccggaacctccctttggggcttgaactcccccctgaaagagcaaccacccttgggaaaaacaacgcattatgacgtcttgggaaaccactttcgctcgtgttaaaaatattaatatcagaagagtactcggacattatgaaatcccgatttttaactccccgtgtcttctacgcgcctacaaagcagcatactttttatacaggcggccacacccccacggtacaccctaacactagtagtgaatttcctcactctganatctaactttatatggagcaccttctctccactcataccatatatggatattctgtgctcccatcagcactaacccactatcaactccttgtacaatccccaattctccaacgtaactgtaatcttctctctcaaccacaccctgtccataaacaaagtcattatttctagtccgcagactatttgccacaccagatactttttctacacacacggtagttcaatcgcacgccacgcttgttttaaaagaccccctataaatccctaaaaaccttttaaacccacaaaaca

SEQ ID NO: 592731 - DNA, 1011 bp, Homo sapiens
gggatgcttgccagtgggccgggcctgaccgctgcgtgggaggcgggctgcattatttcccgctagggccgcgctccaggaaggaaggggccagacacgtgccctctcagccccgaaccggcgcgctgcttgccctggcgggcggggatccagggcgcggtccgaggcggcgggcgcttgaaccccctgggcctgtggcccgtgcgaattcccccggtggggctttctccccaactgcttcggtggccccgtgggtcctaacccttttcctttccttttcccttcccccttcgggtgcttccccggggagaggctgccttcgggaaaaaccgccccggagctttttgttggggggcgcccggggggggccccaagcaggagacgcccctcggggggcgggcccaaagtttgggacattcatcccggggaacgggacaccccgagaaggcggggaaccttggggaagggcggtggccccggggattgggcaaggcgagggaccgcatatggaagagcggcacgatagaggggctaccaccgggacaaagccgcgaggataaggcgaagcggtaggacaaggcgtccggcaccggcgaacaacgtggaccctggggggcagagcatcccggccactacgccgagaaacacactattttagacgtcgttgatgcggcgccccaggatgcagaggtcacaggggtacactccggggaggagatcacatggggccacacgctgtgccgccggacaacaggcgcggagaatggcccaagaacgccagaggtgccccccggagggcggtaaagggcgcccatcgcgagcaagacggtccccgtggcccgggcgcgtcggcacccacgtatggagacgggccgggacacgctgatttgggcggacggcccttggagcaggcggatgtgcaacgcaccaaggagactcgagggaagggccacttggggacgcgacaaaaggccgagcaggcgctgggaagaggacccaagaccctcggag

SEQ ID NO: 592732 - DNA, 854 bp, Homo sapiens
  misc_feature (255)..(255): n is a, c, g, or t
acccgggagttaccgtgcgggcccatcctggccatgtggggcacggcgaggcttatacggcgcgggcttcgacctgtggtgtttggtcctgcccccgtggggggccctccgtcgtctgggagcaggccaacccggccgcgctgtgtccgcggctgcccccatgctggtcgcctccgaggggcttcctctggcttcttgagcccattcatgccgtgaggccttggccaggatgaatactgtgtcgagttggttgcncctggacaagagacttccacctgaagggttacaagtgtggaggacttcgggaagcccctgtcgagtgaggcagatgaccatggctggcttccccctggacggtcacgtgctctgtcggaagtggccaccactgctaggagccccgacctgagtgaggacaggccctcttctagaccgccaaggtccatgcccccttgtggaccacccaccgctgagacccacctgcccccacctcagttattgttttgatgtctagccccgtcccgatttccgaacccctccgctagcattcccggtgccctgacacccaggaccccacatggtctagggatcgaggatccccgccctggggtctggtcctcgcccaatcctgcagggattgccccccgtgttcccagacacccccccctgaggggggcacccaggtttagtgctgcgtgctttcactgtgcacccgcgccctcggccggccccccgagcagacctttgtactttgcttcggagggctgggagaccctcccggacattcccccaccctcccccctgctgcccagttgtagctatagctaccaaataaaaaaaaaccttgttttcccaga

SEQ ID NO: 592733 - DNA, 516 bp, Homo sapiens
ccgctcacggatacctcaaagatattcatattacagagttatttacagttgcctagttgaattgtatttcatcagatatttatgaggttgtgtttccgttttgtttagtgcatgtttctatgcacatttcacctatttgggacaacagtacatttaatataacgcctcttaatttttaaaataaaagtgacatgttgatctgtggctatgattattatgtttcaatgtttgtcccctccaaatctcacattgatatttaagtccccaattgttgcatgcaacgccccagttgtgaggtattttggtcgtgagggcaagctcccgtgaagggcttggtaccttcctcttggcaatgagtgagttattattgcattagttatcaggataactgattgttcaaaagagcctggcacctccttcctctctcttgctttcttcctctttccatgtgatgattgctcccctttgacttctgccatgagtgaaagcaatctgaggcccttaccagagacaggt

SEQ ID NO: 592734 - DNA, 107 bp, Homo sapiens
ctgatagctaggaccacaagtgtgcactacaccatacccgagctaatttttctgatttccagtagagacaaggtctcactatgttgtccaggctggtcttgaactcc

SEQ ID NO: 592735 - DNA, 346 bp, Homo sapiens
cgtcgacatcagagaggtcttcactgtagtgcgctgccaacccacagctctctgcgtcctcccccaacaggacaggtagcctatcctcatcagagaggtcttcaatgtagtgcgctgccaacccacagctctctgggtcctcccccaacaggacaggtagcctactctcatcagagaggtcttcaatgtagtgcgctgccaacccacagctctctgcatcctcccccaacaggacaggtagcctatcctcatcagagaggtcttcaatgtagtggtctgccaacccacagctctctgcatcctcccccaacaggacaggtagcctatcctcatcagaggtcgacgc

SEQ ID NO: 592736 - DNA, 155 bp, Homo sapiens
gtatcgatcagaatcaggctttggtcgatggaccttgcactccagttaggagacaggccatgcctttcaagtgcatgcagctcactgattgcatcctcaaattaccgcacagtggccaccagaagtatgtgcgacaagcctggcagaaggcagac

SEQ ID NO: 592737 - DNA, 415 bp, Homo sapiens
aggggaggggagttaaaaaggggaagggaaaaaaaaaaaggtcccccggttccgcctccaggatggggggctcccggaaaaaacaagaaagggggctttttatttggattgggggggaaccaaagccttttggttggatcctttaaatgaactggggacccctgggccccttctttttttcaacgggggggggccgggaaacaaattttcccccaaaggttggcttttgggggaaagccggaaaaaaaaatttttttgtttttcaaagccggtttttgggaaaaaaaattttttaaagggccaaggggggggccaaaaggttctttgaaaaaggtggtttcgaaaaatttccattaaattttaaaaaaaccttttggccccccttttaggtaaagaaaaaaaattttgaaccgga

SEQ ID NO: 592738 - DNA, 488 bp, Homo sapiens
  misc_feature (236)..(236): n is a, c, g, or t
ttaaatgaatacatttattctctcacaggatactacactgttacccagtgtgaagggagcagccatgtggtcccaagctcccttagcaaaagggtggttctcaaaactgctccattcacaagtcctgcaaccaaaggcctgggctcaactcacacaaagttctaagcaatggccagcaccttggaatactcaccttcccacttgcacaagctggtggggatgggtgtcttaattcntgtccccacaaggttcccattatcctcaataaagaccacgttattgaaatcaaatctaggggtcattcgaaggccagacatacagtaccccacaataaacacctttttcttctatcccttgataaccaataatatctaatcacccaccttacccactccattcttcttatatacatagatacaacaaaaagcccaataatataaactattgcccaaagcactattatccaccactcgtacccacgtcatctt

SEQ ID NO: 592739 - DNA, 666 bp, Homo sapiens
ggtccatcccggataattgctgaagggtcagcgctgcgaccgtgtgtgttactcttcctcctcctcctcctctggagatacgacgtcttcgtgacgtcgcatgcgttctccgcgcggctgcctacgatgcctctcggacgacgtgcagacgccgagagcctccgctgcccagagtcacctcctgcgccatcgtcgagggacgcgatggcatgctcgccggaggaggagctgaaggatggcgagcgccgctggctccgcccgtccaccgcggcgacctgcggctgctgcgggtgctggtctccggcctcgtcctcggcgactcgccactgcgtgtgggtcctgccgccgggcagcgcggatgtagccgcctgtcccgggagcctggagctgtgccctgaagaggcgggcaaggtgtcttcctggtgcggcatgctcgtgtgggccctgtccttcatggcccttccaggaggaccagcgagggctctgtgtgcccaggatgcgccggctccaggcgggggccggcccagccatgactgaagatgagatgacttcctgttcccaggagtttgtccggcaggaggtctggacagctcaatccgcccctacccaaggaacgacagcgggtcccggaggctgtctccctgggttctcgtgaggggggcgggt

SEQ ID NO: 592740 - DNA, 179 bp, Homo sapiens
gggaactccagagttgtcttggcctgaggaaggtcattggctaaggtcgtactgacgtaccccgtagtggtagtaaagggacacagcagtaggagggtgtaaggtgttgggctgttggagttacactcagtgttcagaggggggtgacaacctggcagaggggttcttggtaggcaccc

SEQ ID NO: 592741 - DNA, 128 bp, Homo sapiens
caggtcaacaaggtcctgcattactcatcaacttagttgatatccattttgtcatgggccgccttcatggaccttggcggatagcccatgttcttgagcacctcggtttgggcgctcggcgtgtgcac

SEQ ID NO: 592742 - DNA, 94 bp, Homo sapiens
  misc_feature (60)..(60): n is a, c, g, or t
  misc_feature (75)..(76): n is a, c, g, or t
gtgccatcctgcagcgaggctgctccaaagggcaaggttaggtagggcagagcacttttnaaatgtagtccgttnncaaagtaggcaccttctc

SEQ ID NO: 592743 - DNA, 815 bp, Homo sapiens
attgacaactgagtggcccacgattgggaagaggggacagcccaggtgtaccggatgcctctgggtgaaggcagaggctaacatggggttcggacgcgaccttggccgtatggcctgaccatctttgtgctgtctgtcgtcgctctcatcatctgcttcacctgctcctgctgctgcctttacaagatcgtgccgccgaccagcgtccggttgtcgaccaccaccacatccaccgagctgtggtgcatgccccttatcctcatgcctccatagtgtgccgcccgaggctaccctggaccaagctaccagggctaccacaccatgcctggctcagaccagggtatgccagctagcaccctacccaatgcagtacccacgcaccgttagcccagcccagcccatgggcccaccggcctaccacgagaccctggctggaggagcagccgcgccctacccctgtcagacaggctccttacaatcccggcctacagtggatgccccgataggcgttgtcctctgagcattccctgtgcctctcgtggctgtccacttggttcatgtacgtgtgtgtgcgtgagtggtgtgcagcgcgcggttccttacgaccccatagtgtgctgtgtgtgtccaggcacggctcttacgccccatgtgtgctgtgtgtgtcctgcgcttgtactatgtggcttcctctgatgctgacaaggtggggaacaatccttgccagagtgcgctgggaccagaacttgtgctcttcctcacctgaaattatgcttcctaaatctcaagccataggtcaaacgaatggggtgatg

SEQ ID NO: 592744 - DNA, 752 bp, Homo sapiens
tccccctgtggcaaggtacctcccgtctgcacatgccagtgcgcctggactacacgtcgccgcacaaagaattctgaagccacatccactctcaacgcattgggaccactcccgttgcacggctggacagtcccagatattatctctccggaaagaccgcttcaatcctcttcttcggtcgcaaacaggggcgatgagtgcccaagtgtggggaatcgagacaaagcgatggccacaccagtcccagtattgaacaactacgggttatttcgaccacatttggggccgcgaagcccagtttttaagtaagcatgtctccgcgccgcgggcgcaataatgttacatgggaagtgcgcccaaggcggggcagtggccgtatatttcgtgcctattcttattgttgcactgaaaagaaatggcgtcctcccccgcaaagatcccctgtgtggcgcgtaaaacacctcgggagtgactccacaaggggggacaaccttccaccgggggcgacagaaacacaaggtggatcctcaggcggctcgggacccaaacggttgctaccacccctgctaagagaaagccccaaggcaggcatcgttggagagagacccgcagcaagaaaacgagggggggcttcagaagacaccactggaccgctgaaggcggagaagaccgccccaactcctcggcggctgtgggaaagaaagcgaaaaaaaagcagcgcgcgggcgtttaacaaaaaggagccgccattc

SEQ ID NO: 592745 - DNA, 827 bp, Homo sapiens
tcaggaacgaggctacatgcacgctgtgtcatgtctccggaaccagctgacctgtggcgaccccatggcgggcagcggaggcgcccccgtgctgcgggtgggccatgaccacggctgccaccagccagcccttactgcaacgcgcccctccctggaccctggaccctatcgggtgaagttcctcctgatggacaccagggggctcacccagggactgagaccaagtggctacagacccgcatacactactccaccaagggaagacccccggataccatcagacacctggccagggacggcgaagtggacagcatgatcgtcatatacctaccatcctactcttactctggccggcctcctactcttggcctatcttggcagcactctaccatgcgcttctccagacctgtggtggcccggagggaggccccggagacagactgacggatcggctccttcatgggacaagcgactacatgacccacccacatcccacccagacgaggaccgaccacactgaccggatgggagctgccaagaccctggaacatgacacaccccatcacacaggactcagaacccatagacatgagacaatcatatgcactggggcacggcggaagactgacgcaacagggaagataagcagccatggcgcataagcccaaaaaccgagccaaccaaagggacggcagcacgtgacgcagccacacacgggccaacgggacacgacgcacgcacgaagacagagaccgacaaggaacaggacaaccaacaaaaacaccggcacccgaaaacagcaagacgacaggcgagcacgagcaaca

SEQ ID NO: 592746 - DNA, 705 bp, Homo sapiens
atgaaaagcattgggattctactcctaacgaatatattcaatggcgttatgctactggtgaagatcgtgaagaacttgacaagaatgaccgtatgcacggtgatgctaacaagaaggtcatggaacaagtcttcgtcatgatggtgagaagcgtactgtgaagaactcgtggtcgtagaaagcttaagcaatcttacgaatacgaaatctctgggtggtcgttcttccgtcgataacacctggatctctcgtcaaaagcttgaagatatgggtttcggcacagaagattgctgaagtcgattccgctgaagccgccaagatgggtcttaaccgtcctcttactgctaaggaaattgagaagcatttaactgatgtcggtcttgaagccgaattcgccactcactctcgtattcgtggtctttccggtggtcaaaaggtcaacgcttgtcgttggtgctgccatgtggaacaagccccatatgtctggtctcttgatgaacctaccaattacttggatcgtgaatctcctcggtgctttggctatggtatcaaggcttacggtggtggtgtcgtattgttactcaacaacgtgaatcactgaagctctctgtaaggagtctggatggttgaggcggtcgttgacccttctggtcacagggtttccggtacggggccctaaatcgaggcaacgacctgcgccccact

SEQ ID NO: 592747 - DNA, 402 bp, Homo sapiens
ccgagtagctgggattacagggccacaccaccacacccagataatttctgtatttttagtagagacggggtttctccatgttggacaggctggtcttgaactcttgacctcaaatgatctaccccctgtcagcctcccaaagtgctgggattatacgtgtgagccaccgtgtccagccccttcccgagttttctcatctggaaaatgagaaagtccaggttggtgctgtctgatggaaataaaatctgagtctcaggcgtaattttacattttctagtagccacagtaaaagtaaaaagaaacaggtgaaatcagttttagtaatgtatttatttatcaaacccaatatagccagaatgttatcatttcaacatgtaatcaataaaaaatctagtaatgaaa

SEQ ID NO: 592748 - DNA, 936 bp, Homo sapiens
gactacaagcgactgtgagctgggctggatggtgcatcctccatcagggtgggaagaggtgagtggtacgatgagaacatgaacacgatccgacgtaccaggtgtgcacgtgtttgagtcaagccagaacaatggtacggaccaagtttatccggcgccgtgggcccaccgatcacgtggagatgaagttttcggtgcgtgactgagcagcatccccagctgtgcctggctcctgcaacgagagcttcaactctattactatgaggctgactttgactcggcaccaaagaacttccccaactggatggagaatccatgggtgaaggtggatacccttgcagcgacgagagacttctcccaggtggacctgggtggcgcgtcatgacacatcaaccaccgaggtgcggcagcctcggggcctgtgtcccgcccgccggctctctacctgacttccacgacctattggcctgcttgcatgtccctcatcagcgtgcgtgtcttctaccgccagtggcacccgggattcattcctcgcattgggcggccacttctccggaaacacctgtcccgcgggcctgagcagccaccctccctgtgagtgcatgctcccgcgcgccacgcatcgcttgtcccactgcgcgacacaccgatgctgacctgctaccccctcttaaagccgtcgtcaccctgtcacccgggcggcccacccggacaccgtggcctcgtctcgtcccccatcgctcgcccgccctgtcccatgctccccacacccacatgggatttcaagggcccgcttcccacacatcgtccaccccctctgtgcgcaccgctagtcccacctctgggcaccgcttctcacggcgcgcccacacagtggcttaagtcgcgtgtcccccgttcgtcccctaccgaccccagcccctcttcacgtagcac

SEQ ID NO: 592749 - DNA, 354 bp, Homo sapiens
gtacagtggaacgactgacatcttgtgcgaccgccgccttcctatttcgctcgttctcggtcactgcttgtacccggtcctcttctgggacaccagcacactgttcttcgtgaacaccttggcacgatcatacgtgacggtagcatgcatgcaggtgtacatgtgcatgtcatagcctgagaacgtacagcccagtgcaagggagcctcgtcatactgcattcatggatgagtgggaccactgagcacttaggactaaggacagtgatgcagccgacttagacacggaccaagtgacctatgacatgtatgcttgtcaagtcaagaattggctctaacatgctgggttctgtgg

SEQ ID NO: 592750 - DNA, 415 bp, Homo sapiens
  misc_feature (36)..(36): n is a, c, g, or t
  misc_feature (61)..(61): n is a, c, g, or t
  misc_feature (94)..(94): n is a, c, g, or t
  misc_feature (282)..(282): n is a, c, g, or t
  misc_feature (415)..(415): n is a, c, g, or t
actttgtcaaccccgggctggagtgccagtgggtanaatcctcagctcactcccaaccctnccgccccccgggctcaagtgttaaattttgtanttttacctacagacagggtttcactatgttggcccaggcaggtctccaactcctaacctcaagtgatccgccccacttcagcctctcaaagtcagggattacaggtgtgagccactgtgcccggcctcctcagtccatttttaatactgaaggtataaattgtataaagatgtttagaaagttctaantcattttatgcatttttgcaaatttgactccatgaaagtgcattatcacgaagctgaatttgtgtaagcattgtgcatgtatgtaaaaacattgcaacttcctcaataaaatatcttctttttgtacatccan

SEQ ID NO: 592751 - DNA, 409 bp, Homo sapiens
gaccacggcgatccacggcggcgacgaagttgttcggagcatcatcgacggcgaccgggatcaggatgaaaatgggggaggcgatgaagggctgaccatgcttcgctgagattgcggcgagacgtatgctgccgtagaatcgttgctcatccgatgtgagcagcgtccgattcttcattgggactccttcgctaactgactaatagtagtctatacgcaggaagccggcctgtctaccgatgcgctgagccaattggaaaccggatcatgtctccttcttaggcggtggctcctgttccctgatgatgccctgcaccttgcccagtctcatgatccagtccagatccgcgaatcggtcccaccagccacggcagatcgcgttctgttgcggctcggggtaccgagctcg

SEQ ID NO: 592752 - DNA, 380 bp, Homo sapiens
  misc_feature (20)..(20): n is a, c, g, or t
  misc_feature (25)..(25): n is a, c, g, or t
  misc_feature (75)..(75): n is a, c, g, or t
caaccccccacatgtattgnattgncaagtacactcccctcacaagccttccttgagacctaatctcctctgccnccccgggagaccccaacctgtgacaattactgatttaacagattgaaaagatagtattgtataaaataatattttgggcaaggcgggtggatcacgatgtcaggagttcaacaccagcctagcccaagatggtgaaaccctgtctctactaaaaatacaaaaattagccgggcatggtggcaggtgcctgtaatcccagctactcaggaggctgaggcagagaattgcttgaacctgggaggtggaggttgccgtgagctgagatcgcaccactgcactccatcctgggcgacagagtcagattc

SEQ ID NO: 592753 - DNA, 1049 bp, Homo sapiens
tcagtccactagcacccaagtgaattaacagccttgtgctcacacaaagcctgtttaggtggtcttctatacggacatgcttgacaactatggtgccataacatctgggccagggggactccttcgtgagaccaggaccccatgatccatggccctcattccgtgaagagatccacctgacgacctcgaggatccgtcagcacagagccaaggaacatctcagccaatattcaacatcggggtcccatggagctctggctcaaagctctctggacatgaactccttccacagataatacctcggcgttagaggctgaagactgactgctgcaccgatcgaactccagaagccccattgagacacatcacagaatgccgcagcctccgagagataacatactatacaggagagagggactctgcaatcagaactactagaacaacgtcccatacacgaccgccacatcacacactatgcggacaacgggtgtaccacagcagaacccctgagtccacactacagacagacggtccgggagaaaactatcaagcccctcaccccagagacatcacccagacggcaactcaccacgacggaggcaaccaacccctacaacgctccatataacaccaccataaacccgcaccaaaaatgtccaggcccgaggcagcacggaagactaacacaaggtaacccccgatgacctgacaaataatccgccacagtggccatacaggagacagaagaacggaacagcccaaaccaccaaacacggaaacaacaggacaggcgtaacgaatcaacaccaaaaaacaataacgcaaacagtactggccccaaaatgcatgcacgaacgagcaacgggaacaacccggcaatctcatcttgacagtaccaagtcaccaggcagtggaacccatagggaaccagtcaggactcacaccaacctagaacacatcaggaactagagacccacagaaagggccagagggaaaaacccaaacgagctacacaaacgcctgaccactacttccagcggctgcgtagg

SEQ ID NO: 592754 - DNA, 5832 bp, Homo sapiens
  misc_feature (5731)..(5731): n is a, c, g, or t
cacactctggggaggggctcctttgcctgctcagttggggaagggacagactcataaactcaagtgcagtgggatgggagaagaagttgtccatgttcacactgggtgaaggaagctgaaaccacagacatgactgagtcctccatgaagaagctggcctccaccctgctggacgccatcaccgataaggaccccctggtgcaggagcaggtctgcagtgccctgtgctccctcggggaggtgcggccggtggagacgctccgtgcctgcgaggagtatctgcggcagcatgacaagctggcacacccataccgagcagcggtcctgagggccatggagagggtcctgagcagtcgcgccagtgagctggacaaggacacagccagcaccatcatcctcctggcctccagcgagatgaccaagacgaaggacctggtctgggactggcagcaggcggcgagtggcgtcctggtggccgtgggaagacagttcatcagcaaggtgatggaggagctgctgcgcaggctgcaccctgggaccctgccacactgcgccgtgctgcacaccctcgccagcctctcggtggccaacgcgttcggcgtagtccccttcctgccatccgtcctgagctccctgctgcccgtgctgggcgtggccaagcaggacacggtgcgcgtggccttctgctccgctctgcagcgcttcagcgagggtgccctggagtacctagccaacctggaccgagccccagaccccacggtcaggaaggacgcctttgccaccgacatcttcagcgcctacgatgttctcttccatcagtggctgcagagtcgagaagccaagctccgtcttgccgtggtggaggctctggggcctatgagccatctgctgcccagtgagaggctggaagagcagctgcccaagctcctccctgggattctcgccctctacaagaagcacgcagagaccttctacttgtccaagagcctgggccagatcctcgaggcagctgtgagtgtgggcagccgcacactggagacccagctggatgccctcttggctgcactgcactcccagatctgtgtgcctgtggagtcctcaagccccctggtgatgagtaaccagaaggaggtgctgcgctgcttcactgtgctggcctgcagctcgcctgaccgcctactggccttcctgctgcccaggctggacaccagcaatgagaggacccgcgtgggcaccctgcaggtggtcagacatgtcatcaactcagctgctgctcagatggaagataaaaagccctttatcctgtcttccatgaggcttcctctcctggacaccaacagcaaggtgaagcgggcagtggtgcaggtgattagcgccatggcccaccacggctacctggagcagcctggaggtgaggcgatgatcgagtacatcgtgcagcagtgcgcgctgccccccgagcaggagcctgagaagccaggccccggcagcaaggaccccaaggccgacagcgtgcgggccatcagcgtgcgcaccctctacctggtcagcaccaccgtggacaggatgagtcacgtcctctggccatacctgctccagttcctcacccctgtgcgcttcactggggccctgactccgctctgcaggagcctcgtgcatctggcgcagaagaggcaggaggccggggccgacgccttcctcatccagtacgacgcccatgcgagcctcccgtctccctatgctgtaaccggaagactgttggttgtgtcttccagcccctacctaggggacggacgtggggcagcggcgctgcgcctcctcagtgttctgcacccaaacattcaccctttgctgggtcagcattgggaaacgactgtcccgctgctgctggggtacctggatgagcacacagaagagaccctgccacaggaggagtgggaggagaagctgttgatgttcctgcgagacaccctggccatcatttctgacaacgcgtggatctgccagctgagcctggagctgtgcaggcagctgccctgctacgatgaggcaccccaggagaagaacttcctgtacaaatgcataggcaccaccctgggtgctgcttcaagtaaggaggtggtgaggaagcaccttcaagagctgctggagacggccagataccaggaggaggcagaacgcgagggcctcgcctgctgcttcgggatctgtgccatctcccacctcgaggacacgctggcccagctggaggacttcgtgaggtcagaggtcttcagaaaatccattggcattctcaacatttttaaggatcgaagtgagaacgaagtggagaaggtgaagagtgctctgatcctgtgctatgggcacgtggcggcccgggccccccgggagctggtgctggccaaggtagagtcagacatcctccggaacatctgccagcacttcagcaccaaggacccagccctgaagctgtgccttgtccagagtgtgtgcatggtcagccgcgccatctgcagcagcacccaggctggctccttccacttcacccggaaagcagagctggtggcacagatgatggagttcatcagggcagagcccccggactccttgaggacacctattcggaagaaagccatgctcacctgcacttacttggtctccgtggagccagcgctggacgagcaggcccgggcggatgtgatccatggctgcctgcacagcatcatggccctgctgcctgagcccaaggaggaggacggaggctgccagaagtccctgtatctggagacactgcacgcccttgaggatctgctgacgagcctcctgcagcggaacatgaccccccaaggcctgcagatcatgattgagcacctgagcccatggatcaagtccccaagaggtcacgagcgggcgcgggccctgggcctgagcgccctcctgctgcgctacttcctggagcacctgcgtgtcagcgccctggtgcccttccacaacctgggccttctcatcggcctcttctccccacggtgtgcggacctgtggcctgccacccgccaggaggccgtggactgtgtctactccctgctgtacctccagctcggctatgagggcttctcccgggactaccgcgatgacgtggcggagcggctcctcagcctcaaggacggcctcgtgcaccctgaccccgccattctcttccacacctgccacagtgtaggccagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacaggtacccagctcagactccaggcttaggggtccctctggaatgatgctccccctggaatgatgctccccgagccctccacccggctctgcaccccgactttctgcatgagttcccatggctgtaggccacgtgggacagaaagtgacatggagctaggccccagtctctcaggtacccacggggacctctcctctccaggcgttttgggatcctcactggctccggtgggccctgcacagcacccccacagggaagctgctgtttctgccttcctctaaggtcccaaaactgcctggctgctctgttggccccaggctccagcacacactggaggctgcccctcaccctgtgtcttggttccggctactccaagccttgtcctctgcagggcatccactgctgcctgtgagcagacccctgggaactgcctgatctgagccccctcaggagcccaaggacaaccttgtctgtaccatacatcactatgtcttcccaagctcacacctcccagctcccagcaaagggcagggcgtgtctaccacccaccagcccactggggtcccccttcctcgccgaggcctccggagcatgggtctgctggcccttcctttctttgccatcttagtcatggacagaggctggcccaggggcacctggcttcctgtgacctccgggagactccatgctgggcaaggcagagtgacccttcccctggcaggcgggggcatgaggctgccacggggaacacaggtttccttgcacctggccctttaccctgtcagctttgctgttttcatgtgctctgacgccctcccattaggtgcatccaagctgcaatgcccacttcctcctggcaggggggacccgcaggcaccttctgctcagaggtgcacttgtctggtggccctgctccttcctggtactgttgacctttctgtgtgtttgttttaaatctcttgcatggtaaatagctgcattttgttactgataagagtgagtttaaatccactgtcatatcttttgcgtctttgttacacattttgttttttaaaaatcttctttcttgtccttttttagattgacagtgtccctcttacctcactttctccactcagtttgtaatcctgcagtctgttgcttttcttttagcgtttgccctaaaggtggctgcatgtgtcctcactgaagtccagcatgggccccaaatgcaggctgaggtctgggtctggctgggctgctgggcgcccgagtcatcatgaccattgttcctgggcacagccggcgttgacttgtatttcctccgtgattaccgcctggctcatcaatcactgttttcgttttccgtggaggcgtggctcacacaaagggcaagcacggagtcactgggtcctgcaggactttccaggtcaaggcagaggaggtgtccggtccccagcaggctcctgtgtgcccctcagtcccctagagggtcacggccacctgaccgccaccactagaggttttggcgattgtgctgtgtggtgggtcttcccggcctctgcttagcacagcagtgctgctgcccatccttcctccttgccaggtagtgccgggtgctgctgcccatccttcctctgccgggcagtgccgggtgctgctgcccatcctttctccttgccgggtagtgccgggtgctgctgcccatcctttctccttgccggacagtgctgggtgccgtgtgggctgcactgtgtgtgtgtttctaggtgatggacattcagattgttttttggtttggggctgctggggatggcgatgctttgaatgttcctgggagtgtctgttggtgggtagagcatgcatttctctttcgtgtgtatataggagtggaatcaaggccgggcactgtggctcatacctgtaatcccagcagtgtgggaggctgaggcaggaggattacctgaggtcagaagtttgcgaccagcctggccaacatggcaaaaccccgtctctactgaaaatataaaaattggccaggcatggccaggcgcagtggctcacccctgtaatcccagcactttgggaggctgaggtgggtggatcacgaggtcaggagatcgagaccatcctggctaacatggtaaaaccccgtctctactaaaaatataaaaaattagccaggcgaggtggcaggcgcctgtagtcccagctactcgggaggntgaggcaggagaatggtgtgaacccaggaggcggagcttgcagtgagttgagattgcaccactgcactccagcctgggcgacagagcaagaactctgtctc

SEQ ID NO: 592755 - DNA, 1658 bp, Homo sapiens
  misc_feature (1557)..(1557): n is a, c, g, or t
tgggccctgtgtgtataggcccagatttttctctgtgtcctttattaccagctctgtttacagatccctggcaggcgggggcatgaggctgccacggggaacacaggtttccttgcacctggccctttaccctgtcagctttgctgttttcatgtgctctgacgccctcccattaggtgcatccaagctgcaatgcccacttcctcctggcaggggggacccgcaggcaccttctgctcagaggtgcacttgtctggtggccctgctccttcctggtactgttgacctttctgtgtgtttgttttaaatctcttgcatggtaaatagctgcattttgttactgataagagtgagtttaaatccactgtcatatcttttgcgtctttgttacacattttgttttttaaaaatcttctttcttgtccttttttagattgacagtgtccctcttacctcactttctccactcagtttgtaatcctgcagtctgttgcttttcttttagcgtttgccctaaaggtggctgcatgtgtcctcactgaagtccagcatgggccccaaatgcaggctgaggtctgggtctggctgggctgctgggcgcccgagtcatcatgaccattgttcctgggcacagccggcgttgacttgtatttcctccgtgattaccgcctggctcatcaatcactgttttcgttttccgtggaggcgtggctcacacaaagggcaagcacggagtcactgggtcctgcaggactttccaggtcaaggcagaggaggtgtccggtccccagcaggctcctgtgtgcccctcagtcccctagagggtcacggccacctgaccgccaccactagaggttttggcgattgtgctgtgtggtgggtcttcccggcctctgcttagcacagcagtgctgctgcccatccttcctccttgccaggtagtgccgggtgctgctgcccatccttcctctgccgggcagtgccgggtgctgctgcccatcctttctccttgccgggtagtgccgggtgctgctgcccatcctttctccttgccggacagtgctgggtgccgtgtgggctgcactgtgtgtgtgtttctaggtgatggacattcagattgttttttggtttggggctgctggggatggcgatgctttgaatgttcctgggagtgtctgttggtgggtagagcatgcatttctctttcgtgtgtatataggagtggaatcaaggccgggcactgtggctcatacctgtaatcccagcagtgtgggaggctgaggcaggaggattacctgaggtcagaagtttgcgaccagcctggccaacatggcaaaaccccgtctctactgaaaatataaaaattggccaggcatggccaggcgcagtggctcacccctgtaatcccagcactttgggaggctgaggtgggtggatcacgaggtcaggagatcgagaccatcctggctaacatggtaaaaccccgtctctactaaaaatataaaaaattagccaggcgaggtggcaggcgcctgtagtcccagctactcgggaggntgaggcaggagaatggtgtgaacccaggaggcggagcttgcagtgagttgagattgcaccactgcactccagcctgggcgacagagcaagaactctgtctc

SEQ ID NO: 592756 - DNA, 188 bp, Homo sapiens
cacgaggggacacgagggggcaccctcctgctctgtgggggaccttgcagttggggtttccacctcacctgccttgggctttcccgtcggacatatcgaaggttcacttgcactcaatgtgcctcagggcttcacacatgtttcgtgtgtatagagagaatcacacatgtccattcctgtgtggtccc

SEQ ID NO: 592757 - DNA, 333 bp, Homo sapiens
  misc_feature (97)..(97): n is a, c, g, or t
  misc_feature (99)..(99): n is a, c, g, or t
  misc_feature (102)..(102): n is a, c, g, or t
  misc_feature (104)..(104): n is a, c, g, or t
  misc_feature (106)..(106): n is a, c, g, or t
  misc_feature (126)..(126): n is a, c, g, or t
tcgccactccgggcccctgctgggcgggaaggcggcgccccggccgaggtggcggcggctcctcaggacggaagctcctgctctcttgtcagccgcnanctnangnccattcgcagcttctccagnccacctgcattccttgtctcagagcctccctcctgcatcctccaagccagcagttgtgggatgggagaagaagttgtccatgttcacactgggtgaaggaagctgaaaccacagacatgactgagtcctccatgaagagtgagtgcatggggattgggagtggccgggtgtgaggcctctcttgcctctgggtggtcagtatagata

SEQ ID NO: 592758 - DNA, 5324 bp, Homo sapiens
  misc_feature (97)..(97): n is a, c, g, or t
  misc_feature (99)..(99): n is a, c, g, or t
  misc_feature (102)..(102): n is a, c, g, or t
  misc_feature (104)..(104): n is a, c, g, or t
  misc_feature (106)..(106): n is a, c, g, or t
  misc_feature (126)..(126): n is a, c, g, or t
  misc_feature (4140)..(4140): n is a, c, g, or t
tcgccactccgggcccctgctgggcgggaaggcggcgccccggccgaggtggcggcggctcctcaggacggaagctcctgctctcttgtcagccgcnanctnangnccattcgcagcttctccagnccacctgcattccttgtctcagagcctccctcctgcatcctccaagccagcagttgtgggatgggagaagaagttgtccatgttcacactgggtgaaggaagctgaaaccacagacatgactgagtcctccatgaagaagctggcctccaccctgctggacgccatcaccgataaggaccccctggtgcaggagcaggtctgcagtgccctgtgctccctcggggaggtgcggccggtggagacgctccgtgcctgcgaggagtatctgcggcagcatgacaagctggcacacccataccgagcagcggtcctgagggccatggagagggtcctgagcagtcgcgccagtgagctggacaaggacacagccagcaccatcatcctcctggcctccagcgagatgaccaagacgaaggacctggtctgggactggcagcaggcggcgagtggcgtcctggtggccgtgggaagacagttcatcagcaaggtgatggaggagctgctgcgcaggctgcaccctgggaccctgccacactgcgccgtgctgcacaccctcgccagcctctcggtggccaacgcgttcggcgtagtccccttcctgccatccgtcctgagctccctgctgcccgtgctgggcgtggccaagcaggacacggtgcgcgtggccttctgctccgctctgcagcgcttcagcgagggtgccctggagtacctagccaacctggaccgagccccagaccccacggtcaggaaggacgcctttgccaccgacatcttcagcgcctacgatgttctcttccatcagtggctgcagagtcgagaagccaagctccgtcttgccgtggtggaggctctggggcctatgagccatctgctgcccagtgagaggctggaagagcagctgcccaagctcctccctgggattctcgccctctacaagaagcacgcagagaccttctacttgtccaagagcctgggccagatcctcgaggcagctgtgagtgtgggcagccgcacactggagacccagctggatgccctcttggctgcactgcactcccagatctgtgtgcctgtggagtcctcaagccccctggtgatgagtaaccagaaggaggtgctgcgctgcttcactgtgctggcctgcagctcgcctgaccgcctactggccttcctgctgcccaggctggacaccagcaatgagaggacccgcgtgggcaccctgcaggtggtcagacatgtcatcaactcagctgctgctcagatggaagataaaaagccctttatcctgtcttccatgaggcttcctctcctggacaccaacagcaaggtgaagcgggcagtggtgcaggtgattagcgccatggcccaccacggctacctggagcagcctggaggtgaggcgatgatcgagtacatcgtgcagcagtgcgcgctgccccccgagcaggagcctgagaagccaggccccggcagcaaggaccccaaggccgacagcgtgcgggccatcagcgtgcgcaccctctacctggtcagcaccaccgtggacaggatgagtcacgtcctctggccatacctgctccagttcctcacccctgtgcgcttcactggggccctgactccgctctgcaggagcctcgtgcatctggcgcagaagaggcaggaggccggggccgacgccttcctcatccagtacgacgcccatgcgagcctcccgtctccctatgctgtaaccggaagactgttggttgtgtcttccagcccctacctaggggacggacgtggggcagcggcgctgcgcctcctcagtgttctgcacccaaacattcaccctttgctgggtcagcattgggaaacgactgtcccgctgctgctggggtacctggatgagcacacagaagagaccctgccacaggaggagtgggaggagaagctgttgatgttcctgcgagacaccctggccatcatttctgacaacgcgtggatctgccagctgagcctggagctgtgcaggcagctgccctgctacgatgaggcaccccaggagaagaacttcctgtacaaatgcataggcaccaccctgggtgctgcttcaagtaaggaggtggtgaggaagcaccttcaagagctgctggagacggccagataccaggaggaggcagaacgcgagggcctcgcctgctgcttcgggatctgtgccatctcccacctcgaggacacgctggcccagctggaggacttcgtgaggtcagaggtcttcagaaaatccattggcattctcaacatttttaaggatcgaagtgagaacgaagtggagaaggtgaagagtgctctgatcctgtgctatgggcacgtggcggcccgggccccccgggagctggtgctggccaaggtagagtcagacatcctccggaacatctgccagcacttcagcaccaaggacccagccctgaagctgtgccttgtccagagtgtgtgcatggtcagccgcgccatctgcagcagcacccaggctggctccttccacttcacccggaaagcagagctggtggcacagatgatggagttcatcagggcagagcccccggactccttgaggacacctattcggaagaaagccatgctcacctgcacttacttggtctccgtggagccagcgctggacgagcaggcccgggcggatgtgatccatggctgcctgcacagcatcatggccctgctgcctgagcccaaggaggaggacggaggctgccagaagtccctgtatctggagacactgcacgcccttgaggatctgctgacgagcctcctgcagcggaacatgaccccccaaggcctgcagatcatgattgagcacctgagcccatggatcaagtccccaagaggtcacgagcgggcgcgggccctgggcctgagcgccctcctgctgcgctacttcctggagcacctgcgtgtcagcgccctggtgcccttccacaacctgggccttctcatcggcctcttctccccacggtgtgcggacctgtggcctgccacccgccaggaggccgtggactgtgtctactccctgctgtacctccagctcggctatgagggcttctcccgggactaccgcgatgacgtggcggagcggctcctcagcctcaaggacggcctcgtgcaccctgaccccgccattctcttccacacctgccacagtgtaggccagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgtcaggactcggggggcatgaggagggggccacaggttggcaggncatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccactgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccgggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctcccagcga

SEQ ID NO: 592759 - DNA, 252 bp, Homo sapiens
gatgctgactcatactagacagctgtgcacagtaagcgcgttactcataccagctgctactcctgacggtgctcgatcaggctgtctgtacatgtccctgcacaagcccaaatagtgtactacaagatgttatactttttgtaataactctatctcaactactgcgctctccgatttaaattcttttatgggcaagtctggaatagcctcggtcttttacaacaattgcagcttctcgagatacacctatac

SEQ ID NO: 592760 - DNA, 428 bp, Homo sapiens
  misc_feature (264)..(264): n is a, c, g, or t
  misc_feature (325)..(326): n is a, c, g, or t
  misc_feature (354)..(354): n is a, c, g, or t
  misc_feature (380)..(380): n is a, c, g, or t
  misc_feature (399)..(399): n is a, c, g, or t
  misc_feature (404)..(404): n is a, c, g, or t
  misc_feature (409)..(409): n is a, c, g, or t
  misc_feature (411)..(411): n is a, c, g, or t
  misc_feature (422)..(422): n is a, c, g, or t
ttctacgtgcctctccctctgccttctctcacagtgcccccggctccagagctcaggggtaggggttctcctgagggtgcaggggatccttctcatctcctggaccctccagggcactctggtccctattccccagctcctaggcagctgagccggtgtcccttagggaaaggtgaccaggaagctttggtgcagggagctcttggttggggacaaagggcttggacccctgcacagtgttctgtggacaatggttaatatgcnccgggaagaggggggtgacagggcccacagggtatggcccccaatttcccacctctgtttnnattcttgtaaactgcaacctatttaaantaacctttagccattccctattgtanacaaaattaatttttcagnaattnaattntntttacatagtntaaata

SEQ ID NO: 592761 - DNA, 5087 bp, Homo sapiens
  misc_feature (3903)..(3903): n is a, c, g, or t
ccaagactttcacgaagctcccaatccttcctactattgtttctcctccaaacgaccttgtcacgctttccttcaaatgtcctgcgtggctgtcttcactgagccggtagcacttctcctatgtgggcccacctccacctgccgtggcggccatagctgtcagagtggatgagctggcacacccataccgagcagcggtcctgagggccatggagagggtcctgagcagtcgcgccagtgagctggacaaggacacagccagcaccatcatcctcctggcctccagcgagatgaccaagacgaaggacctggtctgggactggcagcaggcggcgagtggcgtcctggtggccgtgggaagacagttcatcagcaaggtgatggaggagctgctgcgcaggctgcaccctgggaccctgccacactgcgccgtgctgcacaccctcgccagcctctcggtggccaacgcgttcggcgtagtccccttcctgccatccgtcctgagctccctgctgcccgtgctgggcgtggccaagcaggacacggtgcgcgtggccttctgctccgctctgcagcgcttcagcgagggtgccctggagtacctagccaacctggaccgagccccagaccccacggtcaggaaggacgcctttgccaccgacatcttcagcgcctacgatgttctcttccatcagtggctgcagagtcgagaagccaagctccgtcttgccgtggtggaggctctggggcctatgagccatctgctgcccagtgagaggctggaagagcagctgcccaagctcctccctgggattctcgccctctacaagaagcacgcagagaccttctacttgtccaagagcctgggccagatcctcgaggcagctgtgagtgtgggcagccgcacactggagacccagctggatgccctcttggctgcactgcactcccagatctgtgtgcctgtggagtcctcaagccccctggtgatgagtaaccagaaggaggtgctgcgctgcttcactgtgctggcctgcagctcgcctgaccgcctactggccttcctgctgcccaggctggacaccagcaatgagaggacccgcgtgggcaccctgcaggtggtcagacatgtcatcaactcagctgctgctcagatggaagataaaaagccctttatcctgtcttccatgaggcttcctctcctggacaccaacagcaaggtgaagcgggcagtggtgcaggtgattagcgccatggcccaccacggctacctggagcagcctggaggtgaggcgatgatcgagtacatcgtgcagcagtgcgcgctgccccccgagcaggagcctgagaagccaggccccggcagcaaggaccccaaggccgacagcgtgcgggccatcagcgtgcgcaccctctacctggtcagcaccaccgtggacaggatgagtcacgtcctctggccatacctgctccagttcctcacccctgtgcgcttcactggggccctgactccgctctgcaggagcctcgtgcatctggcgcagaagaggcaggaggccggggccgacgccttcctcatccagtacgacgcccatgcgagcctcccgtctccctatgctgtaaccggaagactgttggttgtgtcttccagcccctacctaggggacggacgtggggcagcggcgctgcgcctcctcagtgttctgcacccaaacattcaccctttgctgggtcagcattgggaaacgactgtcccgctgctgctggggtacctggatgagcacacagaagagaccctgccacaggaggagtgggaggagaagctgttgatgttcctgcgagacaccctggccatcatttctgacaacgcgtggatctgccagctgagcctggagctgtgcaggcagctgccctgctacgatgaggcaccccaggagaagaacttcctgtacaaatgcataggcaccaccctgggtgctgcttcaagtaaggaggtggtgaggaagcaccttcaagagctgctggagacggccagataccaggaggaggcagaacgcgagggcctcgcctgctgcttcgggatctgtgccatctcccacctcgaggacacgctggcccagctggaggacttcgtgaggtcagaggtcttcagaaaatccattggcattctcaacatttttaaggatcgaagtgagaacgaagtggagaaggtgaagagtgctctgatcctgtgctatgggcacgtggcggcccgggccccccgggagctggtgctggccaaggtagagtcagacatcctccggaacatctgccagcacttcagcaccaaggacccagccctgaagctgtgccttgtccagagtgtgtgcatggtcagccgcgccatctgcagcagcacccaggctggctccttccacttcacccggaaagcagagctggtggcacagatgatggagttcatcagggcagagcccccggactccttgaggacacctattcggaagaaagccatgctcacctgcacttacttggtctccgtggagccagcgctggacgagcaggcccgggcggatgtgatccatggctgcctgcacagcatcatggccctgctgcctgagcccaaggaggaggacggaggctgccagaagtccctgtatctggagacactgcacgcccttgaggatctgctgacgagcctcctgcagcggaacatgaccccccaaggcctgcagatcatgattgagcacctgagcccatggatcaagtccccaagaggtcacgagcgggcgcgggccctgggcctgagcgccctcctgctgcgctacttcctggagcacctgcgtgtcagcgccctggtgcccttccacaacctgggccttctcatcggcctcttctccccacggtgtgcggacctgtggcctgccacccgccaggaggccgtggactgtgtctactccctgctgtacctccagctcggctatgagggcttctcccgggactaccgcgatgacgtggcggagcggctcctcagcctcaaggacggcctcgtgcaccctgaccccgccattctcttccacacctgccacagtgtaggccagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgtcaggactcggggggcatgaggagggggccacaggttggcaggncatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccactgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccgggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctcccagcga

SEQ ID NO: 592762 - DNA, 2847 bp, Homo sapiens
ttatagttattcttttccttatgaaaaacaaaaaggggactgggcgtggtggctaacacctgtaatcccagcacttggggaggctgaggcgggcagatcacaaggtcaggagttcgagaccagactggccaaaaggatgaaaccccatcactctactaaaaatacaaaaaattagccaggtgcggtggggcgcaccagtaatcccaactactagggaggctgaggtaggagaatagcttgaacccgggaggcggaggttgcagtgagccaagatcgagccacggcactctagcccaggtgacagtgtgagactctgtctcagaaaaaaaaaagaaaaacgggatcgagatggtttgcaggattagcaagtgatagagatatattgaagacatagaaagccagtgtggttgctcacacctataatcccagcactgtgggaggccaaggcaggaggatcacttgagtcaatgagttagagaccaacctgggcagcaaagtgagaccccatctctacaaaaaaattttttaaaaatcagccaggtacggtggtgcacacctgtaatcccagctactaaggaggctgaggtaggagaatctcttgaacccgggaggcagaggttgcagtgagccaagatcgagccacggcactctagcccaggtgacagtgtgagactccatctcagaacaaaaagaataacaggatagggatggtttgcaggattatcaagtgatacagatgtactgaagacacagaaagccagtgtggttgctcacatctataatcccaacactttgggaggccagggcaggaggatcacttgagttgacgagttagagaccaacctgggcaacaaagtgagacccccacctctacaaaacattaaaaaaaaatgagctgcacatgttggcacgcacttgtaatcccagctacttgggaggctgaggtgagaggatcacttgagcacaggaggttacagtgagctatgatcacgccactcgacaccagcctgaatgacagagcggagaccctgtctcaaaaaagtggggggaaataaaaggatatagtgcactggattgaaactttctcctgtcgttatcataagcagaagaattgaagtaactaaaaagagaatcatagtctcaatgtgtgcttgaatgttatttaacatcacgtctctgctacctcatcattaaccagctgtggtaatgattccacactttgaacccatcccacctgttgacagaagcgattgcatgccagcatcatctcagtgacggctcatcatgtaggcccagaatactgattttgtgacttctaagcttgtgctccattcccaacacaaagtcttctgaccagcctttgagtaccattattgtagaggaagctcatcttaggtaactattactagagcagaaatcacttaatataaaatatttcatgtatcaaatttaaaactcacttttgggttcattgatgtagtaactcaaccaggaaacttaaatggaattagtgttttcactgacaataatgatgctgctttttcattataggcccataagatggcctggcctttccttgaaccagtagaccctaatgatgcaccagattattatggtgttattaaggaacctatggaccttgccaccatggaagaaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcaggtctcataacaacaaactgcagtctacagcttcttaaagttcagcgtgttaacctaacataaaacacagcaagaatctggttgtctgaactattttaaattaaggagccagatgtttttagtcaggctatcctgacaagacttgacctaaacttcgtttttattggtcataacagtccaattatattcttggccaattttgtccaacggacaagaaaaaagcaaagtcaacgacaccattatcttgtcaagatcagatggttttactattgtggcagaagcgagaaaactttgtttattgaaaaaaaaagaaaaagaaagcaagaaaaaaagatactatggggtcaagtgtaactccatggaaatgccacgtctgctcttcagtgaagaagctggtttagagtctcacagaaaacttttgactgtatttatttattgttgcaaaaaagacgcttttttattgctgccctcatttgtcagctaagtattttttcttataaaatccagccccggttacatataatcatctgtatcttatcatgattcctgtaggtaaaagtacaagacgacctctagatgtcttttctttctatgaaaggagctgctatgtacacatgtgcacacacacacaactgggaatcaacaatgagtttattgttcatggtagattaaaattaagcttgcataaaggttgggctaagtggtcctggactacagactctgttgccttgaatataacagtacaatttgtcaattactctgcaccaggctaaagtgagtaaaatctatttgaaggtatcttgtttgtaaacatttgtcagattctaatttttttcttttgtattaaaattcaactatggatgtatatgaaacaaaataaatggagataatttttctcccacaaacaaaaaaattacacattgtttataactgtctctcgtctctctcatgttatactcgcttatcttcattcatatctatctctatcgatttactctcttgttatattccccttgacctactct

SEQ ID NO: 592763 - DNA, 161 bp, Homo sapiens
tagaactgtgaggaaaggtataccggctaatgctagagactgcaatggtgagggaggttgaagtgagaggtatggttaacgagtagtcctacctattttatcgaatatctatgtccattgtataaggttagtggatcatggacccgagagcacataaatag

SEQ ID NO: 592764 - DNA, 157 bp, Homo sapiens
cctgtgaccctctctcaggatgaggcaagaagcccaagccaaggctgataaaattaagctggcgctggaaaaacagaaggaggccccagttaaaacgcacggtcctacgtggtgtcgcgtaagtacattatactgagatttctacagctgggggtct

SEQ ID NO: 592765 - DNA, 5377 bp, Homo sapiens
  misc_feature (97)..(97): n is a, c, g, or t
  misc_feature (99)..(99): n is a, c, g, or t
  misc_feature (102)..(102): n is a, c, g, or t
  misc_feature (104)..(104): n is a, c, g, or t
  misc_feature (106)..(106): n is a, c, g, or t
  misc_feature (126)..(126): n is a, c, g, or t
  misc_feature (4193)..(4193): n is a, c, g, or t
tcgccactccgggcccctgctgggcgggaaggcggcgccccggccgaggtggcggcggctcctcaggacggaagctcctgctctcttgtcagccgcnanctnangnccattcgcagcttctccagnccacctgcattccttgtctcagagcctccctcctgcatcctccaagccagcagttgtgggatgggagaagaagttgtccatgttcacactgggtgaaggaagctgaaaccacagacatgactgagtcctccatgaagaagctggcctccaccctgctggacgccatcaccgataaggaccccctggtgcaggagcaggtctgcagtgccctgtgctccctcggggaggtgcggccggtggagacgctccgtgcctgcgaggagtatctgcggcagcatgacaagctggcacacccataccgagcagcggtcctgagggccatggagagggtcctgagcagtcgcgccagtgagctggacaaggacacagccagcaccatcatcctcctggcctccagcgagatgaccaagacgaaggacctggtctgggactggcagcaggcggcgagtggcgtcctggtggccgtgggaagacagttcatcagcaaggtgatggaggagctgctgcgcaggctgcaccctgggaccctgccacactgcgccgtgctgcacaccctcgccagcctctcggtggccaacgcgttcggcgtagtccccttcctgccatccgtcctgagctccctgctgcccgtgctgggcgtggccaagcaggacacggtgcgcgtggccttctgctccgctctgcagcgcttcagcgagggtgccctggagtacctagccaacctggaccgagccccagaccccacggtcaggaaggacgcctttgccaccgacatcttcagcgcctacgatgttctcttccatcagtggctgcagagtcgagaagccaagctccgtcttgccgtggtggaggctctggggcctatgagccatctgctgcccagtgagaggctggaagagcagctgcccaagctcctccctgggattctcgccctctacaagaagcacgcagagaccttctacttgtccaagagcctgggccagatcctcgaggcagctgtgagtgtgggcagccgcacactggagacccagctggatgccctcttggctgcactgcactcccagatctgtgtgcctgtggagtcctcaagccccctggtgatgagtaaccagaaggaggtgctgcgctgcttcactgtgctggcctgcagctcgcctgaccgcctactggccttcctgctgcccaggctggacaccagcaatgagaggacccgcgtgggcaccctgcaggtggtcagacatgtcatcaactcagctgctgctcagatggaagataaaaagccctttatcctgtcttccatgaggcttcctctcctggacaccaacagcaaggtgaagcgggcagtggtgcaggtgattagcgccatggcccaccacggctacctggagcagcctggaggtgaggcgatgatcgagtacatcgtgcagcagtgcgcgctgccccccgagcaggagcctgagaagccaggccccggcagcaaggaccccaaggccgacagcgtgcgggccatcagcgtgcgcaccctctacctggtcagcaccaccgtggacaggatgagtcacgtcctctggccatacctgctccagttcctcacccctgtgcgcttcactggggccctgactccgctctgcaggagcctcgtgcatctggcgcagaagaggcaggaggccggggccgacgccttcctcatccagtacgacgcccatgcgagcctcccgtctccctatgctgtaaccggaagactgttggttgtgtcttccagcccctacctaggggacggacgtggggcagcggcgctgcgcctcctcagtgttctgcacccaaacattcaccctttgctgggtcagcattgggaaacgactgtcccgctgctgctggggtacctggatgagcacacagaagagaccctgccacaggaggagtgggaggagaagctgttgatgttcctgcgagacaccctggccatcatttctgacaacgcgtggatctgccagctgagcctggagctgtgcaggcagctgccctgctacgatgaggcaccccaggagaagaacttcctgtacaaatgcataggcaccaccctgggtgctgcttcaagtaaggaggtggtgaggaagcaccttcaagagctgctggagacggccagataccaggaggaggcagaacgcgagggcctcgcctgctgcttcgggatctgtgccatctcccacctcgaggacacgctggcccagctggaggacttcgtgaggtcagaggtcttcagaaaatccattggcattctcaacatttttaaggatcgaagtgagaacgaagtggagaaggtgaagagtgctctgatcctgtgctatgggcacgtggcggcccgggccccccgggagctggtgctggccaaggtagagtcagacatcctccggaacatctgccagcacttcagcaccaaggacccagccctgaagctgtgccttgtccagagtgtgtgcatggtcagccgcgccatctgcagcagcacccaggctggctccttccacttcacccggaaagcagagctggtggcacagatgatggagttcatcagggcagagcccccggactccttgaggacacctattcggaagaaagccatgctcacctgcacttacttggtctccgtggagccagcgctggacgagcaggcccgggcggatgtgatccatggctgcctgcacagcatcatggccctgctgcctgagcccaaggaggaggacggaggctgccagaagtccctgtatctggagacactgcacgcccttgaggatctgctgacgagcctcctgcagcggaacatgaccccccaaggcctgcagatcatgattgagcacctgagcccatggatcaagtccccaagaggtcacgagcgggcgcgggccctgggcctgagcgccctcctgctgcgctacttcctggagcacctgcgtgtcagtggcgcccaagtagataccaggtttccatctgagcccaggatcctgtgcaatgcgccctggtgcccttccacaacctgggccttctcatcggcctcttctccccacggtgtgcggacctgtggcctgccacccgccaggaggccgtggactgtgtctactccctgctgtacctccagctcggctatgagggcttctcccgggactaccgcgatgacgtggcggagcggctcctcagcctcaaggacggcctcgtgcaccctgaccccgccattctcttccacacctgccacagtgtaggccagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgtcaggactcggggggcatgaggagggggccacaggttggcaggncatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccactgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccgggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctcccagcga

SEQ ID NO: 592766 - DNA, 1167 bp, Homo sapiens
gttcttttctattcgcttgccaagggtgaatgaaagaacatggctgcttctcccagactgactgaccttggcatccgcataaagcatcattgttttcaaaaatgaagggtgcttaattgttcccttttttctatattctgtaggtctcataacaacaaactgcagtctacagcttcttaaagttcagcgtgttaacctaacataaaacacagcaagaatctggttgtctgaactattttaaattaaggagccagatgtttttagtcaggctatcctgacaagacttgacctaaacttcgtttttattggtcataacagtccaattatattcttggccaattttgtccaacggacaagaaaaaagcaaagtcaacgacaccattatcttgtcaagatcagatggttttactattgtggcagaagcgagaaaactttgtttattgaaaaaaaaagaaaaagaaagcaagaaaaaaagatactatggggtcaagtgtaactccatggaaatgccacgtctgctcttcagtgaagaagctggtttagagtctcacagaaaacttttgactgtatttatttattgttgcaaaaaagacgcttttttattgctgccctcatttgtcagctaagtattttttcttataaaatccagccccggttacatataatcatctgtatcttatcatgattcctgtaggtaaaagtacaagacgacctctagatgtcttttctttctatgaaaggagctgctatgtacacatgtgcacacacacacaactgggaatcaacaatgagtttattgttcatggtagattaaaattaagcttgcataaaggttgggctaagtggtcctggactacagactctgttgccttgaatataacagtacaatttgtcaattactctgcaccaggctaaagtgagtaaaatctatttgaaggtatcttgtttgtaaacatttgtcagattctaatttttttcttttgtattaaaattcaactatggatgtatatgaaacaaaataaatggagataatttttctcccacaaacaaaaaaattacacattgtttataactgtctctcgtctctctcatgttatactcgcttatcttcattcatatctatctctatcgatttactctcttgttatattccccttgacctactct

SEQ ID NO: 592767 - DNA, 198 bp, Homo sapiens
  misc_feature (126)..(126): n is a, c, g, or t
agatccatcctgctctttcaggctggctgactcctgaccagcctcaaccgcctgggtcccgccgccggccggaccccggccctcggtctctagccccgggctgggaccctgcgccgggctcctacncgcgcggctcccagctccggcgcccagcccagccggactccttaaaggcgcagcgtgccggttcgcgtcctc

SEQ ID NO: 592768 - DNA, 3454 bp, Homo sapiens
  misc_feature (2270)..(2270): n is a, c, g, or t
gtcgggggcaacctctcaccctgcctggtgagccaactgtggcatggctgtcccctgagggttggctctgccgcccccggcctccgctggaaggcggtctgcagcccctgcagccacagcacatggggatgtgcccaggctccagccagccctgtgaggggtcgggctcccagcccctcagtggcatcttggcctgcagttcctgcgagacaccctggccatcatttctgacaacgcgtggatctgccagctgagcctggagctgtgcaggcagctgccctgctacgatgaggcaccccaggagaagaacttcctgtacaaatgcataggcaccaccctgggtgctgcttcaagtaaggaggtggtgaggaagcaccttcaagagctgctggagacggccagataccaggaggaggcagaacgcgagggcctcgcctgctgcttcgggatctgtgccatctcccacctcgaggacacgctggcccagctggaggacttcgtgaggtcagaggtcttcagaaaatccattggcattctcaacatttttaaggatcgaagtgagaacgaagtggagaaggtgaagagtgctctgatcctgtgctatgggcacgtggcggcccgggccccccgggagctggtgctggccaaggtagagtcagacatcctccggaacatctgccagcacttcagcaccaaggacccagccctgaagctgtgccttgtccagagtgtgtgcatggtcagccgcgccatctgcagcagcacccaggctggctccttccacttcacccggaaagcagagctggtggcacagatgatggagttcatcagggcagagcccccggactccttgaggacacctattcggaagaaagccatgctcacctgcacttacttggtctccgtggagccagcgctggacgagcaggcccgggcggatgtgatccatggctgcctgcacagcatcatggccctgctgcctgagcccaaggaggaggacggaggctgccagaagtccctgtatctggagacactgcacgcccttgaggatctgctgacgagcctcctgcagcggaacatgaccccccaaggcctgcagatcatgattgagcacctgagcccatggatcaagtccccaagaggtcacgagcgggcgcgggccctgggcctgagcgccctcctgctgcgctacttcctggagcacctgcgtgtcagcgccctggtgcccttccacaacctgggccttctcatcggcctcttctccccacggtgtgcggacctgtggcctgccacccgccaggaggccgtggactgtgtctactccctgctgtacctccagctcggctatgagggcttctcccgggactaccgcgatgacgtggcggagcggctcctcagcctcaaggacggcctcgtgcaccctgaccccgccattctcttccacacctgccacagtgtaggccagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgtcaggactcggggggcatgaggagggggccacaggttggcaggncatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccactgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccgggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctcccagcga

SEQ ID NO: 592769 - DNA, 436 bp, Homo sapiens
ctccagggtgaaccagcctggctccaggactgcttgcacagtaaacatatatacttgttagaacttcggagaatattcacattggaaaaaccttaaagctctgaaaatgttttacattttgtgtttttaagaccttgccaccatggaagaaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcaggtgagcagatgggttcggtattctgaattaattcaactcttcacactctttatactattctgtctaacgattcaaccagtgcagtttatggtaaatttaaccttaaatatctttaaaa

SEQ ID NO: 592770 - DNA, 2049 bp, Homo sapiens
  misc_feature (865)..(865): n is a, c, g, or t
tgaaacctggcgttgggggtgccccccttccctcaagctctggcatcgccttcctcctagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgtcaggactcggggggcatgaggagggggccacaggttggcaggncatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccactgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccgggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctcccagcga

SEQ ID NO: 592771 - DNA, 2153 bp, Homo sapiens
  misc_feature (1902)..(1902): n is a, c, g, or t
ttatagttattcttttccttatgaaaaacaaaaaggggactgggcgtggtggctaacacctgtaatcccagcacttggggaggctgaggcgggcagatcacaaggtcaggagttcgagaccagactggccaaaaggatgaaaccccatcactctactaaaaatacaaaaaattagccaggtgcggtggggcgcaccagtaatcccaactactagggaggctgaggtaggagaatagcttgaacccgggaggcggaggttgcagtgagccaagatcgagccacggcactctagcccaggtgacagtgtgagactctgtctcagaaaaaaaaaagaaaaacgggatcgagatggtttgcaggattagcaagtgatagagatatattgaagacatagaaagccagtgtggttgctcacacctataatcccagcactgtgggaggccaaggcaggaggatcacttgagtcaatgagttagagaccaacctgggcagcaaagtgagaccccatctctacaaaaaaattttttaaaaatcagccaggtacggtggtgcacacctgtaatcccagctactaaggaggctgaggtaggagaatctcttgaacccgggaggcagaggttgcagtgagccaagatcgagccacggcactctagcccaggtgacagtgtgagactccatctcagaacaaaaagaataacaggatagggatggtttgcaggattatcaagtgatacagatgtactgaagacacagaaagccagtgtggttgctcacatctataatcccaacactttgggaggccagggcaggaggatcacttgagttgacgagttagagaccaacctgggcaacaaagtgagacccccacctctacaaaacattaaaaaaaaatgagctgcacatgttggcacgcacttgtaatcccagctacttgggaggctgaggtgagaggatcacttgagcacaggaggttacagtgagctatgatcacgccactcgacaccagcctgaatgacagagcggagaccctgtctcaaaaaagtggggggaaataaaaggatatagtgcactggattgaaactttctcctgtcgttatcataagcagaagaattgaagtaactaaaaagagaatcatagtctcaatgtgtgcttgaatgttatttaacatcacgtctctgctacctcatcattaaccagctgtggtaatgattccacactttgaacccatcccacctgttgacagaagcgattgcatgccagcatcatctcagtgacggctcatcatgtaggcccagaatactgattttgtgacttctaagcttgtgctccattcccaacacaaagtcttctgaccagcctttgagtaccattattgtagaggaagctcatcttaggtaactattactagagcagaaatcacttaatataaaatatttcatgtatcaaatttaaaactcacttttgggttcattgatgtagtaactcaaccaggaaacttaaatggaattagtgttttcactgacaataatgatgctgctttttcattataggcccataagatggcctggcctttccttgaaccagtagaccctaatgatgcaccagattattatggtgttattaaggaacctatggaccttgccaccatggaagaaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcagattgtgatatctttagtctgaatttttaactggaatcagaactggatgttggggtcactctttgttttattgtacctcngtgattacctaattcaaaattgccccccaaaaagtcagattagttaatataattttttaatgttaaagatgtatcgtggtaaaaaatttactctagcagccatgttgaacaatgtatttaaaaattgtaaactcttggaatactgtatttatctgctatttcaatataaagtcctttgactttagtcctggtaactgtacagtaatttggtttactaatgaaagttgtgaataaaactggtgaaacctaga

SEQ ID NO: 592772 - DNA, 387 bp, Homo sapiens
cgtgtagatgctaaaggaatacgtagctgatagctacaggaatcgtgctggtgcttctcatcttctatccatttatgacggtagttctcatggatttctgagacagaatgtcacagacaaaagccaataggttgtccaaaagttcatacctgttctgccggaagatatgtctggaggatggtcctcttctcctgggtctccttctccacttcagtgctgcaactgccacgggatcccaatgccgcagcttccttggccttgaattctttctccctctgcaggcggtactgttcaatttcagcctgagcttcttctttggcctgcttcagcctccggttctttcttttgcgggcctcggacaccttctcggctgcccgcttctcggcc

SEQ ID NO: 592773 - DNA, 5542 bp, Homo sapiens
  misc_feature (97)..(97): n is a, c, g, or t
  misc_feature (99)..(99): n is a, c, g, or t
  misc_feature (102)..(102): n is a, c, g, or t
  misc_feature (104)..(104): n is a, c, g, or t
  misc_feature (106)..(106): n is a, c, g, or t
  misc_feature (126)..(126): n is a, c, g, or t
  misc_feature (4140)..(4140): n is a, c, g, or t
tcgccactccgggcccctgctgggcgggaaggcggcgccccggccgaggtggcggcggctcctcaggacggaagctcctgctctcttgtcagccgcnanctnangnccattcgcagcttctccagnccacctgcattccttgtctcagagcctccctcctgcatcctccaagccagcagttgtgggatgggagaagaagttgtccatgttcacactgggtgaaggaagctgaaaccacagacatgactgagtcctccatgaagaagctggcctccaccctgctggacgccatcaccgataaggaccccctggtgcaggagcaggtctgcagtgccctgtgctccctcggggaggtgcggccggtggagacgctccgtgcctgcgaggagtatctgcggcagcatgacaagctggcacacccataccgagcagcggtcctgagggccatggagagggtcctgagcagtcgcgccagtgagctggacaaggacacagccagcaccatcatcctcctggcctccagcgagatgaccaagacgaaggacctggtctgggactggcagcaggcggcgagtggcgtcctggtggccgtgggaagacagttcatcagcaaggtgatggaggagctgctgcgcaggctgcaccctgggaccctgccacactgcgccgtgctgcacaccctcgccagcctctcggtggccaacgcgttcggcgtagtccccttcctgccatccgtcctgagctccctgctgcccgtgctgggcgtggccaagcaggacacggtgcgcgtggccttctgctccgctctgcagcgcttcagcgagggtgccctggagtacctagccaacctggaccgagccccagaccccacggtcaggaaggacgcctttgccaccgacatcttcagcgcctacgatgttctcttccatcagtggctgcagagtcgagaagccaagctccgtcttgccgtggtggaggctctggggcctatgagccatctgctgcccagtgagaggctggaagagcagctgcccaagctcctccctgggattctcgccctctacaagaagcacgcagagaccttctacttgtccaagagcctgggccagatcctcgaggcagctgtgagtgtgggcagccgcacactggagacccagctggatgccctcttggctgcactgcactcccagatctgtgtgcctgtggagtcctcaagccccctggtgatgagtaaccagaaggaggtgctgcgctgcttcactgtgctggcctgcagctcgcctgaccgcctactggccttcctgctgcccaggctggacaccagcaatgagaggacccgcgtgggcaccctgcaggtggtcagacatgtcatcaactcagctgctgctcagatggaagataaaaagccctttatcctgtcttccatgaggcttcctctcctggacaccaacagcaaggtgaagcgggcagtggtgcaggtgattagcgccatggcccaccacggctacctggagcagcctggaggtgaggcgatgatcgagtacatcgtgcagcagtgcgcgctgccccccgagcaggagcctgagaagccaggccccggcagcaaggaccccaaggccgacagcgtgcgggccatcagcgtgcgcaccctctacctggtcagcaccaccgtggacaggatgagtcacgtcctctggccatacctgctccagttcctcacccctgtgcgcttcactggggccctgactccgctctgcaggagcctcgtgcatctggcgcagaagaggcaggaggccggggccgacgccttcctcatccagtacgacgcccatgcgagcctcccgtctccctatgctgtaaccggaagactgttggttgtgtcttccagcccctacctaggggacggacgtggggcagcggcgctgcgcctcctcagtgttctgcacccaaacattcaccctttgctgggtcagcattgggaaacgactgtcccgctgctgctggggtacctggatgagcacacagaagagaccctgccacaggaggagtgggaggagaagctgttgatgttcctgcgagacaccctggccatcatttctgacaacgcgtggatctgccagctgagcctggagctgtgcaggcagctgccctgctacgatgaggcaccccaggagaagaacttcctgtacaaatgcataggcaccaccctgggtgctgcttcaagtaaggaggtggtgaggaagcaccttcaagagctgctggagacggccagataccaggaggaggcagaacgcgagggcctcgcctgctgcttcgggatctgtgccatctcccacctcgaggacacgctggcccagctggaggacttcgtgaggtcagaggtcttcagaaaatccattggcattctcaacatttttaaggatcgaagtgagaacgaagtggagaaggtgaagagtgctctgatcctgtgctatgggcacgtggcggcccgggccccccgggagctggtgctggccaaggtagagtcagacatcctccggaacatctgccagcacttcagcaccaaggacccagccctgaagctgtgccttgtccagagtgtgtgcatggtcagccgcgccatctgcagcagcacccaggctggctccttccacttcacccggaaagcagagctggtggcacagatgatggagttcatcagggcagagcccccggactccttgaggacacctattcggaagaaagccatgctcacctgcacttacttggtctccgtggagccagcgctggacgagcaggcccgggcggatgtgatccatggctgcctgcacagcatcatggccctgctgcctgagcccaaggaggaggacggaggctgccagaagtccctgtatctggagacactgcacgcccttgaggatctgctgacgagcctcctgcagcggaacatgaccccccaaggcctgcagatcatgattgagcacctgagcccatggatcaagtccccaagaggtcacgagcgggcgcgggccctgggcctgagcgccctcctgctgcgctacttcctggagcacctgcgtgtcagcgccctggtgcccttccacaacctgggccttctcatcggcctcttctccccacggtgtgcggacctgtggcctgccacccgccaggaggccgtggactgtgtctactccctgctgtacctccagctcggctatgagggcttctcccgggactaccgcgatgacgtggcggagcggctcctcagcctcaaggacggcctcgtgcaccctgaccccgccattctcttccacacctgccacagtgtaggccagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgtcaggactcggggggcatgaggagggggccacaggttggcaggncatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccactgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccgggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctcccagcgagtgactgacagggtgcgatgccgagcctcttaggggatgggccagagggtgccctggactggctgtgttgtccccactgtttttgcaaaattgagtgaggggaaggctcggcgctgtggtgtgggcggctttgttggcaacccctactcaagaaggtgggagcaccagctagcacagggtaaagtactcttagttcagcacaactcttctcatagcat

SEQ ID NO: 592774 - DNA, 1941 bp, Homo sapiens
ttatagttattcttttccttatgaaaaacaaaaaggggactgggcgtggtggctaacacctgtaatcccagcacttggggaggctgaggcgggcagatcacaaggtcaggagttcgagaccagactggccaaaaggatgaaaccccatcactctactaaaaatacaaaaaattagccaggtgcggtggggcgcaccagtaatcccaactactagggaggctgaggtaggagaatagcttgaacccgggaggcggaggttgcagtgagccaagatcgagccacggcactctagcccaggtgacagtgtgagactctgtctcagaaaaaaaaaagaaaaacgggatcgagatggtttgcaggattagcaagtgatagagatatattgaagacatagaaagccagtgtggttgctcacacctataatcccagcactgtgggaggccaaggcaggaggatcacttgagtcaatgagttagagaccaacctgggcagcaaagtgagaccccatctctacaaaaaaattttttaaaaatcagccaggtacggtggtgcacacctgtaatcccagctactaaggaggctgaggtaggagaatctcttgaacccgggaggcagaggttgcagtgagccaagatcgagccacggcactctagcccaggtgacagtgtgagactccatctcagaacaaaaagaataacaggatagggatggtttgcaggattatcaagtgatacagatgtactgaagacacagaaagccagtgtggttgctcacatctataatcccaacactttgggaggccagggcaggaggatcacttgagttgacgagttagagaccaacctgggcaacaaagtgagacccccacctctacaaaacattaaaaaaaaatgagctgcacatgttggcacgcacttgtaatcccagctacttgggaggctgaggtgagaggatcacttgagcacaggaggttacagtgagctatgatcacgccactcgacaccagcctgaatgacagagcggagaccctgtctcaaaaaagtggggggaaataaaaggatatagtgcactggattgaaactttctcctgtcgttatcataagcagaagaattgaagtaactaaaaagagaatcatagtctcaatgtgtgcttgaatgttatttaacatcacgtctctgctacctcatcattaaccagctgtggtaatgattccacactttgaacccatcccacctgttgacagaagcgattgcatgccagcatcatctcagtgacggctcatcatgtaggcccagaatactgattttgtgacttctaagcttgtgctccattcccaacacaaagtcttctgaccagcctttgagtaccattattgtagaggaagctcatcttaggtaactattactagagcagaaatcacttaatataaaatatttcatgtatcaaatttaaaactcacttttgggttcattgatgtagtaactcaaccaggaaacttaaatggaattagtgttttcactgacaataatgatgctgctttttcattataggcccataagatggcctggcctttccttgaaccagtagaccctaatgatgcaccagattattatggtgttattaaggaacctatggaccttgccaccatggaagaaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcaggtgagcagatgggttcggtattctgaattaattcaactcttcacactctttatactattctgtctaacgattcaaccagtgcagtttatggtaaatttaaccttaaatatctttaaaa

SEQ ID NO: 592775 - DNA, 166 bp, Homo sapiens
cggacggagaatccttgggtcacggagacggacggttgcgtgcacccagcttgtacccttgcactgcagcctgggcaacagagcaagactccatctcacagaaataaataagaatttctaataagggttttgtgcatactgtagccgttaatagtcctccggccta

SEQ ID NO: 592776 - DNA, 5296 bp, Homo sapiens
  misc_feature (97)..(97): n is a, c, g, or t
  misc_feature (99)..(99): n is a, c, g, or t
  misc_feature (102)..(102): n is a, c, g, or t
  misc_feature (104)..(104): n is a, c, g, or t
  misc_feature (106)..(106): n is a, c, g, or t
  misc_feature (126)..(126): n is a, c, g, or t
  misc_feature (4140)..(4140): n is a, c, g, or t
tcgccactccgggcccctgctgggcgggaaggcggcgccccggccgaggtggcggcggctcctcaggacggaagctcctgctctcttgtcagccgcnanctnangnccattcgcagcttctccagnccacctgcattccttgtctcagagcctccctcctgcatcctccaagccagcagttgtgggatgggagaagaagttgtccatgttcacactgggtgaaggaagctgaaaccacagacatgactgagtcctccatgaagaagctggcctccaccctgctggacgccatcaccgataaggaccccctggtgcaggagcaggtctgcagtgccctgtgctccctcggggaggtgcggccggtggagacgctccgtgcctgcgaggagtatctgcggcagcatgacaagctggcacacccataccgagcagcggtcctgagggccatggagagggtcctgagcagtcgcgccagtgagctggacaaggacacagccagcaccatcatcctcctggcctccagcgagatgaccaagacgaaggacctggtctgggactggcagcaggcggcgagtggcgtcctggtggccgtgggaagacagttcatcagcaaggtgatggaggagctgctgcgcaggctgcaccctgggaccctgccacactgcgccgtgctgcacaccctcgccagcctctcggtggccaacgcgttcggcgtagtccccttcctgccatccgtcctgagctccctgctgcccgtgctgggcgtggccaagcaggacacggtgcgcgtggccttctgctccgctctgcagcgcttcagcgagggtgccctggagtacctagccaacctggaccgagccccagaccccacggtcaggaaggacgcctttgccaccgacatcttcagcgcctacgatgttctcttccatcagtggctgcagagtcgagaagccaagctccgtcttgccgtggtggaggctctggggcctatgagccatctgctgcccagtgagaggctggaagagcagctgcccaagctcctccctgggattctcgccctctacaagaagcacgcagagaccttctacttgtccaagagcctgggccagatcctcgaggcagctgtgagtgtgggcagccgcacactggagacccagctggatgccctcttggctgcactgcactcccagatctgtgtgcctgtggagtcctcaagccccctggtgatgagtaaccagaaggaggtgctgcgctgcttcactgtgctggcctgcagctcgcctgaccgcctactggccttcctgctgcccaggctggacaccagcaatgagaggacccgcgtgggcaccctgcaggtggtcagacatgtcatcaactcagctgctgctcagatggaagataaaaagccctttatcctgtcttccatgaggcttcctctcctggacaccaacagcaaggtgaagcgggcagtggtgcaggtgattagcgccatggcccaccacggctacctggagcagcctggaggtgaggcgatgatcgagtacatcgtgcagcagtgcgcgctgccccccgagcaggagcctgagaagccaggccccggcagcaaggaccccaaggccgacagcgtgcgggccatcagcgtgcgcaccctctacctggtcagcaccaccgtggacaggatgagtcacgtcctctggccatacctgctccagttcctcacccctgtgcgcttcactggggccctgactccgctctgcaggagcctcgtgcatctggcgcagaagaggcaggaggccggggccgacgccttcctcatccagtacgacgcccatgcgagcctcccgtctccctatgctgtaaccggaagactgttggttgtgtcttccagcccctacctaggggacggacgtggggcagcggcgctgcgcctcctcagtgttctgcacccaaacattcaccctttgctgggtcagcattgggaaacgactgtcccgctgctgctggggtacctggatgagcacacagaagagaccctgccacaggaggagtgggaggagaagctgttgatgttcctgcgagacaccctggccatcatttctgacaacgcgtggatctgccagctgagcctggagctgtgcaggcagctgccctgctacgatgaggcaccccaggagaagaacttcctgtacaaatgcataggcaccaccctgggtgctgcttcaagtaaggaggtggtgaggaagcaccttcaagagctgctggagacggccagataccaggaggaggcagaacgcgagggcctcgcctgctgcttcgggatctgtgccatctcccacctcgaggacacgctggcccagctggaggacttcgtgaggtcagaggtcttcagaaaatccattggcattctcaacatttttaaggatcgaagtgagaacgaagtggagaaggtgaagagtgctctgatcctgtgctatgggcacgtggcggcccgggccccccgggagctggtgctggccaaggtagagtcagacatcctccggaacatctgccagcacttcagcaccaaggacccagccctgaagctgtgccttgtccagagtgtgtgcatggtcagccgcgccatctgcagcagcacccaggctggctccttccacttcacccggaaagcagagctggtggcacagatgatggagttcatcagggcagagcccccggactccttgaggacacctattcggaagaaagccatgctcacctgcacttacttggtctccgtggagccagcgctggacgagcaggcccgggcggatgtgatccatggctgcctgcacagcatcatggccctgctgcctgagcccaaggaggaggacggaggctgccagaagtccctgtatctggagacactgcacgcccttgaggatctgctgacgagcctcctgcagcggaacatgaccccccaaggcctgcagatcatgattgagcacctgagcccatggatcaagtccccaagaggtcacgagcgggcgcgggccctgggcctgagcgccctcctgctgcgctacttcctggagcacctgcgtgtcagcgccctggtgcccttccacaacctgggccttctcatcggcctcttctccccacggtgtgcggacctgtggcctgccacccgccaggaggccgtggactgtgtctactccctgctgtacctccagctcggctatgagggcttctcccgggactaccgcgatgacgtggcggagcggctcctcagcctcaaggacggcctcgtgcaccctgaccccgccattctcttccacacctgccacagtgtaggccagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgtcaggactcggggggcatgaggagggggccacaggttggcaggncatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccactgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctcccagcga

SEQ ID NO: 592777 - DNA, 212 bp, Homo sapiens
tcatcagctcggtaccgcatactgtgacttctgcataagtgaatttaactaggagataacttgcaagggaggagcccaagctaccgacccccgaaaccagacgagctaccttagaacagctcaaatgagcacacccgctctatgctagcagatatagctgggaaagattcataaggtagtaggcgatcgaaccgtaccgtagcctgggtgat

SEQ ID NO: 592778 - DNA, 297 bp, Homo sapiens
gggcccccaaaaaggggggaagggttctgggtgctttttttaaaaggggggggtcctttttttggttttttcccaacaaaaatttttttttgggtttgagggtgaagggtttttggcccctttgtaagtccccccccccccccccccccaagttaaagccgaagattttttaaaaattatgtttttcccccggggggggtgtttggggcccctcccggaagtgaaagcccttttttttttgccgggttttttttcttttttttgggggggtaattaaaaaaaccggggggcctttta

SEQ ID NO: 592779 - DNA, 138 bp, Homo sapiens
cgtttgagtggggctggagctcgggtgcaagaatgagtgcgtgaggagagacagaagtatctggaagcgaacatgacacaaagtgcgtgccaaagatcattaaggctgggttggcagcactccaactagaatacttgt

SEQ ID NO: 592780 - DNA, 531 bp, Homo sapiens
  misc_feature (42)..(42): n is a, c, g, or t
  misc_feature (61)..(61): n is a, c, g, or t
  misc_feature (64)..(64): n is a, c, g, or t
  misc_feature (69)..(69): n is a, c, g, or t
  misc_feature (104)..(104): n is a, c, g, or t
  misc_feature (366)..(366): n is a, c, g, or t
tatctatactgacgcgtgaaaaataatatctatgaagatganagattcttaaggaattccnctnttttnccatagagcccaaagtttccttgacccaagcaagnccatcaaggagctatctggattgtatgatactggacctcagtagaactacttttactgaattgctggagccaaaactaggctgcagcaagagaaggcaattagggtacaaaatctaaggaagctgtcattctgaggatcatatgatagatgctgggttaagacatatggctgggcatggtggctcatgcctgtaatcccagccctttgagaggccaaggcaggtggatcacttgaggtcaggagttcaagaccagcctgggnaacatggtgaaaccccacatctactaaaaatacaaaaacagctgggcgtggtggcatggacctctaatcccagttacttaggaggctgaggcaggagaatagcttgaacccaggaggtggacgttgcagtgagccgagatcatgccactcgactccagcgtgggc

SEQ ID NO: 592781 - DNA, 118 bp, Homo sapiens
cgctatatcgacgaagagcttcttcctttatcacaccatcttgagcccaggctgtccccacttgctagtcctgctgtgttacgtctaggtcgactacagtacccggcttttcgtattc

SEQ ID NO: 592782 - DNA, 292 bp, Homo sapiens
aagtcggaggcaagcgaggatcgagctgctgcggcccagcgaaattccgaccgactgagctggagaccgcaggaagctgaggtcaggccaggaggagcgagcaggcctgcagcggtctctgagaggccgagctctggccaacgtgccccagtgtgaaggccaccgcgtccaacaggcctcatcagagtccacacaggccaggagtgaaggaccaggccacccctcgagtcttgtgcttcagcagtcctgttgacccaggcgtgccgagaggaggacttgtccttcctgcttc

SEQ ID NO: 592783 - DNA, 269 bp, Homo sapiens
tcccctcagcttatacttcacactgtggcatctaccctgaattctttcttgcacaagatccaagaaccctctcttggggtctagattgggacccctttgcctgtaactatcatgctactgcactccagcctgggccacagtgtgagatctgtctcaaaacaagaaaaaaaacaagcaaaaaaaaaaccaacttgctattgtcgttcaatacaaagctctccttcacctcttatcaattcaacaagagctgtgctgatcccacacccatt

SEQ ID NO: 592784 - DNA, 382 bp, Homo sapiens
cttccatgtagcatttcaaggaaaagatatcctgagtttccaaggaacttctttgggagccaacccaagaggccccacttttgggtaaactttggccattcaaaggtgcttaacccaggacaaggtgaccgagggaaacaagttcagtgtggtctccttatttgcaccctccccccatttttgtaagtggcctcctttgtgtaaggggagtgtcggatctaaggaggcatgtaaggcccaaggtctgtctgtcctgtggccccagtcctggccctggccgtcttgctgctggtgtccatgtctaaggattctacccaaggcctgtatgggtaaggtggatgcggggtgagcaggagcagcaggcaactatgccaggggacat

SEQ ID NO: 592785 - DNA, 144 bp, Homo sapiens
cctctgccttttgtgccccacccccttttttgtccgtaagtctttcgcccacagtggcactggagtctctctgagcctattttggtttggggggttccctgattcctgaatcattctttgctcaattaaactctgtaaaattta

SEQ ID NO: 592786 - DNA, 636 bp, Homo sapiens
  misc_feature (213)..(213): n is a, c, g, or t
  misc_feature (487)..(487): n is a, c, g, or t
  misc_feature (569)..(569): n is a, c, g, or t
tcgatctagaggatcccgcccatgcacagttgtgtgtatttggaatgtcttgggcgtcagttctatagtcacatattttaaaatgtctatggtgcacatattggaaagggcacttaccaaagtgtgaatatctccttcacttgagggcaagatcccgctatagtggatgagatggtcccgtctcacctgtgcccgggcaacctgtgtcattcnttttcagtgtgttggcaaagaatgagatcttaattctcaaggggtggatctccatatctgaagtgcagttcatgggtccatcaatatcataatgaaggatatacaacagagtgtaattattatatgggtaaggccactgaagatggagcatggccttgctgaatgaactgggaccatggtttctcagctaaggagaaaaaagaaaaggtatctacacctggggcaaaaatcggttccataatccttcccctacatcaactttagaaatcaggtnagcaataggttttaaataacagcaatttccacaattaacctctaattacaatgtgaccatttttatgcaaaaatgatcaaantcaacatttgtctctaacacagagtcacctgtgtccggataacatataaacccggtggggccagtgg

SEQ ID NO: 592787 - DNA, 1425 bp, Homo sapiens
aaagtgagtgtcgatccgagctgtcggcaacgattagcattcttagttagtgtcttgtcgtttatctcttgcgtcagcttctttctactcttcctcttctctataccttcgcgcgtacggcttgtcgttatcgtcttagctcgctctatctccttctctgtagttgtatgtttgggtgatgtagtgtggttgttgacgtcgatctttttctttctttcctttcttgttcgttctctgtatcgtctgttctggtgttgactttgtctccggttcgatgcgtctctctttcttctttgtcttgtgttgcccgtcgtttgccgctgtctgtcatttctctcatcctctgtcgatgtagtttggttattctatggtttttatgtagaatatttgatgtgcgatttaaggggtaatgggtatatgattattttttttagtgttttgatttattgtatttttagagtttttatgtaagtgatagggagtagtaggtgtagtaggtttagttatagtattatttagtttgagtttaatttttattgtgtgtgtttagtttttttgttgtatagttgtttatgtattgtgtatcttttttgttgtttttggtgatggcgcggtagtcattgtaggacacgctctgtcttgttgtgctgtgtgtgtctttgggttgtgtgttatgtgtgtggaggattgtgtgctgttatgggtgcggtgctcgtctgtagtccgtgttgcccatcatgttttcctctcggtctgtatctgtcgtctcgtcgcgtcgctcgttcgtcccttcgcttcctttctcgatgttcgtgtgtgtgttgtgtgtgtatgtagagctgcgtcgtttgtgcggctggcggcttctctctctctctctcgcgctcgcgctccgcgctctcgctctgtgctgagtgctcgttggtgtatctgtttgtctttctttcttttctgttctcgtcgcgcgcgcgctcgcgctctccgctcgcctttctgcgctctctctctttctctctcttctctctgctgtctgtcttgctctcgcgcactctgcgcctcgcttctctgcgctgcgtgtgcaagtagtagagtagttgcaatgtgtgcgtgcttcttcgctgctctctcgtacgcgtcgtcctttctcctcgtcccctgttgcgcgtctcgtgctgcgcgcgggcgcgcgcgcgcgccgccgcccgcccccgccgctcctctcgcgttcgtgtgtggtgtgggttgtggtgtcgtgtgtacctcgtttctgttttccttccgctcggcgagaggtagtgcacccctcccccctccccccctctctctttttttctttttttttttttttgtttctctctctctctctctctctctctctccctcgccgagcaagaaaaatataatatataattagtactattaata

SEQ ID NO: 592788 - DNA, 362 bp, Homo sapiens
aaactttgttgacagcggtgtctggatggaccagcagagggcactctcacccacggggaaaatcgtgcgcccggcctcgtccaccgtcagaagacgccgctacacaatggagtctcgctctggcgaccaggctggagtgcaatggtgcgatctcggctcattgcaatctctgcctcccggtgagaggagaagcccgctagactttcctgggctagtggggacttggagaacttttctggctagctaaagatttggaaatgcacctataatggttgggtctagctaaagtttgtaatcgaaccaacagcacttttgaaaagagggcccattagtcacttcgtaaaaggaccaatcaccactct

SEQ ID NO: 592789 - DNA, 302 bp, Homo sapiens
tgcagtgatgactatcgtctgcaatatagagactactacgttgcgaattggggaggtgttcctctagtgttttctctattacagaagtgtgcaatctctttgcagctacttctgatcttcagcggagcacatttgactcagtcacataagatgagattgttccatttctactgtttggtaacatatcagatttataagataacagacaggtttctgtagaaaaggccataaatcgagctcagcagtgaaatgttcactacgttcaaccatctgctaaaacaagagctaatgtttactaggta

SEQ ID NO: 592790 - DNA, 147 bp, Homo sapiens
gtgaaccactcgttcagcagctcctatgacgtgctgtgcgcctcctcttgtagaatcttcatcagctatgctcgtgatcctatctgagtgacgagacatgctcagtaggagggtacgcttatcgatcgccaggagtcagaggccaca

SEQ ID NO: 592791 - DNA, 191 bp, Homo sapiens
ctaaagcctggagaaaggaggtcttctcggacccgagaccagtgttctgggctggcacagcgacttcacatggagcagtgccaccagcacgggcagcagctggcaccttattgaccagcaacatgtccctgatctcagtgaggacctccttgatgaacacagagccgacattcccaccgatatgaggcagc

SEQ ID NO: 592792 - DNA, 761 bp, Homo sapiens
  misc_feature (9)..(9): n is a, c, g, or t
  misc_feature (266)..(266): n is a, c, g, or t
  misc_feature (273)..(273): n is a, c, g, or t
  misc_feature (292)..(292): n is a, c, g, or t
  misc_feature (309)..(310): n is a, c, g, or t
  misc_feature (321)..(321): n is a, c, g, or t
  misc_feature (323)..(323): n is a, c, g, or t
  misc_feature (332)..(332): n is a, c, g, or t
  misc_feature (334)..(334): n is a, c, g, or t
  misc_feature (347)..(350): n is a, c, g, or t
  misc_feature (352)..(353): n is a, c, g, or t
  misc_feature (357)..(357): n is a, c, g, or t
  misc_feature (360)..(360): n is a, c, g, or t
  misc_feature (366)..(366): n is a, c, g, or t
  misc_feature (371)..(371): n is a, c, g, or t
  misc_feature (388)..(389): n is a, c, g, or t
  misc_feature (392)..(392): n is a, c, g, or t
  misc_feature (394)..(394): n is a, c, g, or t
  misc_feature (399)..(399): n is a, c, g, or t
  misc_feature (408)..(410): n is a, c, g, or t
  misc_feature (416)..(416): n is a, c, g, or t
  misc_feature (418)..(418): n is a, c, g, or t
  misc_feature (421)..(421): n is a, c, g, or t
  misc_feature (471)..(471): n is a, c, g, or t
cccaaagangtctatttcctcccacaggatggctagagtttaggggccacgttctcctctatagctcaccagaggatgcagcctgaagagctcagggtttgaaggttgggccttgggcgggagtcagctactatttctagtctgttctagaaagacctagaaacttcctgtgtgaaaacaggattaggaagctctgggggtgaaaatgccatgcacggagctggcccatgccaagtcccttctaactattttaaattacatctttngccaggnacggtggttcatgcctatnatcccagcactttgggnngtcaaggtggntngtttttctntngttaggtgttccnnnncnncctngcnaacatngtgtnaccctgtctctactaannatncnaaatnattatctgnnnatagtngngcntgcctgttatcccagctactcaggtggctgaggcaggataatcgcttgancccaggaggcagaggttgcagtgagctgagatcatgccacgttacactccagcccgggtgacagagcgagactcttgtctcaaaaacaagaaaaagaaaaaaaaatacagcctcatcaacatctcctgcttctctgagacaaagggaacaaaccaaatcaggaaaatcgtgacagataaatgacaggcagccattgtcatttccattcttattcgtggtttctggtttttttggttttgttttcccttttaatttttttctagaaaaaaaaacacaacccggggaattta

SEQ ID NO: 592793 - DNA, 100 bp, Homo sapiens
ggcacgagcttaaccttggaggcggaggttgcagttagtccgagattttcaccacttcacttctagcctttggcgtcagacatggactctctctcaaata

SEQ ID NO: 592794 - DNA, 1187 bp, Homo sapiens
  misc_feature (1)..(1): n is a, c, g, or t
  misc_feature (5)..(6): n is a, c, g, or t
  misc_feature (16)..(16): n is a, c, g, or t
  misc_feature (21)..(21): n is a, c, g, or t
  misc_feature (26)..(26): n is a, c, g, or t
  misc_feature (42)..(42): n is a, c, g, or t
  misc_feature (68)..(68): n is a, c, g, or t
  misc_feature (88)..(88): n is a, c, g, or t
  misc_feature (257)..(257): n is a, c, g, or t
  misc_feature (404)..(404): n is a, c, g, or t
  misc_feature (524)..(524): n is a, c, g, or t
  misc_feature (815)..(815): n is a, c, g, or t
  misc_feature (855)..(855): n is a, c, g, or t
  misc_feature (861)..(861): n is a, c, g, or t
  misc_feature (868)..(868): n is a, c, g, or t
  misc_feature (1030)..(1030): n is a, c, g, or t
  misc_feature (1078)..(1078): n is a, c, g, or t
  misc_feature (1174)..(1174): n is a, c, g, or t
ncccnnccccgccccnccccntctcnccgaaccacctcgccnacgcgccgcgcccttctataagacanaacgccgcactgccgactcnacagcactctggttccgcaggcgcgatactacgccacgatcacggcctccgcgccgctccgacgcacgctgtgtgttaaggtcagccggacgcgggccggcggcctgccgccgcccagcgtacccggcgccagcgcgcgcgcgcgcccgcccccccccccgacgcccancgatggggacggcgagggaggggggggggggaacgggaggcggcgggggcgagggcgcggggaaggcggggacggcaaagggagagagagagccgcctcgcataacaacccaggcaccagccgtcgtaacgtgcgcgtgcgcggtgntccaagatggtagatcatcgtccacatcactatgatatacaatataattacccatacgtcatacttcaataatacataaacataatacgatcgatcatggatgtaatgaaatatcagatnaggaagtatatgaggatcgtgcgtagggagcaagaacgtagaatgcttttcgtaatcagattcaagtcagtgacagccggcgcgacgtgggagcgaggtacaggcgcgtatatgttctcgttattctcaactcgacctcgtgtccagttgtccggcagcagtacgtctagtggctctgggcgacgccgctgcaccacgtgattatctagtgtctgtgccgatcgcgtctatgtattactatttgctcatacgtaatcctgtcactgatcatagtatacgggtgatgctcgncggtcagcgcgtgctcgtgctgaggcgacgcatcgcgtancgagcngttcgangtcctgctcatacacgacgtatctcgcgcatagctgcaagcgagtgatcttagtcactctcatccgcacgtacgatcagatactgtgctgataagtatgatcatgtgtatatgagaacaccatcacactgcgaactagtcacgtgtccgtgtgctcgatccngcgacgcaacgtgcgcgcgtcatgctcagcgagacgcgagcgtagtcntgcggcggtcgtctataggtcgtacggcgtagtgtgcggtcacgcgcgcaccacgcattcaccgcatccgccgccgcagaccgctcgtgctgcagntgcgagcctgtcg

SEQ ID NO: 592795 - DNA, 308 bp, Homo sapiens
tctttaccgaggccccgtctaaaaaaaacaaatgagccgggcgcggtggctcacgcctgtaatcccagcactttgggaggccgaggcgggcggatcacgagccaggagatcaagaccatcctggctaacatggtgaaacccccatctctactaaaaacacaccacgcctggttaatttttgtatttttagtcgagacaggatttcaccatgttggccaggctggtctccaattcccaacctcaggtgatccgccttcctcggcctctgaaagtgctgtgctccagcctgggcgacggagactccgcaa

SEQ ID NO: 592796 - DNA, 152 bp, Homo sapiens
gggaccttacgcgatatatagtcatgcccggttccagccctttgatgtgtagtatcctactgaggagtcacaaaatcttcaaaaatagggataccttctcctgccgcaactactgtgatgcggtacccaattaagtggtgcgaagagtttag

SEQ ID NO: 592797 - DNA, 311 bp, Homo sapiens
tggtaggggtaccagaaaggaactggctaccgtgcggactatttgtagtcttgttacagaacatgatcaagggtgttacactgggcttccgttacaaaatgagttctgtgtatgctcacttccccatcaacgttgttttccaggaaaatgggttctctgatgaaatccgaaattttctttgggttgaaaaattttttccgcagggttcggattgagaccaggttgttgcttgttcagatattctcagtgcccagcaaagatgaatttattcctttgaagggaaattgagatttgagctttgttttcaaatt

SEQ ID NO: 592798 - DNA, 162 bp, Homo sapiens
agatggattggcgatgaacagcgctggagtgggcaggtgtggtgcgtgatggtggcctcactcagagtggaccaatggcccagctccttgcccaaaaccaaagcccttgggccgaagtttttagtataacatcctttgcagtaaatctcgccaacccgatcg

SEQ ID NO: 592799 - DNA, 1059 bp, Homo sapiens
gcaggctcgagccgagcaagccaaggccgcggaccaagctgctatggcggacatggaggacctcttcgggagcgaagctgagagcgaggccgagcgcaaagattccgagtctgagtccgactcggactctgaccaggacaacggcgcttctggcagcaacgcctctggcagcgaaagtgatcaggatgacagaggtgactccggacagcccagtaacaaggaactgttcggggacgacagtgaggaggagggggcctctcatcacagtggcagtgacaatcactctgaacggtcagacaataggtcggaggcttccgagcgctctgaccacgaggataatgagccctctgacgaggaccagcacagtggctctgaagcccacaacgatgacgacgatgagggccacaggtcggacgaagggagccgtcactcagaggcagaagggtctgaaaaagcccagtcagatgatgagaaatgggatggagaggataaaagtgaccagtcagatgacgagaagctgcagaactctgacgacgaggatcgggagcaagggtccgatgaggataagctgcagaactctgacgacgacgaggagaaaatgcagaacacagatgacgaggaccgggcccagatttctgatgatgacagacaagcagctgtctgaggaggagaaggggaattctgacgaatgagcatccaggtagcttctggtaatggcgagggagaagcgaaatttggaccatagggaccaaaccgccaggtggtccgaagaacggtcgacaaatggcgaacgccgcaacagtggagagtgcccacaaacttcgaataaaacaagtaaaggagtacgaaagggagagaagaggaacacaaagacaagagatgagaaacagctgcaaaggcagcgacacaagagcaagcaacgatccagaaacagagagcacaacaacgagcgagcactgacgaaacaacaaagacacacgagacacaaggatgccccacaaaacaagagagcgagcacgagccgcagcacgaaagacaaataactacagcaagagagga

SEQ ID NO: 592800 - DNA, 214 bp, Homo sapiens
gatccttaaattgaggtcctgggtggggagtccaacgccgctgtctctggctctggtctagccacaacgaggtcaatgctcgcttgcaggtgccccagcgaggacccccagttccccaaggtgcagtggtcaccccgtgaactttgttcttgcctgccacaatgaacgcctggatgtgcccgtagtgggaacgtgcgaagccacccctcaactt

SEQ ID NO: 592801 - DNA, 633 bp, Homo sapiens
gatggcagtaactctcatcagtctatgttgtgggcgggccattcatccttctgtctttaacctgtgcctaaatgttattgattcttgaatccctcttgtccgcccagagctacctactaaacatttcttggccacaaaatgttcggagcagggccactgttacagatggtggaaattataatttcctcctttcctcaagtgcacaggtccaaaccaggattcattcttcctcaaaattaacacctctgccttagcataagcatgcaaaccaaaatcaatacaggctagtgtctactccactgcaacgctaatgcaaaacatatcactgaaggaaaagagggctgatagaacaaaagcaaggcttaaacttcagattcaaaggctcctgtagaaaccagagagtccctacagcaattaagtggaagtgagggcacatgttttgaaagtatttctttaaccccttggaaagcaaagtttggttagtgctataagcagaatgcctcaggtcagagcttcgctgtgagactactggttaaagcacagaatggccacagaattatgcgtgccaggcaggcttactattttcagcagtcaagctgatgcagcatatctaatgtttggtggaggcacaga

SEQ ID NO: 592802 - DNA, 441 bp, Homo sapiens
ttagaggatccttcttgtgtggagctgcatctctgcctgagggggcaggaaaggctctctgtggaggtgacatctgaaggtggctaaactgacatgaagggtgagctgcatgtggagttctgggaagagcatccagtgcgagtaaaccagcgacagagggagccaaagagggagcgtgtagagaggtgagcagggccctgacaaggtagaacagccatgagaaggttcctgggggcttggagcaggacgtgcacgtgagttttaacagtgacctctgacagctgtgcccagactgcagtgtagggccctgaatggaaatgaggagagccatggggaatccagtgcaactgtccaggaaggcgagggaggcgtccacactcttagcacggacagcacaaaaaccaccagcaaagaaacacagggtaccgaggtcggattcgg

SEQ ID NO: 592803 - DNA, 296 bp, Homo sapiens
gagatggagtcttgctgtgtcgcccaggctggggtgcagtggtgcgatctgggctcactgcaacctccacctcctgggttcaagcagttctcctgcctcagccttccgagtgggtggaactacaggtgtgtgccactacacttggctaattttcatattttttgtagagacggggtttcaccatgttgcccgggctggtcttgaactcctcctgagttaaagcagtctgcttgtctctgtctgccagagtgctggcattataggcatgagccaccacccccttctgtcgtcttctc

SEQ ID NO: 592804 - DNA, 252 bp, Homo sapiens
gtgcgtcatgaactgctggcaagcctggtagatgctgatctgaatctgctgcccatgctgctgccagtaccactgccctgtcatctggaatccactgcaactgtgtatgccaatggtgcaatgctgcagtgtgacctgtaccagcatgctgttctgtgccaccgtgctatgctgctgctgaccgtgatctgggctgtgggatccatctatgagtctgcacctgcatgtgcatgcaatgctttgtgcacttgg

SEQ ID NO: 592805 - DNA, 834 bp, Homo sapiens
ggtaaactcgttcgagaatctagaattggaggaaaaacacagcagcagggtgtcttacattccccaccaaacagaaaaaggtggctcagacccaacattttctgactctaaacaagcaacagaaggcagtctaggtaaggtcattcctcctatggctcgaacagaccctctgacaacaccaggtaagcctctagtcccatgtaagagcggttggttgggagccccactaacaataaactggccggagaagtgttccccttttctgctgtgcttagactcccctccccacaataaagatgctctccgaccttcctgcttgggtggctcccaaaaaaaaaaaaaaaaaaatacacaagaaaagaaacacaaaacaaaaaaaaaaacaagggggggcggcgccgccatgataatgatctcccccgcgggcggggcgcgcacaccgatgataagcgcgatctccacacaagtttttgttgggacaaaaggggcggccccaaaataggagagaggaggcgcgactataagtagaggccgagcgagccaccgggggcgcagcgtgtatacacaaacaagcgtgagaccagcgtggcgggaaaacaacacgggtgatccagcacgggggagacacactctgtgggcgaagagcgaccacacaaccaccaaccgggggggggggacgacaccacacataggtgggcgcacaacacaccaccacacagaaagaaaatttaacaaaccggccctcaaggggagaaaacgtacaccacgccttacaacaaggcggagaaacgagggggtacaaccacaaacgccggacaaaatactagcgcagga

SEQ ID NO: 592806 - DNA, 230 bp, Homo sapiens
tcccccccgaaatttttatttttttaaggttctcaaaggaaaaggccctttaatccaccagggtcatcagaagataacttgagccccgtcagggcttaatgtttattcctgataaaaattgatcaaattcatttttttcccgggggttccattaatgttaattcagccctgatttccccccagatcaatttgtaattgcttccatttttccaataaataatctgtacgta

SEQ ID NO: 592807 - DNA, 916 bp, Homo sapiens
attattgtccgagtggccggaacgggagccaacatggcagcggggttcgggcgatgctgcagggtcctgagaagtatttctcgttttcattggagatcacagcatacaaaagccaagtcgacaacgtgaaccaggattaggatttagttttgagttcaccgaacagcagaaagaatttcgaagctactgctcgtaaatttgcccagagcaggcaacatccatcccagtggctgcagacatcatgcatcaaacactggtgcaatatccagtcccccttaattcagcaagagcctgggaacttggtttaatgcaaccacacacattccagagaacttgtggaggtcttgcgactatgggaactttggcatgcttgttgtaaattcagttgcacagcacaccggcttatggcatgtcccaggggtttcagcaactgctcattgcaccaggcacacattcttttgggggccaaatgccgtcattcattcattgcttggcaaacttgcatcaagcaaaagcaaaggcaagtcatttgcgcggagcaatgcactgcaggcagcccattggatgtgtgctttaatgagtgtaacagcaaccctggcagcagggctctggaatggtagctgggtcataaacaggaacacaagcaggaacaagcaccaggcaggatgcaggtcatcattcatttccatcgggtcagcacacgactggtggacataaaacccagacagggacggcgcaccaacacgactcacactcggggaactgcagtgatactagagacaccggtatgcaggagtccgaagagtcccgtaacagccttccgtgggtaaattcacagaccctctaactggggatatacatagtagggacaagccgccatacccccaaggacacatgcacgactaggggccgacaa

SEQ ID NO: 592808 - DNA, 1674 bp, Homo sapiens
acgtgaggggtgcggaaggggtcgacagcccgcttatgagagctgttggggaaggtacgtggcaggggcagcgcgggtaaagagtgggtgggtcgacccacggtctcggagtagatgggcgccgcgtgccccaccgcctggggtggctgcggcggggctgtcgaagaggaggggcccggttgggagttatgcaagccagggagagaggttgcgtgggtcaaggggcaacacagtgagaatccatgattaggtcggacggggtcgttccaggagaaggtggtagaggataggtggccgacagagccaggtgtggggtgctggtgaacgtggctggtaagagagggatgcgtgggcgagttggtgtcgggtgctgtaaagggtgttgtgcgacaatgtgaatgtcttgtagaggggattggttagatgtagagtgtgttgttctgagtcttgcgtgtgggtgtgattgtgttgttccctgtgagagtagtgtggaaagtcgcgtccagtttgggggtttagacctgtgtttagtaagtgaacgggggttaggtttatgccgtgacgagaagagagtgatggctgtcggattttgggggggatgggtccatggagggtggaagttgttgtgagggagacgaagtgtgtgtgcgctggaagggaatggtagtgtgggtagtttattgtatgttgaagtgtgttgttaagggctgagaagttttagcgttggatattgtttgcgagttgggaagggaagttgagttggggagatgtcattagggtgcttatttgggcgcttatgggtggaggatatgtaagaagtgatgggaggtcgttgtagggcctaggttggttagaatggtgtaaggaagaaagcggttgggcgttcagagcttaacgagtaggtgcgttgtgtgagtagttggttaatttgggagcaggtgtaggctggcgtgtagaggtagagatagttgttgttgtgtgcgcgtgatcgcgtgtgtggtgtggcgtgcagatgggcgtggttgtagaaggtgggcagggggctggagggaagcgctcaaggcgctttggtgtgtgggtagagggttagcagggatagagagagtagaggtgcgcaggcgcggttgtgtgtgtgtagcagagagagccgcgtaggatgcagaaagggggggtgtagagaagagagaggtgtagagggaggtatggcgtgtgtgccagttggtttgtgagagagtgtgtaggcgcagtgtggaggagggtgcagagtggaagggttgggctagtgtgttggaggtgtgtaggcaggttggagtagtgtggtgagagatagtagaggtgcagagtgtgtgggagtgttgcagtgtgtgtgcgtgtgaagtagtgtgcagttgctgtgtgttgcagcaaagtgagagtgagttaagggaagttatgcagtcagtaaagggaacgctaaggtgagggtagtatgagtgagtgtagttgtgctttgcacacagcagtagtacggtagtagttcgtgaatagcaagcttattcacattttgcttcctaatctgttttgttgtacagggattcaggtctctgattcttacaacatgattgtttatatgtgaagcacatcttgctgttgccttatttttgatgcttacagttcagggtcagatttgtcaag

SEQ ID NO: 592809 - DNA, 177 bp, Homo sapiens
tggatttttatttgggggggagggctgggacagttttttttctaaaaaagtctgttgagatttccccccttagtttcccaccctctcccccacccctggagctaaatgcgttgtaaaatattgcccaaatgaaaagtgttttgtaatacccccataaaggccgcttgtttttgtgga

SEQ ID NO: 592810 - DNA, 248 bp, Homo sapiens
  misc_feature (20)..(20): n is a, c, g, or t
  misc_feature (100)..(100): n is a, c, g, or t
  misc_feature (110)..(110): n is a, c, g, or t
  misc_feature (152)..(152): n is a, c, g, or t
  misc_feature (185)..(185): n is a, c, g, or t
caattcgtgatggcgggggntggttccgccgctgtatcgggggcagggaccggttggcgggcccacaggcgcgaccttttcgccgaagcttgctggagtnctgcgacccnctgtcagcagctcgactctcacgtacacgccgtcagagagancaggtagagctcgggaacaaattgacaacctancacagaactgtgccgcataaatgaggatcagaaggtggccctggatcttgacccctatgttaa

SEQ ID NO: 592811 - DNA, 113 bp, Homo sapiens
tggggaagagacggggtctggctatgtggcccagacgggtctcaaactctgggtctcaagaaatccttccacttaggcctcccaaagcatggggattataggtatgagccact

SEQ ID NO: 592812 - DNA, 1044 bp, Homo sapiens
  misc_feature (14)..(14): n is a, c, g, or t
  misc_feature (21)..(21): n is a, c, g, or t
  misc_feature (435)..(435): n is a, c, g, or t
  misc_feature (476)..(476): n is a, c, g, or t
  misc_feature (487)..(487): n is a, c, g, or t
tccgctaggactcnggcagtnggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgcccatgggcatggcgcaggccctgggccctgacacgccattacacagaccatcgccggcagtgaaatcttctcccatggagatgagcaagaccgaggcgctgacgcaggccttccggcggtccatcggcgttcgcatcaaggagnaagacggagatcatcgaaaggggagagtggtggagatccanattgatcgacngccaacagggaccggctccaaggtggcgcaaactgcccctccagaccccagccatcgagaccatctacgacctgggcaccaacatgattgagtccctgaccaagcgacggggtccaggccggggacgtgatcaccatcgacaagcgcgcacgggcaagatctccaagttgggcccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacagggggagatcaagtcagaagtccgtgagcagatcaatgccaaggtggctgagtggcgcgaggagggcaaggcggagatcatccctggagtgctgttcatcggggagggtcccatgttggacattgaaaacctctcctttcctcaaacgggcccggggcagtagctgcggccggcctggatcctgggccagcggggattcagcgaat

SEQ ID NO: 592813 - DNA, 703 bp, Homo sapiens
  misc_feature (14)..(14): n is a, c, g, or t
  misc_feature (21)..(21): n is a, c, g, or t
tccgctaggactcnggcagtnggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgtctccaccatccccactacagcgagaaagacacgaagcaggatcctccgccatccggttgcgaggaaagcaagatagtggagatgagtgaggacgcctacacggtgctagacccgacactcgggctggagacgtacactgcgctacagccatccagctcatcaaagctgcacagacttggatgtgccaggacaacgcacagggtaacggccaaagatggccagtgactgcgacatgacaccttccgagacgcccggggttcattacttccaccgtcctcgcccatgaggaacgaaagcatccgcggtcatccgcacggcaagcatcccaactggcaacgggagaaacgccgagggcacagtcccgtgacccatccgttccagcagacaacgtacacaaagagcgcaacagcca

SEQ ID NO: 592814 - DNA, 923 bp, Homo sapiens
tctgaaacggagtctcgatctgtcgcccaggtgggagtgcaggggcgcgatctcggtcagtgaattccgcctcccgggttcaagcgattctccggcctcggcctccgttgagttggggatctacagatgcccaccaccagccgggtaatttcatttttagtagagagggggttcactatgtgggccaagctggttctcgaactcctaggctcaaatgatccgcccgcctcggcctcccaaagtgctggggatcacaggcgtgatgccaccgtgcccgggccgattggcgttaaaagtcgctctgaacaataaaatccggaaggactgggaggggaggctccgaccttcatccctgtctgggcaggtgtgctggctgccgggccagcaaacgggcgcctggcggacagccgggccgggctcccacaaggggcccggggcgccaagtaatatcccgggggccgctcaaaaccccatttaccccaacaagaggggcgcggatccaccatccgggagcggaccggcaatattagggaccatgatcggcaaagtgagggtgaacctccaggccaagagtctcaagagccggtccggagacaaaccgtgctgtaacaaaaagaggcgaggatcaacgaggcccaccagaagatccaaaggtggctaaacccggggggggggccctgatggagaaaaaatggggactgggggccgtgtttaacgccaaaacacggtcaatcgcggagaaagaacacggccccctggacggaagcacagaagacgaggcacagccaaggctgcaactgtctgtatgcccaaacggaaacactctaagcaaccgcaaggagacaacacgatacacacggccagagaacccacagacaagtgacgccaacaaccgaagagcgaacaaatacaaccaagaataa

SEQ ID NO: 592815 - DNA, 612 bp, Homo sapiens
ggtcctagtggcggcgcagtgtcgcaggccggagggaagatggcggcgcctggtgggagccgcgctgtgcgagtgtcggagatggcggggttcaagcacctcggcgtcctgggccggggaaacccccgctggggcggatgccacaacaagtggacatcgagttggagcaaacctgtgagcgggcttggaagaagtcaccgggagctttcgaccgttacgggcggccgggcagaagcagggaggccggcagggcccgcggcactggtgtgggggggaaccctaccggaggagtaatccggggggaagaagggcacaggatcccacaaaaggaggaaagaatcgcgataatggggggcgggcgttcaccaccccaaaaggtcctacccgggaacccaaacgaagctttaagtgggaacgggggaaaacgaggccccaatcccaagggaagctttcggggggcccaactgggtggggaaacgaaggcgacgcgggctgggcacacggcctttccgaggaacaaggccaaggtggtcccacggctgaaattgctcgtgtgggggcgcccgaagtggggcaggacaggaccttggtgggcccattaaccagaagcag

SEQ ID NO: 592816 - DNA, 111 bp, Homo sapiens
ccgtcctttccaaaacgattttttgttgccccttgtagtggattttgcatatcatctttcccccctaaaaatgtttgaatgcttacccaaataaattttataacccgctta

SEQ ID NO: 592817 - DNA, 683 bp, Homo sapiens
ggcaggcgcctgtagtcccagctattcgggaggctgaggcatgagaatcacttgaacctgggaggtgggggttgcagggagccgagatctgccactgcattccagcctgggcaacagagtgagactctctcaaaaaaaaaaaaaaaaaaaaaagaaaaactctgaggaaaagtcctgcgagttgggggaaaaccttcaaagtgaaaaacattctttacggaaggtcagtataccacaatagaaacaaatttctatctttctatagggtgggaaacgctctagtcttatccagacataaactacaggaagagagtggtatcatggtacagagcatctaaggcagaacttatcaggatatggtaaaaatcagtgtgggaggtatccagtcaaaagtcacgaaggaaacgtatcatccgcgactaactccgtcaaaccttcaagaaaagcgctacatttcaccaatgggatatccaattttgtgggactacaggtacgaggacaacacttacattcccctcaatatccttaaatggcctttataatcaatatgcacccttaccccctgaacgcttagaagccctacactttatggcctaagcccagataccctattccaaatccacgcgggtacacatggctaatacgcgtcaccgacgtagtcaacagtaacctaaggctacagt

SEQ ID NO: 592818 - DNA, 254 bp, Homo sapiens
  misc_feature (144)..(144): n is a, c, g, or t
gagcggacgggtaggggggttagatgaattactacgagtcaaagttgagcggtggtaatttccaaatccagaccggatacagaattttacgggtgcatatatacgcccccggatgcacgttctcttcgacccctacctttaatnggtaaatgatgtctgatctattattttttcccgtgtcgatgccggatgaaatgctgcactctcgtgtcacccgctatcactatctgttaggcaatagaaccgcggcagaa

SEQ ID NO: 592819 - DNA, 140 bp, Homo sapiens
ctcgatactttctatgtatagagctcggctcattccaggcttgtgtgacgaacataggcgcacggtaagtgtgagatgcgctgatggacctaatatccagatgactgtttcgaagcctttgtgtgccgtgattgatgggg

SEQ ID NO: 592820 - DNA, 404 bp, Homo sapiens
  misc_feature (32)..(32): n is a, c, g, or t
  misc_feature (70)..(70): n is a, c, g, or t
tgactacctccatcccgagttacaattatgcntctcaaaatgagctttctatgggatacactctacctcnaaaaatagtatatacacttgaacttggcatctcaccctctattaaattgagaacttttctactcctggaaagttactcagggatgtgatcctatttcatcatttgtgcttatctcatttttctccaaacttacttagtctgttctcaacgttagaaccaaagaatcaagtgttggtaagttgatacatagctctacttaactctttaggagaaaggtctgtgtgttacttggcctatcacataattttccagatgaaatgtaagataagcaaacaaaaggaagttacccgtgtgataccaggttagaaaatcttcacaaacactgcaaaaaaaa

SEQ ID NO: 592821 - DNA, 325 bp, Homo sapiens
ctggggggctactctttgtggttggtgtttccccccggcatgtctgaatgcgggcgccaagggcaggccctctggcgtgagcccacacgcgcgcgtggagcctttctcgcctaccctcgtggttggtttttctggccgggcgccacagggtcgtgaccgggcccgctcatgggggggtgcaacgttcctggcgttgtcttatgggccgcccgcggcagaccggaggagagaattggcggtctgtttacagggaggcccaaggcctggcgcgaccgtgtagggccgccgattgtggcgccgccaggagagcggagacgacacgtgc

SEQ ID NO: 592822 - DNA, 100 bp, Homo sapiens
gatagcgttggggaagagatagcgttgtgaagtgcttagctgtacttggagctattggggtctgaccccaaacaccttccagctcctgtaacatactgga

SEQ ID NO: 592823 - DNA, 142 bp, Homo sapiens
tgtcgtgcctggactattcggctccccttcgccaaggtcgaagggggttcggttggtctctgctagtgtggagatagtcgatattatggcctaggttcagaggcaggcctaagttcagagccaggcctaagttcagagccgg

SEQ ID NO: 592824 - DNA, 357 bp, Homo sapiens
  misc_feature (349)..(349): n is a, c, g, or t
  misc_feature (356)..(356): n is a, c, g, or t
agggccaggcggtgaagcccgaacccacctgaggacggcagtgaggatgagcacctctagcagcctggactccgcagtggctgtgtcagcctcaccctttgtgtgcacccgcatgggagggtcggagggtgctgcccgcccttggtgctggaggcgggcttggtgtccggctcaagtagccttcctttgctctgggaccagtggttttttttcccgcaaacctggatggattgggggcgggacgttttaaaaaaattggttccttttcccccctaaagcagtcgaggagatttgtaatcccctttttagtgcaacaaaagccccagtttaggctgttaaaacatatttnaccgggna

SEQ ID NO: 592825 - DNA, 242 bp, Homo sapiens
ggggtctcacagcattcagagccgagaacccccaacaaagatttacccacgtatttattaacagcaaaccagtcattagcattgtttctatagatgttaaattaactaaaagtatcccatatgggaaatgaagggatgggctgaattaattgcagcagggaacacgcctttaaggacacagattgctcatgcttttgtttgtgggcttaaggaatgcctttaaggcagttttccgccttggg

SEQ ID NO: 592826 - DNA, 274 bp, Homo sapiens
cagggggcagcagaggtagaccaggatatacaacgagctgctaaagtcctaacagtggaagatgctcaaacaccatccatcctctgctggagcagctagaaacgagcagatttaacgtgggtagtcccggatggcaaacctcacgcaaggcgaagaacagggctatctgcgggtcaccacggtggattcccacacttctgactcggacgttccttccggtgtcactgaggtggtcgtgaagctcatatgactctgatcccatcactgacaacgg

SEQ ID NO: 592827 - DNA, 381 bp, Homo sapiens
  misc_feature (53)..(53): n is a, c, g, or t
  misc_feature (152)..(152): n is a, c, g, or t
ctgggcgactagaggatctctatgtctcgatgtactatagccatcttgctggntgtgctctttggagctgctggatacactgtagactaacacagacagacaggcatacaggattatatgaaattaccatagtgaaacttctgatgttttanaccaagtgactggcttaagatttgtgaggctatcagcagctttcacgattgtctccgttcctggcaccaaatttaaatgggcttttgatgcctcaaaaatttttttcttggccgggcgcggtggctcacgcctgtaatcccagctctcagggaggctaagaggcgggaggatagcttgagcccaggagttcgagacctgcctgggcaatatagcgagaccccgttctcc

SEQ ID NO: 592828 - DNA, 423 bp, Homo sapiens
ggtatcggttacccgtatcaaattatcaaaactgttttaaaatgctcatgttaaaacaaaggagcactgtactttgaaatgactgctctgatgctttccaaggttgacgtgtagaacattaaaaaaacctgttcattatctgagctctaacccccaatcctgattttaggccttaagtctcttagaaggtaagcaatagttagagcaaccatactcccttgattttgggaagagttcatactttatatatactttcctagaaattatagctttctgtcataaaatgtgaagaatgcatctccctcccacacatggttaccagatccattgttagacagtggtggtgtgttcatgatattgtattttaattatttatgtggagttttaatttaataaggtaccatgttcatggacctgaaacat

SEQ ID NO: 592829 - DNA, 958 bp, Homo sapiens
gggctcccgcctgttggtgttaacaaggagcgctgtgttccgcctgtcttttgagggctggtgccacccgctgtcgggtgtcagcgcgctccatgagtgcgcggtgttccgtatttgcgcggttctcgagtgtgctcgtggtggccccctctggtcggtgaggaaagcagcagcagcacaagtcactgtgcttgatgtgatggggacggtttctcgagacgctctcctggggagtttgtagagggcccgttctgtggagtttattctttctggccgcccgccgctgcactactccttatgtgcccttgctattggtgggcctccccaaatccctaaggggatcgctcgttatacagatgaacacacaggccgagggggtctcaacggtagtctccgtacccgcggtagaccacagcagaagcagcagtgggcgaagccccagaggggggcgttgaagcaactcatcgagaggttaaccccggactttcggcgggggactaatatattgtctaaacacttcccaagacaaaagacgtttcgcccgcccgtatgtttcgtgagtagaccacagcgagggagacctgtagagagtcctgtagcagttggaccaatccgggtgttggtcatctcccgggtgagcgccccccattcaggtgatgatagaagtacgcatcgaccaggacgggtttcgacactatgaaggcgtgtcgcccaaacaatagggggttaaaaccagaggcgtattctcccggaaggttgttaacaccaacaaccacggttctacccggtacaacacgacgcgggggggataataccgggccaaagctttcttggaaatttgtggggcacaaaacccaattttaagccctttttctaaaaattatttcccctaaaatttttaattggggcccttttttcccctttggacccccttttccccctttggggcccacaaata

SEQ ID NO: 592830 - DNA, 785 bp, Homo sapiens
agcggtagagacgggttttcaccgtgttagccaggatggtctcgatctcctgacctcgtgatccgtccgccgtgggcctcccaaggtgctgggattataggcgtgagccaccgcgcccagccccgagtaatacattgtgtaaaaaacacaaattaaacatgttctcgaggggtatctaatagactttaccgtatgaagtttacgtatacttctattataatgcaacaatgctttgtttaacagacaaagatctttcctcttttcaaaatgtagtatgactcaagcacctgggcctttcctgctgtttctctgtatttgcactgtagcttaaacccaatgcggggcaggtcaggactcagccttgctgtgggaggtggcatatcagtctgggagagagtgggaggtggacggcattctgggcacgagccggcagggacacatgagcttccccagacttggggacttgcaaattggacatgcctggctacaagggacagtccaggaagatcgggcatctgggacaggttctaccagagcccaaagacaagggcctcttctacgtgcaagattcagacgtggagcccagtctgggcattttctcatgggccgcaatctggatcacgtggggtccccacaatgggccctttcctaattaacaggtaggtggcaggaggcaccaatacgaagactgagaatcaacctaggggccggccagtaactaatccattggtcacgtttctgtataacaaagaaggacattcaacggcaaagaactaagaatattg

SEQ ID NO: 592831 - DNA, 883 bp, Homo sapiens
ctccggttgacgagcctgaggcctgtgatcagatgtacgagagcttgagcgcgactccattcaaactactacaaacacaagtaccctcggcccagagacaccagcttcagtggcctgacgtgggaagaggacaagatgatcctgtggacagacacgcttgggagagcttaaggaagtagataaaggtatggggaagaaactgggggagaaggaagattcctgggccctgaggaggagcataaggtcagagctaacgtctatcctagattcttctactgtgtagagttatttaataactggtattaaattgaatatttatcatcttgcatcctatatcatgtaaatatgtgatcatagaggagagatccggcgaattttttagctaagcttgacagattgaaagaccagggccgtttttttttggagagggtgactataccatggagatgaagaaagacatcttagagttagacgaaaaaaataatacggccttgctggctcttacaggtggggccttgcggacatttccttccacgaggggtagatatggatcgggttcactgactcgtgcgctttgtaattaagagtgcgccaggggtatcagtctactaaatgcgctattgtcggttttcaacgaatcccggcttaactcgcgccaaatcatctcaggtataggcactacgtgcgtccgcactctaaaagaggctgcgcgggtgcttattatttctgccagatccccggcacgctcgcacacgtttgctgtgctctagtggctccaacccaatgcaagacactatgctttgtgagattaaggaagctccactcgcccttgtattattctataatcgccgatcttgacgggatctgctgggatgcggtcgcg

SEQ ID NO: 592832 - DNA, 229 bp, Homo sapiens
cgcaacggcggcggaagcatgaacgcccttacagccttcgagtcgctcttgctcttcgagggcaagaagatcaccattaacaaggacaccaagctacccaatgcctgcttattcaccattaacaaagaagaccacacactgttaaacatcattcagtcacaacttctaaaagacccggatgtgctatatgttgtctacaaagacacgcaccccttggagcacatgatca

SEQ ID NO: 592833 - DNA, 318 bp, Homo sapiens
aacgatggtctcagctctattaaaagtatgaaaaattagccgggcatggtggcatgcagctgtggtcccagctacttcgcaggctgaggtgagaggatctgcttgagcctgtggaggcagacggttgcacttgagcttgagatcacacccaccacactccagcgttgggtgacatgagtgagaagaaaacaaaagtctggcatgaccagacagtatttgtagttggcttaacttttattttatttaacagctatttctaagagatttctcatcagggaatgtgataaagtaaagttatctcaactaggcatcaggatt

SEQ ID NO: 592834 - DNA, 988 bp, Homo sapiens
  misc_feature (365)..(365): n is a, c, g, or t
  misc_feature (476)..(476): n is a, c, g, or t
  misc_feature (969)..(970): n is a, c, g, or t
gggctcattggcgaggaaagggagaagcgcgggcacaagaaacggtcccgggggatcaagtaaggagaaaagagaatctcgaattcggaaggagaagaccaaattgagtaacgaacctggaaacccttccggtccaaactaacagcagacaatcctggggtgggtggtggacccagataccacattcaaccggggggctaagggtctctaactcgggggctggctcggggcacacacgggtctccccaggtctctggacatcggttgggtccgggatgggtcctaatctatagcagtccgaagttctcccacacggctctgggccgtggaactcattaaacttgtggcacagaagaaggaacaancatcaattcctggtgaatcgaaggatgtctcgaacaacccaacacaaagtatccggactggctcactcggcaactgggtggactggtgactctcttggctgaatggtgggnccacggcacgaaccaagaacgcggacttggtggtgccctgtaatggccaacaacgtttcctggggtaactggaaggacaaccttggtggatttccacttaaagggcgcactgtgattggacttccacaggccttcaatccgaagggcggtggtttggcctccgaaaggtgtaaaaaggatggccagcgggagaaccttgaaatcctgcaggaacagttgtacccttgaagccatagaaacagaaccaggcggtggtcccgggaagtttacgggccacccccaggttacgaacgtaggtccacgccgcaggatgcaaaaaggtggtcaccggagccgggttttgcaatgaccctcgggaacaacacaaccccggggggggccccccctcgccagggacgtaacaagcgcggtacacgggggaaccgtggcactacgacaccctgcgagacgcagcacccgacggggaatatctttcgccccagaagaccactanngcgcgcccacgagccggc

SEQ ID NO: 592835 - DNA, 1209 bp, Homo sapiens
tctggtagacacaggatagataactctttggatagcatgtcttttcttctgttaattagttgtgtactctggcctctgtcatatctgcgacaatggtgctcatttcatggggtattatccattcagtccatcgtagcgtgcatttgcacaggtcttgatcctgttttcagcacatgatgcgacatttcatgtcattcccagttagtttcattacttcatttaggggttgccatccagcacaatgtcttggagcacatcacattctttggattcatgcacgtgcttctccttcaccactcaggcaaccattggcaccattcaagcgatccaccaaatgcattattcacaccacattgtgctccaggtctgcaactccttgcatcggggggcatcccttcgctacccacagctaatccgtgccctattgccaggcacaacccagcaatcattgcgtcgcaactcttcgcacatcctcccatatcttccgcagcttaactcttcgcatctggctcctcctccctcagcttccaatggccagcacctgggaatagttctcacgttttcagcccacattgtttcaattcctctggggacagcgtggttcccagggaggtgtcaagggtctgtcacacgattcaaccccgtggtcccattcgactcatccccttggcatcattaagcgatccaacattaaaccaggtaatgggccgcgaggtcccatccacagcctcatttctagatctggggtaaggcgcattccaagggacgacaaacggaccacagggccagaaacagcagctcccgcagaaccccggaaataggactcccccagcagtttgcaggtctcctctccccgtggaagtcacgggcacaccgtatcgggcgtcgaacagacacctcacaacaacgtcctcgacccggtgcggcaacacacggcgaaggcaagcacacagcgcccccctaacagtgacctttttcgttgtgagaccacagctttgttgttgcgtattactccccacaagagtcgagctcacacccacccaatagcgacctactgttcagaaatctctatggagactcgcacggtagcctatgattctatacccccgtctacccgtactcgcctcctctgctgtcacttcatgatatagtgccccatgcgtaaacgaacccgcgacacggctcgacactgtcccagccatcgaccca

SEQ ID NO: 592836 - DNA, 490 bp, Homo sapiens
  misc_feature (360)..(360): n is a, c, g, or t
ggcttgctgcacatttataccttacttttaataacatgcaaatatggccgggtgtggtgctcatgcctgtaatcccagcacattgggaggcggagccaggcagatcacctaggtctggagttcgataccagcctagttagcatggcaaaaccccgtctctattaaaaatacaaaaattagctcggcatggtggtacacacctgttatcccagctactcgggaggctgaggcatgagaatcgcttgaacctgggaggcagaggttgcagcgagccgagatcatgccactgcactccagcctgggagacagagcgagactttgtctcaaaataaatcagtgaataaaaataacatgcagatnagagggcagtttatgcagaaatttctagggaagggggccgggcgcggtggctcatgcctgcaatcccagcacttcgggaggcgaaagcgggcagatcacctgaggtcaggagttcaagaccagcctgagc

SEQ ID NO: 592837 - DNA, 308 bp, Homo sapiens
ttgctaatcctcctcttagcctcacaggtccttgggctgcttcatgcaaacaccaagaagtggggcctccgtactggtagtcattaagtgctgggtgggtccagctgggcctggattttcaaggtcaggctctgggaaaaggcttccagatgcagcaatcagctcacccctccattaggcctagcaagcagccctcaaggcctgggaaactacggaggaaagagagggtgggaagccagaggtggagaagccagggtctcaggtcagctgagccaaaccgactccaggagtagatgatttactgattt

SEQ ID NO: 592838 - DNA, 114 bp, Homo sapiens
tcagtcgagttcaagacctacccatgcaggccacacacgaacacgacgccctgcgccaggccaatgcacgagatgattgaactaccgacaccagatccaggagctgcgtgtcct

SEQ ID NO: 592839 - DNA, 102 bp, Homo sapiens
atcctgttttgggctgtgtgcaatggtcacgtgaagatgcgaggtggggacgcccctgtgtacggctctgctctgaacgttcctcaacaggacggcacacag

SEQ ID NO: 592840 - DNA, 862 bp, Homo sapiens
gaggggatttagtaagaaaccccacaaaaaaggcaactcatgggccactgggtattgatctgtcgcggaggcggggagtagaaatggacatcttacctcgaatgaaaacgtagtgtgttttttaaaagtaacgatgttggatgggaggagacctctccgtatcgtctaggggcccagggaagagagcgcattgctttccccacgtgccctcttcctcatcacgcctcgtcccccgcggggcgccccccctcatacctcccgccctccacgaatcaccccacccgtcctatacatggcgccacgggtgggggtagaagaaagctccaacagagaatatatcgggaaaaacacacggggacgacgacaacgacaagaccgagagactggagagcgggggaacggaagttaacagtaaacaaattaatcataaacagaagcgacaggaagaagggtgcggccgcgctacacggacccaagagcacgcagcaagacgactcctctcacccacccacccacaccccagcccggaccaacatacacccagcgaccactcatcgacccacgaaaagagcaaaggaaagaccaccacacaccccgacaccaaaccaccgcaccacgcgacaccacataacaccaaagcctagataagaacattgcgacgaatagaagaaatactctcacgtcataaacttacgaatcagaatacgcgcaccccctaacaacaacaggaccaacgagaaagcatgcgaggagccaggtaggtggcgtggagggtgtgtcatcatgaactgatgagaatcggcgggagggagactgaacgaattaaaaactgaatagaaagcaggatagaaagatgataaat

SEQ ID NO: 592841 - DNA, 397 bp, Homo sapiens
  misc_feature (96)..(96): n is a, c, g, or t
cggcaggctgactatagaggatccctacgaactgtgaaggtcggagcccgcccccagtgtggttgctgcagagcccggtgctcagccctgatgtcntggagctgaggcattgctgtggtttgttttatttttggagccttgttctttcaagaagtgtcagggcagccccctcccctggagcctcgtggagggtcatgattcatgaactactcaggttggacgtgagatgccccagaaaggttcaggttccaagtttccaggggatgggaaagataccagggcaagggccttgcaggtggaaggcccccacaacctgggcaatttggcaggctccctttttctgcaaccccttcccaacattgtgcccagccgtgggcttcattcctccttcattttt

SEQ ID NO: 592842 - DNA, 622 bp, Homo sapiens
  misc_feature (64)..(64): n is a, c, g, or t
  misc_feature (234)..(234): n is a, c, g, or t
ttataaaaggggggccgtggagaatattcagcatctttgatgggagcgtcagggtgtgtgtctnaggtgttaaaaagggacatgtggtcacttgtgctttggtcttgtcccccgggtcttcccctttgcatatgaaccgtgaactgtgcatagtgctgggatggaggggagtgttgggcctgtgatcccccctggctaataaggctttaggggatttatttaattaattaattnatttgtttttcctttatccccttaatcatttcccccaaacccaatggcctaaaactggcctgacttggggggaccatgggtttgttttttatgtggctgttgatccccaaatgactgggggggggggtctttctaaaatgggaagggtcataaaaagggcctttacctcagttcctttgggtggactccctaaagcccgcgttggtccaaaacggaggctgtgggcctgggggggtttttctttatacatttttccccccccctagggttcctgttttttctcccggtggcccagagcaacctttccctccccctgccccgtttcccagttgcccccccctttgggggctttaaattgggccccccctttaagttttgatccgggcca

SEQ ID NO: 592843 - DNA, 257 bp, Homo sapiens
  misc_feature (127)..(127): n is a, c, g, or t
  misc_feature (153)..(153): n is a, c, g, or t
  misc_feature (172)..(172): n is a, c, g, or t
  misc_feature (214)..(214): n is a, c, g, or t
  misc_feature (239)..(239): n is a, c, g, or t
tgagacagagtctagctctgttgtccgggctggagtggtgcagtggcgtgatctcggttcactgcaacctccgcctccagggttcaagcggttctcctgcctcggcctcccaaagtgctgggattanaggcatgaaccaccgtgtccggccanatattttcgtcttttgaanactgttatatacatgaaattatatggtatgtagcattttganagcgacttcttttgctatgagtaanacatttgagattcatcca

SEQ ID NO: 592844 - DNA, 164 bp, Homo sapiens
gggagatctacagcccagcaggatcaccagcaccaggaaggcagcatcatgcggccgcccttgtgcaggatgcgcgagacccagttctgtagccgtgcgtggtggcgtcgaacttgcggttgaaccagccgaagaagcccttcttgtcgttgtggtgtcccttg

SEQ ID NO: 592845 - DNA, 373 bp, Homo sapiens
tccctgaactacagcccatttttttatttgaaagattatcacattggggatattaaagttgggctcactattttttaattataattaacatcggggaaaatgaacttttttacccttttgaaatatattacattctggcttcatcgctggagttggtcttgactggcccaagttgaaattctccatccgtaagttattcctcgaataaaagggcttttttggccagtctttctaatttggaaaatttggtttataaaaactgctgcaaaaaactgggcatgggggcacatgcttggagccccagctactcgggaggctgagcccagaaatccaaatcccgcctggccaatgtagggagacccatcctttgccc

SEQ ID NO: 592846 - DNA, 245 bp, Homo sapiens
atctggctccctcttcaataactttgatgataacagtttatttgtgggctgggagcggtggctcatgcctgtaatcccagcactttgggaggccgaggcgggcggatcacgaggtcaggagatcgagaccatcctggccaacacgatgaaaccctgtctctactaaaaatacaaaaaattagccgagcgtggtggtgggcgtctgcagtcccagctacatgggaggctgaggcaggagaatggtg

SEQ ID NO: 592847 - DNA, 1015 bp, Homo sapiens
gccagcttccaactaggtcacaagggcgtgctcggtgaacccagctggatcacacactgcctgtgcacgtcgtcccttctctccctgacgttgacgtgcactttcatggagttggatctagaagcgagtgctggctgtggctgtctccggtggcaggcactaggggaatctgtgtaaccttatgacgcttaaatctaagagttataacatttgtgctagtagtagtgatgaaaagactagaaatttgtgtgcgtagaaaagctgaatgtattagggtccaaaggcatacagagagggttcccatggtacgataggaagagcttcagggctactaaaatggaaataggaggagtctagagtggactcaaataattcttgaacgaagtcggcagagtcttttcatgtatcttgagtgagaaggagtgtctatcagggactatatgagcgtgatgcatattgaatcctatcatgaatctgtgcaagttgtgcataggattgtatcatgtgcaacagatggtgacatctctgaatggcataatggggagtgtgggacctttcatgcttgtgttctgctcactaagctgtgtgcagtgccctgggtgtggggactacttctccctgagaagaacggagtgccttccctaatttgcaaggtgccattatgggcgtccaatgaaccctggaggaggaagggcctcaaactgtgggcattgtatgcctttgtgttggttctgctcaggatatttctggatattacctcttcttggtcaagaattctattctcagggtgtgtaccatgatgtgtctgctaagcacgaacggggttcctgctttgcacgagaatgcgccggggaccacgttgatgactggtctgggaccgcgcttggccatttgtgaattcaggcctcctggggggtttccatacattatggatgtgttggaaactcgtggctcccctccgtggttcagtggggacggcactgcgccgttgtcgtggcacgcaaaacgcggtttc

SEQ ID NO: 592848 - DNA, 369 bp, Homo sapiens
tttaataaaaaattgggaatcccccaaaaggcctcctggtcccaaagtatgcatataatttcagggaatgttcaaatccctggagatgggtccatttatagattccttagggcgggtccccgtttgtgagcccagcggatttttttggtttaaaaatacgaacccctgttaaagtcctttcattttttaaggtacccttccccagctataaagaggggccgccttttaaatttttgaggtgaagaaattttgttatagtcctttaattttgaaaatgaacgtttccgggtatgggataccccctttatcccgagggaatttttaccctttggatgcctttaaaaaggaattaattaattttgaaaatca

SEQ ID NO: 592849 - DNA, 235 bp, Homo sapiens
tttttattacataagaaaggcatcttttctaatagatgttggttgactcagaataaatgttaacatctagaagcaaaacgatacctgaatgattcaactgaactttaaaaaaaattttttgaataggaatgagtgtaaactctagacagtatttctagttgcatatatgagtattttgcctggggtacagcaccctttgggaaatgagtgggccaatcaaaaatggcccacaggc

SEQ ID NO: 592850 - DNA, 278 bp, Homo sapiens
  misc_feature (52)..(52): n is a, c, g, or t
gaagaggtcagaacatgtgtgttactcatttccattcttcagggagtttgtnagggtatttatttgtttagagtttgagtaccacagctttcttctgtctatatttctgtcttagaattcagctgtgccatctctcagtcacctccaacccttccctctccagctactttaaacctccatcttcatcttctcttagctgtgatgttcctcttccatttaataggccccttttcttctgagtattaggtgagttgatttgtggagaagccccttccccc

SEQ ID NO: 592851 - DNA, 356 bp, Homo sapiens
gggctatagcactgcagcagatcattatcatatcgcatccgagcggtgtggagagtcagctcaattacttagacgccggtggggatagcgatgattatggtagcggaggtgaaatatgctcgtgtgtctacgtctattcctacggtacatatatggtggtgcgcacacgatgaagcctaggaagccaattgatatcagtagctcagaccatacctatggtatccaaatggttcgtgtgttccggagtagtagttacaatataggagattattccgaagcctggtaggataagaatataactacagggatgaccgacaaatcagaatagcggaagtatgtagtcattctatggtggt

SEQ ID NO: 592852 - DNA, 976 bp, Homo sapiens
cttgaataacttacgcattggtttttcccatgcaatgagggcggaggaatagcaaagtcgttgtgagagcctgggtcaggcccctgggtgggccagctcctgagatcgtctcgtgtcggagacccttggccacttcatccacctggagcttctcctcctctcacagtgtcattgttgctattggtctgaagctggcaaagtgtgatggacacattgggaatgggggcactggtcgcatcctcagggctacgctatctcgtgagttggtcaattcttggactgaatactgggagacaaccactggctggttgaccgtgtccccaataggagggctcgagcacgtggttagtatgccaacgaagagaactaaatgtaagtcccacccgtcaacgtgttcttcaatgtcaacgatcgtaatccgaatgtgagacatgtcctaatgataacacgctgcagaaggtttatagcgtcacccacgcttgggcgcaccagatccagctgagttatgaacatgatgcatatactaactatttacacatcgaaaatgcttactacaccactgggggttgcattgctggatatagcactgttgtggatggaaacattgtatgagcctgcaagtgctatagtaattcgcgttataaatatgcaggtctgaatctcacttgcctttgcgtatcctgatgtcatataaacgttactccctttcttgtgagttgagttttctattcactagctctacctgaaatgaggttgggtaggcctgattgttgaccctcgtctaatgtacgaagatggagcatgtctgggcctcctgcaccggtgttcagtctcatctgggccaattattgccccgttactcttagtgtgatagactaccacgctggtttatgttcagcgttcccctatattgttgtttcggggcacacaggggtttgagccccgccgttggaacgggcgggcctgttcggaagtg

SEQ ID NO: 592853 - DNA, 159 bp, Homo sapiens
gtcaacgagctggccttcaccgcccgcaagatgatgggctgacggagggccctcgggcagtcgggctcggtcagccgggtgcgttcccaggacaaaggaggctcatgctggatgctgccttagcgtctgggcggcccgagattttccagcaagagcccc

SEQ ID NO: 592854 - DNA, 1401 bp, Homo sapiens
tacctgcgcatcacgcggtgaaggaccacgggctccaggccccgcgggctgacctgcatcctgtgcaagctgtgcagcgtgcactgcagagacccctgtcccagctggccggccacatgctagacccatctggggggggccgcccctccctgtcccgggacgacgccccccagcccacgagcccaccttgctgcagcggggacccccgtcacctcatccagcgctactggctgacgcgtttgctcctacctggcgtgcggcagcggccatgccggccggcacgcctggcacgctatgccgcgcaggctagtacgcccgccgccgtccccaccacgccctcgtgcggcatccgctcctccgcgggcgcgcgcacggcgcggctgccctgctcgagcctctcaagcgcactctccccgtccccagagccccttggctgcacgcccccccacatgcctcggccttcgcgcgcgctcgcagcacggcggcacccaccgtgcgcacgctacgaagctcccccccttgcgcctcccctcacgccctcgtcgttcctcgcccggcccccgtccgtctttcccccgagcccctcgccgtcccccttacgctcccccccgcctcaccccacaccccagcgggccctccccttcccgcaccaacacgcggcacaccggcgccagcgccccactcaccccctgctccgccccttgtacgcggcgcacgacttcgcgcctccgcgacctccccgacccggcccactccccgcccccccccctcccctggcctctcccctcctttcccgtactccaggacccccttgccaccccccaccagcgcgccaccgcaccccctgccgtccgccccgcttcgcgcccccggctcgtcctcgctccccctgcttcccccctccgtgcgcgccacaccgcccgcggtgccaccacgtcgtcgctctgccgcccccgcccaccctccatccacccgacacgtcctcacggctcaccgcagctgtgactccatgtttatcccccccgcaactcgctttccgttccgttgcgtcggcgtcgtcgagtcccgcgctcatggctcacgcccgcgcctgcttgtctcacgcatcgtcggcagcacccttccggcggacacgcccccgcttctactcaccgccgcctgctccgggggcccacacgatccgtctctcactctcgccccagttcctccaaccggctcgacatacaacacgccccgcctgccgcctctcgctcctcgtggcaccgagcccccgctccgcccgcggcgcgcacaaccacacgactcgcccccgcccgccgttggccccccgcccgtcgggtccgagccccgcatcgacgcactcggtggtcgatcacggtccgcccaccagcctcgccggcg

SEQ ID NO: 592855 - DNA, 171 bp, Homo sapiens
  misc_feature (108)..(108): n is a, c, g, or t
atagccggaccaactgtgctgatgactgccagcgttctgacttcgtggcctgtggagggtgaggtgtacttatttgtcacctgaacctaatgtatattctccttgagncccccagattccttcaagctggaagggatggggctgttggtggggtcagggtccaacgaggaa

SEQ ID NO: 592856 - DNA, 140 bp, Homo sapiens
  misc_feature (59)..(59): n is a, c, g, or t
gtttagtaggcattcaccccagcaaggtggttatcactaggctagccactgggcaatanacagcaaaaagatcctcgaacggaaagccaaatctcgccaagtaggtaaggaaaagggtaaatacaaggaagttgctaggg

SEQ ID NO: 592857 - DNA, 193 bp, Homo sapiens
acccctgatcaggagatctcctgagttcatgccaccatggaccttgggtccaactacagcagaactggtgtgtgtgtctcaggcatgagcatgctgctcagtgcacatacgagtgacccagggaattttatatatcgtctaggcgccagagatccctcgagcgaaggggggcatatccagtactgtatattat

SEQ ID NO: 592858 - DNA, 389 bp, Homo sapiens
tctcgagcttttgtctttcattttatagggcccattttgaattttttggtttccaattagggaaatagttggtattaggattaggattgtggtgaagtatagtacggatgctacttgtccaatgatggtaaaagggtagcttactggtttgctccctccgatttcaggtttaaaatgaggaggctctgcggctaggagttcaataaagtgatgtggcttaggtgggcgaaatattatgctttgttgttgtggatatattggaggagtggggattatctgcataggattgaggattggattacgataattagggcaagcgaccccctccatagtttgtgctatcgcgagaccgcgatctcgagaagacatttgttgttacgcgcagacat

SEQ ID NO: 592859 - DNA, 731 bp, Homo sapiens
caacatggtgaaaccccgtctctactgaaaatataaaaattagctgggtgtggtggcaggagcctgtaatcccagctacacaggaggctgaggcacgagaatcgcttgaactcaggagatggaggtttcagtgagccaggatcacaccactgcactccagcctggcaacagagcgagactccatctcaaaaaaaaaaaaaaagggtaaaaaaaaaaagggactcccttaaaatggggaaaaaaaattcttaaaatttggagctgatcccctgtattatagaaaatttaagcgttttctcgaaaagcgtgttctagtgtttggctgtaatttaaggtcttaaatcctctttccttaaggtgggcagaaaacaaggtaccaatttggaggggattattttaagtggtggtacttggggtttctgtcagttagaaaattaaccattattggtgcttacccaaattttcggctgcacaacatgtttccagggttactcattatttctagagtattaagcctcccccatagtttatgaggagttacccgtgaagatgccccttattgggtggacacctgggataatttggtacttgggtgaaaaacatctactcttccggggaaattctttacagggtttttaccattctaaaagaatcgacagactgcccaccatggcaatttgaccgttctaataccctgccaggttggttgcagaaaagaagcggttctagcc

SEQ ID NO: 592860 - DNA, 348 bp, Homo sapiens
tattctttttattttaagtttatttttttgagatggagctttgctctgtcacccaggctggagtgcaatggcaccatctcggctcactgtaacctccacctcctgggttcaagagattctcctgcctcagcctcccgagtagctgagactacaggcatgcaccaccacacctggccaaatgtttttgtatttttaatagacatggggtttcccatgttggccaggctgctcttgaactcctggcctcaagtgatccacctgcctcagccttccaaggtgctgggatataggtgtgagccaccaccccagctgctaactgattttaatgttggaatttggtcgacgcgg

SEQ ID NO: 592861 - DNA, 300 bp, Homo sapiens
  misc_feature (155)..(155): n is a, c, g, or t
agaaggagattcaaactcaatatgctaccatgcctttccaaaattttcaacccccgacattatcttggatcctatggtttctccaaccaattctttgaatttcccagtctcccctatgtaaaaattaacaatttggggggcctcattcctggggntatgctgtaaccaaattattgtcccaggctatatttttgggatgaaaaaaatttgaggaagggagttaaaaaccctcctggggctctcagtgtgccataaaggacagcaactggtgattgtttcaaaaaaataaactttggtgga

SEQ ID NO: 592862 - DNA, 906 bp, Homo sapiens
  misc_feature (227)..(227): n is a, c, g, or t
  misc_feature (621)..(621): n is a, c, g, or t
ggatgcctctgaaatcttcagtttattagagtctgcgcgaaaacctacagaattcataggaggggttacttctacttctcaaagctgggttcagaaaatggaaaccaagacggagtccagtggaatagagacggaacccaccgtgcaccacctgccgcttagcactgagaaggtggtgcaggagaccgtgttggtggaggagcggcgtgtggtgcacgcgagtgggnatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtgagatattctgtgaagaccagagncctggctgcttatttcacccctctatggcctagtgtgtttacatagaactgcacgatatttaattcatgagacttagaggatccagcagccagaccatttctattaaaagtgatgcaataatggtcattttattagtgatcagggagcagcagatgacttaaccaagtctttatgtgtcttgaagtgtagaaaaaggctcagaaacctgtttccctagccacagagaaagaaaaatattcactcacccatccacctagacgtcgacttccagcctagggggatcc

SEQ ID NO: 592863 - DNA, 1869 bp, Homo sapiens
  misc_feature (227)..(227): n is a, c, g, or t
ggatgcctctgaaatcttcagtttattagagtctgcgcgaaaacctacagaattcataggaggggttacttctacttctcaaagctgggttcagaaaatggaaaccaagacggagtccagtggaatagagacggaacccaccgtgcaccacctgccgcttagcactgagaaggtggtgcaggagaccgtgttggtggaggagcggcgtgtggtgcacgcgagtgggnatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccaaaactgtgaaagggggcatttcagagacaagaattgagaagcgaatagtcatcacgggggatgcagacattgaccatgaccaggaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttataaggtagtactgattttagcatattaatgcgatttcttccttgttgtttgctttggtctgtgttcaatccagagagcttaaattgtcattattttgggaagaaaacctgtatttttgttagtttacaatattatgaaatttcacttcaggagaaactgctgggcttcctgtggctttgttttcttagttactttttccgtgccgtgtattttttaattgatttttcttcttttacttgaaaagaaagtgttttattttcaaatctggtccatatttacattctagttcagagccaagccttaaactgtacagaatttccactgtaattaaaactatttagtgttagttataaatagccttcaaaaagagagattctccattacacgatcacctgcatcacagcccatggtgaatgtatgtttctgcatagcgaaataaaaatggcaaatgcactga

SEQ ID NO: 592864 - DNA, 124 bp, Homo sapiens
ctccacagtggcatcgagaggaaagacaggacatacgctctgagaagcgcaaggctggggtgttaataatgcaggcccttgtggaaatctgtgagtgcccctgttcccgctcgattatgatccc

SEQ ID NO: 592865 - DNA, 1983 bp, Homo sapiens
  misc_feature (227)..(227): n is a, c, g, or t
ggatgcctctgaaatcttcagtttattagagtctgcgcgaaaacctacagaattcataggaggggttacttctacttctcaaagctgggttcagaaaatggaaaccaagacggagtccagtggaatagagacggaacccaccgtgcaccacctgccgcttagcactgagaaggtggtgcaggagaccgtgttggtggaggagcggcgtgtggtgcacgcgagtgggnatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccaaaactgtgaaagggggcatttcagagacaagaattgagaagcgaatagtcatcacgggggatgcagacattgaccatgaccaggcgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttataaggtagtactgattttagcatattaatgcgatttcttccttgttgtttgctttggtctgtgttcaatccagagagcttaaattgtcattattttgggaagaaaacctgtatttttgttagtttacaatattatgaaatttcacttcaggagaaactgctgggcttcctgtggctttgttttcttagttactttttccgtgccgtgtattttttaattgatttttcttcttttacttgaaaagaaagtgttttattttcaaatctggtccatatttacattctagttcagagccaagccttaaactgtacagaatttccactgtaattaaaactatttagtgttagttataaatagccttcaaaaagagagattctccattacacgatcacctgcatcacagcccatggtgaatgtatgtttctgcatagcgaaataaaaatggcaaatgcactga

SEQ ID NO: 592866 - DNA, 3441 bp, Homo sapiens
  misc_feature (227)..(227): n is a, c, g, or t
  misc_feature (922)..(923): n is a, c, g, or t
  misc_feature (931)..(931): n is a, c, g, or t
  misc_feature (944)..(944): n is a, c, g, or t
  misc_feature (976)..(976): n is a, c, g, or t
  misc_feature (987)..(987): n is a, c, g, or t
  misc_feature (997)..(997): n is a, c, g, or t
  misc_feature (1015)..(1015): n is a, c, g, or t
  misc_feature (1020)..(1020): n is a, c, g, or t
  misc_feature (1026)..(1026): n is a, c, g, or t
  misc_feature (1372)..(1372): n is a, c, g, or t
  misc_feature (1376)..(1376): n is a, c, g, or t
ggatgcctctgaaatcttcagtttattagagtctgcgcgaaaacctacagaattcataggaggggttacttctacttctcaaagctgggttcagaaaatggaaaccaagacggagtccagtggaatagagacggaacccaccgtgcaccacctgccgcttagcactgagaaggtggtgcaggagaccgtgttggtggaggagcggcgtgtggtgcacgcgagtgggnatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccaaaactgtgaaagggggcatttcagagacaagaattgagaagcgaatagtcatcacgggggatgcagacattgaccatgaccaggtagtgtgtgtgagacggtaaataccctggcagagaaacaaagaaaaacctgtggtcctacagtttcaatgctattcctctagtccagcatgtattccgaagaaaattccgaattaactttccaatatatgatttatgattcctttnnaatcatgnacctcattgtaantgtggatatagatctagctcataagtctccanctcaccactgntcatgcatgntccacctccttttgtttntgccnttctgngatttcccggggatagcgctggctcaggcaattaaagaggccaaagagcagcaccctgacatgtcagtgaccaaagtagtggtccataaagagacagagatcacaccagaagatggagaggattgaccagaggtaagaggtgatgccgattctctaggcttgcctaggctggcatgaggcatggggcacttccctctcatccttcacctgatccctcctttcctctgttctctcactggcatttgtgggctggttaccaagaggatggagaatggtttatgggttgtctcacatttggagcttccattcttgtggagttttgcatgcactgcagttagaggataanggangagcagagtctatgcttctatgcttgtgtggtcttcctggtgttcccttttattccatggcctgcactctttgattatccaaatttgtaatggcaaatttgattttacttgccatgtggcctaattggaacaaaggcagttttgctctgagaggctcaatttgtgtgttccaaatactagggaaataatatatacccctttctccttctgatggcaacattatcccgtcgtaagctttctcttcaactgtgtttgattgtaacctgtttatgcttttgtctttagtttgtttttttaatttgaaagctgagcactcactttctttttggatgtcttatatttcctgtattctttgggatgatttttctccctagcgtagcactgtctcagaaggaggcaaaaaaaatgcagtcttgtggtcctgtagaaagcacatacctttccagtgactgtttggccagcatcatgagcagactatatcatctatgtgagcacagacttgtcatgcatagtcacctgccatgcaagatctcatggggccatgagcgtttctgagagggctttgaatgctgaatgcagcagtcgagcgacttgcacaacttggtgatgtgataaaatgtttaagagatttcatatattagtaagttttctaacatcggtttaagaaacaaattgatgagtggcatctcttaaaagagaaatataaaaaatactcattttactcaaatgaataatatattttggacgatagcaaaaaaaataaaacagatttcttccatgagcttcagccacttgggcgttgttgtaattacttaagagaaagcatgtaattggcagtgacttaacgctggaatgtcatggcatcttgtccaaacgagcattctaacttccaggatactttttttgtgtccttgatctgagaaaatctttcagttgttttcaaatgagtaactaatcaaatgtcttttttgcaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttataaggtagtactgattttagcatattaatgcgatttcttccttgttgtttgctttggtctgtgttcaatccagagagcttaaattgtcattattttgggaagaaaacctgtatttttgttagtttacaatattatgaaatttcacttcaggagaaactgctgggcttcctgtggctttgttttcttagttactttttccgtgccgtgtattttttaattgatttttcttcttttacttgaaaagaaagtgttttattttcaaatctggtccatatttacattctagttcagagccaagccttaaactgtacagaatttccactgtaattaaaactatttagtgttagttataaatagccttcaaaaagagagattctccattacacgatcacctgcatcacagcccatggtgaatgtatgtttctgcatagcgaaataaaaatggcaaatgcactga

SEQ ID NO: 592867 - DNA, 525 bp, Homo sapiens
agcggagttccggagtggagggatgaagtccaatcctgcgccaggctccctccgtcccgcccctccggctcccagggggaactcaggcaagctgccgtccctgacctcacctgagagtggagagggacagggaaaaagccttctactcgcagctgcatggttgccccaccgagggcatttattccgcaccgagggggcggggggcagaatgcacgccagaagaacctaatgtgcgctgggtttaaaatatgcaacaacaacgaaaattacaaataaccaaaaaacagcataagaattaaaaacagttatattccaatgttacgaatacttggttcacattaaggatgctctccccagggatccgacggacgctgctggaggcggcagcgatgttagggatcctagagagaaagcatcagaccagactcaggtctggactgtccctcaagtggcccggaggtaccgatattagtgtcaccagccgtcagtgccctgcccagaaataaaacctttgtactgagagac

SEQ ID NO: 592868 - DNA, 884 bp, Homo sapiens
gaggcagatggtgaaaggagagagaggagcgcgctatcctttcctcgctccgctggccgtccaccctggggagagagctttggcaggggagggaaggcggagctcgaggacatgccagctccgacctcccaaggctgtgcgttcctgagggccaggtcgggggcaggcatggaggggaggaaaggcgtccctcttggtcctccaccagaggtggctttcctggtcaccctgtgcctgggtgtctggttctgttattctgtttcttcgcccttgtgttatccagtcaccataacttcccttcctcggggtcgccccggcacgcatgcctgctcggatgatccaccagaggaagacttaatcacagtgtactcaggaggcctcttggtgcatccgcacgcgtccttctagacctccccctcttctcttcccatttgaaagactgacacgctgataggacattcagagctacccggggctagggaatgcccgcggggctggcctgggccagacgcctgtagcaagtacgcctccctgtgcagtctggtctgccactgtgctgcttgtcgtcgtgtactgagaggtctgccaatcggcgcaagatacacagcttgcatcagtaactactagcgatctggaagttgacgcacccttgaaccgcgagcacgtcatagctgagtgcaccagctgggtaactccttatagccagcccttcctttcggccctcgtcccgtcccgggtgccttgacctctctcgacctctctgccttcctgggcgtgactcccttggcagcgccttgtgccgggcgccacgctgggggccctccgggcccggcctcgccccggccctgccggcaggccctcccgtcggcacccgcccattcccg

SEQ ID NO: 592869 - DNA, 2017 bp, Homo sapiens
  misc_feature (227)..(227): n is a, c, g, or t
ggatgcctctgaaatcttcagtttattagagtctgcgcgaaaacctacagaattcataggaggggttacttctacttctcaaagctgggttcagaaaatggaaaccaagacggagtccagtggaatagagacggaacccaccgtgcaccacctgccgcttagcactgagaaggtggtgcaggagaccgtgttggtggaggagcggcgtgtggtgcacgcgagtgggnatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccaaaactgtgaaagggggcatttcagagacaagaattgagaagcgaatagtcatcacgggggatgcagacattgaccatgaccaggaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttataaggtagtactgattttagcatattaatgcgatttcttccttgttgtttgctttggtctgtgttcaatccagagagcttaaattgtcattattttgggaagaaaacctgtatttttgttagtttacaatattatgaaatttcacttcaggagaaactgctgggcttcctgtggctttgttttcttagttactttttccgtgccgtgtattttttaattgatttttcttcttttacttgaaaagaaagtgttttattttcaaatctggtccatatttacattctagttcagagccaagccttaaactgtacagaatttccactgtaattaaaactatttagtgttagttataaatagccttcaaaaagagagattctccattacacgatcacctgcatcacagcccatggtgaatgtatgtttctgcatagcgaaataaaaatggcaaatgcactgaaaaaaaacaaaaaaacaaaaattgtgggcgccggcccgaaaatttaacccttcttgggccgccgataagcatggcctacttgcccaggaccggcgagggtgtccccaaaaccgggccggtcgcaccggggggtcgcaccggcgcacgg

SEQ ID NO: 592870 - DNA, 1929 bp, Homo sapiens
  misc_feature (227)..(227): n is a, c, g, or t
ggatgcctctgaaatcttcagtttattagagtctgcgcgaaaacctacagaattcataggaggggttacttctacttctcaaagctgggttcagaaaatggaaaccaagacggagtccagtggaatagagacggaacccaccgtgcaccacctgccgcttagcactgagaaggtggtgcaggagaccgtgttggtggaggagcggcgtgtggtgcacgcgagtgggnatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccacgggggatgcagacattgaccatgaccaggcgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttataaggtagtactgattttagcatattaatgcgatttcttccttgttgtttgctttggtctgtgttcaatccagagagcttaaattgtcattattttgggaagaaaacctgtatttttgttagtttacaatattatgaaatttcacttcaggagaaactgctgggcttcctgtggctttgttttcttagttactttttccgtgccgtgtattttttaattgatttttcttcttttacttgaaaagaaagtgttttattttcaaatctggtccatatttacattctagttcagagccaagccttaaactgtacagaatttccactgtaattaaaactatttagtgttagttataaatagccttcaaaaagagagattctccattacacgatcacctgcatcacagcccatggtgaatgtatgtttctgcatagcgaaataaaaatggcaaatgcactga

SEQ ID NO: 592871 - DNA, 1897 bp, Homo sapiens
  misc_feature (227)..(227): n is a, c, g, or t
ggatgcctctgaaatcttcagtttattagagtctgcgcgaaaacctacagaattcataggaggggttacttctacttctcaaagctgggttcagaaaatggaaaccaagacggagtccagtggaatagagacggaacccaccgtgcaccacctgccgcttagcactgagaaggtggtgcaggagaccgtgttggtggaggagcggcgtgtggtgcacgcgagtgggnatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttataaggtagtactgattttagcatattaatgcgatttcttccttgttgtttgctttggtctgtgttcaatccagagagcttaaattgtcattattttgggaagaaaacctgtatttttgttagtttacaatattatgaaatttcacttcaggagaaactgctgggcttcctgtggctttgttttcttagttactttttccgtgccgtgtattttttaattgatttttcttcttttacttgaaaagaaagtgttttattttcaaatctggtccatatttacattctagttcagagccaagccttaaactgtacagaatttccactgtaattaaaactatttagtgttagttataaatagccttcaaaaagagagattctccattacacgatcacctgcatcacagcccatggtgaatgtatgtttctgcatagcgaaataaaaatggcaaatgcactga

SEQ ID NO: 592872 - DNA, 133 bp, Homo sapiens
ctgagttgtcctcgcatcccgctgccaggtcagtgtgatctccgcaggtagaagcccaggcccagcacctcagggtggctcatggtcagagatggggtggtgggtcacatgtgtctttggggggtccgcgcga

SEQ ID NO: 592873 - DNA, 1929 bp, Homo sapiens
  misc_feature (227)..(227): n is a, c, g, or t
ggatgcctctgaaatcttcagtttattagagtctgcgcgaaaacctacagaattcataggaggggttacttctacttctcaaagctgggttcagaaaatggaaaccaagacggagtccagtggaatagagacggaacccaccgtgcaccacctgccgcttagcactgagaaggtggtgcaggagaccgtgttggtggaggagcggcgtgtggtgcacgcgagtgggnatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccaaaactgtgaaagggggcatttcagagacaagaattgagaagcgaatagtcatcacgggggatgcagacattgaccatgaccaggcgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttataaggtagtactgattttagcatattaatgcgatttcttccttgttgtttgctttggtctgtgttcaatccagagagcttaaattgtcattattttgggaagaaaacctgtatttttgttagtttacaatattatgaaatttcacttcaggagaaactgctgggcttcctgtggctttgttttcttagttactttttccgtgccgtgtattttttaattgatttttcttcttttacttgaaaagaaagtgttttattttcaaatctggtccatatttacattctagttcagagccaagccttaaactgtacagaatttccactgtaattaaaactatttagtgttagttataaatagccttcaaaaagagagattctccattacacgatcacctgcatcacagcccatggtgaatgtatgtttctgcatagcgaaataaaaatggcaaatgcactga

SEQ ID NO: 592874 - DNA, 407 bp, Homo sapiens
  misc_feature (254)..(254): n is a, c, g, or t
gcacgagggatcacgaggtcaagagatccagactatcctgacaaacatggaaaaaccccgtctctacttaaaaaaaaaaaaaaaaattagctgggtgtggtggtgtgcacctgcagtcccagctacttgggaggctgaggcaggagaatcgcttgaacccaggaggcagaggtttcagtgagccgagatcacaccacagcactccagcctggtgacacagtgagactccatctcaaaaaaaaaaagctgaattnggtcccccgcagtaattgggtcccccgcagtcgctcacgcctgtaatcccagcactttgggaggctgaggccggcggatcacctgaagtaacgagtgctcaatcagcctggcccacatagtgaaaccccgtctctaataaaaatacaaaaatt

SEQ ID NO: 592875 - DNA, 170 bp, Homo sapiens
tgagaccgcgccattacactccagcctgtgtgacagactgagactccatctcaaaaacaaaaaaaaaaaccaacaacaacaaaaaaagatttggactttaagaacaatactgctgtgaactccttggtacttgttccctggtgcttttatgcaagcgttttggagagggt

SEQ ID NO: 592876 - DNA, 190 bp, Homo sapiens
gtgggaggggggggcccccccccccccggagggggttcctttttttttttggggggggttttttggggcccccccccctttttttttaaagggggcccccccttttgggttttttttttttttggggggcccctgggcccccccccccccccttttggggggggaaaaaaaaggggggccgggcccccca

SEQ ID NO: 592877 - DNA, 1875 bp, Homo sapiens
  misc_feature (227)..(227): n is a, c, g, or t
ggatgcctctgaaatcttcagtttattagagtctgcgcgaaaacctacagaattcataggaggggttacttctacttctcaaagctgggttcagaaaatggaaaccaagacggagtccagtggaatagagacggaacccaccgtgcaccacctgccgcttagcactgagaaggtggtgcaggagaccgtgttggtggaggagcggcgtgtggtgcacgcgagtgggnatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccacgggggatgcagacattgaccatgaccaggcgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttataaggtagtactgattttagcatattaatgcgatttcttccttgttgtttgctttggtctgtgttcaatccagagagcttaaattgtcattattttgggaagaaaacctgtatttttgttagtttacaatattatgaaatttcacttcaggagaaactgctgggcttcctgtggctttgttttcttagttactttttccgtgccgtgtattttttaattgatttttcttcttttacttgaaaagaaagtgttttattttcaaatctggtccatatttacattctagttcagagccaagccttaaactgtacagaatttccactgtaattaaaactatttagtgttagttataaatagccttcaaaaagagagattctccattacacgatcacctgcatcacagcccatggtgaatgtatgtttctgcatagcgaaataaaaatggcaaatgcactga

SEQ ID NO: 592878 - DNA, 146 bp, Homo sapiens
gggttttttaaaaaaaaattttgtttttttttttaagccccgggtttgggccattttttttgttccccctttttttgcccccttcccccccccaaaaaaaaaaaattttttttgtttttttttaaaattgggggggggggggccca

SEQ ID NO: 592879 - DNA, 1568 bp, Homo sapiens
  misc_feature (227)..(227): n is a, c, g, or t
ggatgcctctgaaatcttcagtttattagagtctgcgcgaaaacctacagaattcataggaggggttacttctacttctcaaagctgggttcagaaaatggaaaccaagacggagtccagtggaatagagacggaacccaccgtgcaccacctgccgcttagcactgagaaggtggtgcaggagaccgtgttggtggaggagcggcgtgtggtgcacgcgagtgggnatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccaaaactgtgaaagggggcatttcagagacaagaattgagaagcgaatagtcatcacgggggatgcagacattgaccatgaccaggcgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttggttgggatctccatcacactgtctaacaggggacggatttgcaattaaaggggactccaggagagggg

SEQ ID NO: 592880 - DNA, 430 bp, Homo sapiens
gagaatcgcagatacaacctgataacaccaataatcagcagagagagccaaatcaatgagtgaacacccattcaccattgcttcaaagatcatcaagtacctaggaatccaacttacaacggatgtgaaggagctcttcaaggagcaacgtacaaaccactgctcaaggagagtgaaagaggatacgaacaagtcattcatgagagttggcatcaacttcttttaaacttcttttcatgttgatattttaatctcctcccatgaatcattacagttctcaatggcatctagaatggtaaattctttccaggttaataatttatttttaccaaattaatcagagaaatcacaacgtctggtagttatagccttatgaatgtatttattaactcgtaagacttgaacttcaaaattattccttgatccaagg

SEQ ID NO: 592881 - DNA, 147 bp, Homo sapiens
cagcagcacatcgctcccaccaactcaagcaacggccatgccacgaccaccccacggcacatcgcagcaacagcagctcatccacatctgtccatccaagcacacggtgacatcacatttcgtcccagcgtttcacaacagtcacag

SEQ ID NO: 592882 - DNA, 1866 bp, Homo sapiens
  misc_feature (303)..(303): n is a, c, g, or t
tcgtagctcacgagagaacatgtgttatagcaatgcttgtagctgaacctgatcatgacataagagaatgtatcaacattaatcgcatatatcgtgtggcatagattcagagataaatcgggtatcctgtttactcaacaacattacgggatctcggactcgagattgcgagttctcatagaaacccgttgcggaccaaggtgtaggtagaaattatgataagatactgcatctaatatcacgtgttgtgtgtctaagtcgccataccgtttgcctatgcaaaggcgtgagatgatatccgcnataggctaagccgcgattagtcatccatgagattcatcaccctctctacatagcaattgtgaactggtctatagtcatagatcgcatcctggtgtaccgtagaccgggttgtgaaccacaacacaggaaagcgaaagctctatcgatctcctatgctaggtatctcagagccgaattaccgctactgtaggtgtgaataacccacttgtgcggcgctgaggtgctgcacacagaagagccatagtaaccgcacggcaatgtgccattttgcccttgaacggtggacacagtccatttgcgatcacaaataccgataccattacggacataacactgtcccgtgggtggtcacttttctgacctcctttggcctcacgaaggttggttgagatggtgcacaagtacaccccaaatgtagaaaacctttccatacaggataaattaaaccaagcccatctcctctccaccatgtaaagtggaccgctgtccatatacgtgcctagttagatgcggccgagactgcacacgacaaaaactagaccctcttggacggcagtcctcggtcgcaagataacatttgaaccgtttactccataatggtgacctttaccataattccacggtttcagagacatccagggagaaatggcctctatagtttaacactcatactaaatataccgttgaactatgaattgcatgtccttaacaactgtttggggtagaaacgtcaaaacgcgcctcaaagcactaaacggacatatgtcacacctgtacttggtgcagggtggaaaccccacatgacaccgcaagttaggctcaccccgttacactctgaatgtcggcagcatcaaaccaacgttggccttgttccaaaacgaggtgaaagaactcatacatatgggcacaactggccaaagcatagccatagagtaccttgtcgcgatggagccccgggattaaacgaaccttatcaccactgaagcgctatagccgaaaagagcacgcgcacagggaaacacacaacgccccccgatgtgagcacgcgcgcaacgcaacccaccacgaaacataagacacaccacacacagcgccagcatccaccccagcgccgcaaccagccaaacaccacccccgatgaaatggcaaccgacaccacaatgacgaacaaacgagaaaaacacacacaacgcaaacaacaaaaacacacaagccgcaacagcccacagccaaatgcgagacacacagcgggataggaggcgaccaacacacacgaaagaaaccaaccaagacgagaagagaccagcgaaccagcatagcgacgaggagccgaccacaaaagaccaggaacgaagcgagagaatagaagccaaacgagaaataaagagacaagacgcgcgacacaaaaaaacgaacagacagacgagccgaaagcagcagaagacacgaagaagacaagcacaagagacaacaaataagacgagacaacgactgaccaaatagagcaagagagcacagcctcgaccatgagagaagggcaagctaacgagccagccgacagct

SEQ ID NO: 592883 - DNA, 672 bp, Homo sapiens
  misc_feature (44)..(44): n is a, c, g, or t
  misc_feature (62)..(62): n is a, c, g, or t
  misc_feature (92)..(92): n is a, c, g, or t
  misc_feature (106)..(106): n is a, c, g, or t
  misc_feature (110)..(111): n is a, c, g, or t
  misc_feature (113)..(113): n is a, c, g, or t
  misc_feature (116)..(116): n is a, c, g, or t
  misc_feature (119)..(123): n is a, c, g, or t
  misc_feature (125)..(125): n is a, c, g, or t
  misc_feature (127)..(127): n is a, c, g, or t
  misc_feature (129)..(129): n is a, c, g, or t
  misc_feature (133)..(133): n is a, c, g, or t
  misc_feature (135)..(135): n is a, c, g, or t
  misc_feature (138)..(138): n is a, c, g, or t
  misc_feature (198)..(198): n is a, c, g, or t
  misc_feature (237)..(237): n is a, c, g, or t
  misc_feature (240)..(240): n is a, c, g, or t
  misc_feature (245)..(245): n is a, c, g, or t
  misc_feature (273)..(273): n is a, c, g, or t
  misc_feature (276)..(276): n is a, c, g, or t
  misc_feature (280)..(280): n is a, c, g, or t
  misc_feature (291)..(291): n is a, c, g, or t
  misc_feature (295)..(295): n is a, c, g, or t
  misc_feature (323)..(323): n is a, c, g, or t
  misc_feature (325)..(325): n is a, c, g, or t
  misc_feature (328)..(328): n is a, c, g, or t
  misc_feature (358)..(358): n is a, c, g, or t
  misc_feature (380)..(380): n is a, c, g, or t
  misc_feature (394)..(394): n is a, c, g, or t
  misc_feature (409)..(409): n is a, c, g, or t
  misc_feature (562)..(562): n is a, c, g, or t
  misc_feature (580)..(580): n is a, c, g, or t
  misc_feature (582)..(582): n is a, c, g, or t
  misc_feature (633)..(633): n is a, c, g, or t
ctgctggtggaaagggttcagctgctgtgcaaaacgggctgganattcctcagtaagttatncctaagttaccgcatgacccagcaagtccncttatgggtatatncccnngnganacnnnnncntncntccncngtncatggattcacagcagcattactcatcgtagccaaaaagtgctcatcggctgctgaaganacaaattgtggtccaaccttacaatggaatattctttgnccnccaanaggaacgaagcccttgacacctctgacngcntggncgacccttganaacntgatgctaagtgaaagaggccagttgcnanagnccacgtagcgtacaattccattcacatganatgcccagaacaggcaaatccntggagacagaaatngatgagttgttgccnggggctgggggagggcgcatggcgagtgactgctaaggctaggggattctttgggagaggatgacaaacgtgcaggaattagatagtggtaatgcttgcacaacttagggaatatactacaatgcattaaattgtacactttaaaagagtaantgttattatcagtttctnanaatgaaccagaagctcacatagcctgcactggtcagggagactgacgctcnctcaggtgatctggaaggcgtggcccgtgcaggggaagg

SEQ ID NO: 592884 - DNA, 1320 bp, Homo sapiens
cgacctggagctcactgcaacctaccactatcccggagttcaacgtgatctgtaaccacctacagcctcctgaatagctagggattataggtagcatgctaccatgcctgtctactactaaaaatacacaaaattgtttagctctgtatttacataatagaaatagaaaaggtaacaatcgctatattacttctcgaaacagaacaagtataagtaacataccaagaaccggtttcaagtcgactagaatcagcagtagcctgaccctagtacatagctcgtgcttacaaaaaaccctccagcatgacttagctgtctggcagcacacaaccaacggcaagcacaagcccaaatcacagacaactggcaccattctatcctagctacgcttgacccctcatttacgcacaatacacttcaaactttccgcatgtctgaacgcaacatccacaaaacttcacattcgtcaccactatcatagccaaccttcgaacatctctatagctcctctaacaactgaccgcatcccgaatctcctaacaagaacgcgccctcctcaacacaaagttaataaccacaacccccataaacacgctttcaaacattcctaatgctactaattcagacagtccaataatttcatacaaaaacccacagtaacttaaccacccactaaccactttgtcattaaaccacttggttacctcaactatccaaccggcgcaaacgcacacatggacaacgggacaaaacctaataacataacacgaaaacatgcttcctatacacaacactataacatgcaattcaaacaacatcttcactaatcactcaacccataaaatggaatcccaattaacaacattacatgttacattgtaccttcatatcccaaattgtgccattccatcagccctatgatcaccattatactgtacaacaaacccatactacaagggcccctgcaatcaaattcatcagcttatcagactaaacacaaaactgacacgaaacacacatctatctaccaccacaccgtcggtcgagccacgcattcccgccaccgtcataaacacaatcaaccatgacggaacacaatcaacaacataacacgacatacaactaaagatcaaatatacctacaaacatacaattaacaaaaaacaaaataagataacaccacactcgaactacaaaaaacaaaacaacataacatcaccacataacagaaccacttatcactctacccaccaccctacaacacacacatccagcacccacacacacgacgcaaagtaaacaacaatcaacaaaactatt

SEQ ID NO: 592885 - DNA, 106 bp, Homo sapiens
  misc_feature (3)..(3): n is a, c, g, or t
gcntcaccgtacgggctggtactcatgacatgctagtgaagggcctccgccgctggggctgtgatatggagccgggctgacatggtgggtaggcatagtctgcgtg

SEQ ID NO: 592886 - DNA, 147 bp, Homo sapiens
caaccattgccaaataaaaatgtgtgaggtatacaacaatcacacaatattattacaataaacacacggaaacaaggcacgagtaagtttgccagatttgtgagggttctccaactgtgtggtggtaggaggaggaggaattcgccc

SEQ ID NO: 592887 - DNA, 1019 bp, Homo sapiens
ggtcccggtgtgtgcggtcgtttaccacgcgcgtttcttggagggtttaattgtaggctcgcggtttgtgccccgtggttccccaagcattacttgggcttccccgtgttgggggcccccctgcccagggcaccagtgtttgccggccccgggtccttacccgggcacagggtagcttgatgcccgggtgtgcctgaatggaggggccctctttgtagggcctcccacgggggttctcacggttgtttgtgaccttttgaccccgcgtggtatttgtcctgccccgttgaggtgccgggggcatctacccctgctgttggcgccgggacgaccctctttggggcgtttgattttttttaaggtcttccccgggcccttgtctgtaacacccccggtccgtattgactttcccagacacgtgctcgatgtttatctttgctggttggggcgccccttctgggcggggtgtaccccatctctttcgggcccgcgtacacgttgggctagggagttctcccccagtgcgcatacggggcagcttgtataaattccgcatgggatcactcccatgaacattcggccgctccgggacaatgtgaccctcgagggggtaaaagcagccgcttcatcacttgttttgaggagacccaagatacagcaccctaagaggggtgttgatccgcacctccgatagttggggattcaggcacatacaccggatggtcgcgcacccccgttgttgttaaggtgatctttttgttgcgcaacgagggtcgacagtatctcacgtggtttggggtgttcaaccggggtgtatcccggtgccctgtgtttatttagttctaatttctccctcgttcgataggtagcaacaaagaaataaagggctaggttcttccagggccgtttccaccctgaatgatttgtatttccactttggtattgtgccccccccccccccagaccagggtggttaataaccactagaaaaataaatacaaataaaaaaaaaataaata

SEQ ID NO: 592888 - DNA, 431 bp, Homo sapiens
agtacgcggacgggtccttgtcgtcactattattaacttatttatttatttttttgagtctcgctcgcatcccaggctggagtgcaatggcgcaatctcagctcactgcaacttccgcctcccgggttccagcaattctcctgcctcagcctcccaagtaaccgggattacaggcgcatgccaccacacccagctaattattttgtattttagtagagacgggtttcattgtgttaccaaggctggtctccaactcctgaactcaggcaatccacccgcctcggcctcccaaagtgctgggattacaggcgagagacaccgtgcctggcctgtttttctttttcgagattattatggctgtttagggttccttgcatttccatatgaatagtgatcagttttccatatctgaaaaaagacaaagggaaaca

SEQ ID NO: 592889 - DNA, 684 bp, Homo sapiens
gcagatgggtaaggatgaacctctccctcctttgccgctttagctttagctggcaaacaaacctgctctgtaacctcttctgttacttcgttatactccccttcctcctcatcatcagtgtgaaaaggttccaaggtggaatgaaccagagtccacccttgtcccattgttaccttgatgcctccgagctccccttcttactgaccatggggactgctttaagagtactcgggtgtcctccagcttagttccacgttctccaactgtcgctctggtgatccttcgacctggattcgagcccccacgtatgggcgctgcttgccgagaccagcttggtcagggagacactaacccagtggtgctagaggaattaaagacacacgcacagaaatatagaggtgtggagtgggaaatcagggatctcacagccttcagagctgagagcttcgaacagagatttacccatgtatttatcgacagcaagtcagtgataagcattgtttttatagattatagattaactaaaagtattccttacaggaaacaaagggatgggtcaaaatgggatggtttagctagttatctgcagcaggagaatgtccttaaggcatagattgctcatgctattgtttgtggttgaatgccctttttggtttctgccctgggtatgccgtgttttttgct

SEQ ID NO: 592890 - DNA, 596 bp, Homo sapiens
  misc_feature (380)..(380): n is a, c, g, or t
  misc_feature (566)..(566): n is a, c, g, or t
  misc_feature (577)..(577): n is a, c, g, or t
atggatgtaaattggatgtaaatattcagtttatataattatatctaatttgtacccttgttgaaattgtcatttatacaataaagcgaattctttatctctaaatatgatgaagttttcttaacatgataatttttagttaaaatctgtgtattaactgaggtccaaattgtttacctctcatatgtaaacagatgttaccactgtttacatgcactatctactcttgggaaaataccatggtcattaggagcatgctgaaacatcacagggcatgtattgcctagctttcttcattctgagtctttggcattgctaacttttaaggatgagaatgtcacacatacttattgtatctgcagtactagcacaaggcctgngtcctagtccagtgcctggcacctagtaaataattgttgaaatgaattgaaagctgtgaatatttttcaaagaaacgtcctagattacagtggtggcattttctttgtcacagtattccaggataggatatgtttctgctttcaggttaagtaggagaattaaagtagaaatggaaagagaagtgngaaggactggnggatttaaaggaagagaaa

SEQ ID NO: 592891 - DNA, 1687 bp, Homo sapiens
  misc_feature (116)..(116): n is a, c, g, or t
gatgatgccgagaacccctgtgtcacggctatgagaagatttcatggaaaacttttctcaagtattctgaagaagttttagctgtttttaagagttataaattagatgaactcagncctcaagcaaacaacagatggcaagacattgcacaaaccaggaggcagaaccatgtcatattttgcgacacacattctttcacacacagtgcacacacagctgcatggcatttcaccaactgcagtgcacagtcaactttcgctcagcaccaccatcctgcttgccagttatctccattattcattcccacatcatctccaaggcggcaggtccaacattccacacaagttcaacactcatgcttattcacactgcatgcagcacatccactttggcattgcacagcatcactcaccaacaatccagtttcatccaactcactccatcttgcaagaacctcccccgcatggcacgaacagcattttccaaagcatggtcagcagcatcatcattcacacaccacctggcatagcaaacacctggcacactccgtggcacacacttatgcacaggtatgccctacagtttctcgtcgcaacagcaacagcaaccatccagcatcacccacaaccctcacgcagcacatcacactcccgcgccagcagcacagcatgcgaccacgcaggtactctcgctcagggcacaaggcaccccccccaaacaacacagttatctggactcggtagcaacatgaagcgcacgttctcagtccccacgggctttcagggcaaactcctttctcgcctctgcattacacttcttcgtcgcacagcacctgctaaacacatccacctagcaccactggacgcacactacctattgctccctacatactggcaaccgaacactccttctctgaaacagcacagcccctagttggcactccagtgtccaagcaaccccgtgacgaaagacactcaatgcgtctgccacacacatgccaaccttactcatctgcacctgcttaatcccacacttcacacactttacatggacttggcactgcacacccctatcagcacatctatatctatgtacctgggtcgtatagcgctcttatcctttacatttcccacactacacatccaacaccagccagcctagtacaagatcttatcacaacgacacatatctcttttcacagccattatggactacacttaaatgcgtatgagtccattgaatcgttctaccggagcccctctatcatgtgggaaacattactacacacggcgacacgcacttgctacaactaacgcagtctacatcggctgcgccacagtatagggtcactacgcaagtccatcctacgatccaggtgagaacacaccacgtcagtcagccacagcccacctacggagatctcgcagctccatggtgcaaacaatggctcaatgcagaccaccatcgaacgaagtagatcacccgatactgcaccagggacgtagcacgagcagatcacaactagaacaccctctccgctcgcgcccgacggcgactgacggaacgatgtgaaacgccacgataccactgaagcagacagccagaagatcctagccgagcgtaccaacgtatagacatacgactaggtgtcgtacacctcgcctctccacacgacgcgtaagcagca

SEQ ID NO: 592892 - DNA, 246 bp, Homo sapiens
taggcactggggtgcgaaagaagatcacaaaagtcctgtctcacggagctcacgctgtcatgggggggaagacagacatgcatgagttctagaatgtgaggtcaggtgttgagaagaaccctggagggagcagagcagggaaaggtcagaaagggaagacccagggtctctgaaggaggcgtcaggaaagaagtctcaggatgccctgatgtgagcaggacctgagggcaggatggaaagggggat

SEQ ID NO: 592893 - DNA, 893 bp, Homo sapiens
agcggggcttagtctgatttacggctctgctgaaaaccgcttcgctcccgcagcatcagcaccggaggcggcggctgcagcagcagccacaagtcggagactctcttacgcagtaatcgcaagcagacaggcttccgacggaacagcagactactccctggcaggagtcctttgagaatgttgctgtgtgcctgccattccgctgcccgaggtgtggagacataccagatcttagaacgcttgtcatccttgagggcccatctggagcttcagtcacagctacgaagacagaaccctcttgacacaactgccgtctctttccactccctcacaagacactagacctagtcaccttccatcagcaactcctgacacacgggcacgacactatgccagcagcacgtcggcacagacgcgtacacagccgcacacacccgcgcgtacatgtcaaacctcgtcgctacgaagttatcaacactgaacattttccaacggcacacggaaagccaacttatgacagtgcgcgcaacacaacacggaccagcatgatccctacatgctgcactcagccatacacacccgcgcacaccgcgacaccccacacatgcacacaccctcgcaccggccactgcggcaaccacgcgacccgcagcatcccacaggtgctaaacaagcgctcccaccaccataccgcgaaacaacacaaaatcacaccaccacctattacaccaggaaccctcgacactagacacaacaaaccaacgacaagcctgcccaaatcgcacaacgggattccgacgcgaagcctgcgaaccaatcacgcacacccagatgagacagcacacaacacgagtcacccacagacacacacagagaacgtaccccagaacact

SEQ ID NO: 592894 - DNA, 560 bp, Homo sapiens
cttcaacatagtgaaataaacaggaggagggtttcgagctctggatcctcagccatggcaatgtcacaatttaatcccaaaggtttgctgcgaagttgcaagcacgacagtgcgaaactggacagattattcttgaattctttgttcgttttggctgcgacccgactctcataagatttatgctctcttgcaaacccccagggtgggtggccatatgacttacccacacaccaacattgcggcccccccactgacgagccatcacttctacttcgcttcacccgcccactcgcgctttgtatccacctcgcctcccattgtttttatggcggtgcaggattatcctccctgtgcctgcccgcccctcgtgtcctcgcccccccctactttcccccacgccctcccggtccttcatcccattatgttttgtttttcactccgtcatactctcggcttctatccctatcttcctcctccgctccttaccaccccgcccgcttccaccacctccgacccacagagcgtacgcgctccgtctctcctttccccccatctatcta

SEQ ID NO: 592895 - DNA, 882 bp, Homo sapiens
ctgtaatcccagcactttgggaggccgaggcgggtggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaggaaaaagaaagaatttccaccatactgtttatgttggtccgttggtagttactctgggctcactttaacggttttcagtcacactttattaattaacctcaaggactaaattttggtggtaaacatttgggaagaattattattttgattattcagcatttctctgtgccccattcattcttctttccaaccttttttaaaaattattattattggcgggattttaaaaaaaaaaaaaaaaaaaaaaaaaaaaaaaaacaaaaaaaaaaagaaaaaaacaaaaaaagaaaaaaagaacaaaagaaaaataaaagagaaaacaaggaaaaaccaataagaaagagagggggggggcatgaaaactatacaggggcggagcgaatatagtacaaaccaactagtttgtaggaaggggcaactaaagaggtcattataataatgcgggggcgcggcgtagtaaagacggtgtaggaagaagacaactcgtggctgtgttatggaggcacaatctttggtggggaaagtgatgagccccactacagtaaagtcacgtgcgaataatattctgggttggtatacccagtttattggacaaggggggttaaac

SEQ ID NO: 592896 - DNA, 396 bp, Homo sapiens
ccgctatactggttcagtctgggaaactttcttgttggtcaacatcacaccacatttacatctcaatgcccatcctaccttgcactcatacgtatcatgcatccccgcagctacacacacacgaacacacagcacacagcataacacagcacacacacgagcacagcacacacacgagcatacagcacacacacaaacgcacagcacacacagcacacatatgagcacacatgcacacacacaaagggcacatgcccaacacactctcacacatgcacacacatgcacacaaactgcacgtgacacacactgcacacacatgcacaccccgcacacacgcaaacccacagcacacacaaaacgcacagcacacacgcacacacagcacacacacga

SEQ ID NO: 592897 - DNA, 171 bp, Homo sapiens
gcaccatggaaatcctgagtgatgtgcagctgatcaagacgggagacaaagggggagccagcgaagccacgcggctgaacatgctcaacatctcccccttctccttggggcgggtcatccagcaggtgttcgacaagggcagcatctacaaccctgaagatggctgggggg

SEQ ID NO: 592898 - DNA, 807 bp, Homo sapiens
gtggggggacctggcggtggggctggtcctgctatatgccggcgcctcggtagagtgagcggcggcgacgcctctttcctccatctctttccctgtcgctgcgagagcgacgggcggggaggcggtggcggcggcggggccgggatggaggacgttagctccaacgtgaacgcgggccaggaggtgctggaatctgcaggagtctggtgaaggaagcctgagatgctatgaagcgaacagctgtgggcacgcctgttcggtcgcgccgtgctgggtgccggctcccgttgggcccggtaccccggttcgggccggcgcgtccattccctcctctgggcgctgggtcttcctcgggtagcctcccccttgggggctcagcgccgaagtcgtggcgggggggccctggggtcggcgcccgagggtgggacgacgttgcgcgaactaacggctagtggtgccgccacccttccttgctggccggacgggcgaggagcgcttttggtggaccatgttggcagcctgtttggggccccgacggaagcttgacgcgccttgtcacggcttgggacggtcgcaggcaggagcatctggctgttattcattcacccaagtaggtcaaaaaatagaacccttcggcgcgatcaattgtcgggggggcggaacacggtgacgttattgcgcgcaatggccccctgggtgccttgactttggtccccggccccccgttttttgtgccaggggggacaaattccggggacccccaattgggggggcacaatttcagtacgccgggtcccgtataacctg

SEQ ID NO: 592899 - DNA, 872 bp, Homo sapiens
  misc_feature (477)..(477): n is a, c, g, or t
  misc_feature (486)..(486): n is a, c, g, or t
  misc_feature (516)..(516): n is a, c, g, or t
  misc_feature (553)..(553): n is a, c, g, or t
gcacttggggaataagtagccaggcgggcgggcgggcgggaacgccaggcagtggtatgttttaactgggaaaaagtcttccctggaaaacgcttcacttttaacaaacataacgttatgtgcactctcggttttcctacaaaagaactggaaacttgggtgggcgaaccacattcttataggggccccggtgggttactgaactggtggcgttcacggtttcctaaatggtcttcctggctaatgggcagaacacttccttggaacactcttggggcgggtgtgaattcaccacgaatagacacttctgtagatgggctctccattacacctggtgtggatattctccttttagggcccacatgagggaatattatcatctccagagttgggagaggttaccctcgctgggaagacgttaaccatattccttcatcattcaagaccagcatggttcatggggaagaccaaggttcnaccaaattnacaccccaatggttccaacacgtctccttnatagggattattggacatccctcataatggtattggncatggtggtgcacatctcaacacatgggtgggtatcaatgcaaggagaccttgtgaagcatgttacaaccacggcaagcacatccctggtggcatggtccagcacacctttttccttccccaggttcatccaaaattcaagtggaccaaagaaagtgtgtgggaacccaagggtggaaacaatataagacatctcaaaatttgggagtccctttattaggagaaaaggtcttggattgaattttgagttcctttggaagggattcttgaaagttaaattgaatttcgggaagaaaaattggggcttccagcgagggtcc

SEQ ID NO: 592900 - DNA, 409 bp, Homo sapiens
  misc_feature (88)..(88): n is a, c, g, or t
  misc_feature (291)..(291): n is a, c, g, or t
ctgagtttttttttttaagaatttttttattgaggtaaacttcacataacataaaattaactattttaaagtgagaagttcagtgccncttagtattgttaacaatgttgcataaccccccctttatttaaagttccaaaaaaaatgttctcctctaaaaggaaaccccatcccattaagcagatactctccattccttccttcctccagcccccagcaaccaccaatttgctttctgtctctatggatttatctattcttgctattttatataaatcgaattgtatgagnccttttgtgtctggcttctttcacttagtacaagtttttgagatttatttacatagtagcatgtatcaacccttcatttttatggccaaataaaattgtattatgtgtttatagccca

SEQ ID NO: 592901 - DNA, 588 bp, Homo sapiens
actctccccatattgacgcggactaataaactgatttttgttgctatttctccacttttccttcatttttattcatttttttttcattctggagaactagatttttatgtacaactcttgtattgatttttcattccatctatcatatctctaagttcccaaaccattttcttgttctttgattgttccttttttatatagcatcctcttgttgttttgtagacacattatctttgcttgtctgtctgagcatattataatagttttttgaagactattttgcaccagtattgactcagatgtctccaagttcctttttctctactttgtttttgagtgtgctatgcatatctgataatttcatctattttgagatttgttccatctttgtgtaccccaagagacagaatctgaaatgaggatctaagtgcaagaagtttatttgggatgtaattctagaaaacactggcagtaaagtgcagacatgagacagtgaagggaatgaaccaataaaggccgtactgttagttgctcagtccctctagagctcagcatgtcccaattgaaagtgagtgagaaagccggtct

SEQ ID NO: 592902 - DNA, 349 bp, Homo sapiens
gtagagcctgctcacagctcattctaaccttcgaaccgccatcatgcagctcactattgaatcacgcgttcatgtcgcagaggggaaggaggtgcttctacttgtccacaatctgccccagcatctatatggctacagttggtacaaaggtgaaagagtggatggcaaccgtcaaattataggatatgtaataggaactcaacaagctaccccagggaccgcatacagtggtcgagagataatataccccaatgcatccctgctgatccagaacatcatccagaatgacacaggattctacaccctacacgtcataaagtcagatcttgtgaatgaagaagcaacttgg

SEQ ID NO: 592903 - DNA, 116 bp, Homo sapiens
ctgacatgcccaggagctgggtctctgtgttgggagtgtttggccagctgaccctgtgtcccaggaatgggagagtcacagggaagtggcgagggtctcacgtcgtgggcttgctg

SEQ ID NO: 592904 - DNA, 166 bp, Homo sapiens
gatcacgctctaaggttgcttaacttttaacacgtccacgatttaaaaatatctacaattatattagcacacagtctaataataaggaggcagatcggatcccgccatgcttcatttagaggacactggtgatccctgcagcacaagctccatgggcacccacaag

SEQ ID NO: 592905 - DNA, 141 bp, Homo sapiens
tccggttggacgactgctggccgtaccactcatacagggagaacagaaaattcaatgctgaataacacactggcagacattaacagaggcaactaaacaacagctattaaacaataaataggcttgggcacctgtggcatc

SEQ ID NO: 592906 - DNA, 285 bp, Homo sapiens
tgggggttttccccgggggggggaccctttttggggttttttttggggcccccccccccgggggtttatttgggggtttttaggggccttgtgtttccaagggggcttttttggggcccccggtttttttcggtaaaaaaaaagggtctttggggttttccgggggcccaccaggtttttttttttttttggggggggggggggtttttccccccccaagggggggtttttttgggtccccccctttttggtttccccttaggggaaccattttccccttttcca

SEQ ID NO: 592907 - DNA, 175 bp, Homo sapiens
taggcggtcagcgcatgcagcagtcacatcagcatcagggctccggcgtttgtgtatgctatgtttgcggtttcgctgctgtggtctttggagtcgacacctgtgcggcccggtcttcctgctaatgctcggctgccaatggtgcgggcggttgcagtgcgcggtatggtggggt

SEQ ID NO: 592908 - DNA, 999 bp, Homo sapiens
ggacaatggtggcggcggcgacgggcgggcgctcctgaagcagcagttatggagacttcctctcagggaccggggccgtagcggctctttgactcgcaccggcttccgtgtgactgcttcctactgctcgtgctgctgctctacgctgccagtcgaggttctgcctcctcgtcctgcgcctgttcctcgggcatccacggtctgtccctggtcagacgtgcggcgctgccagaaagcgatccttcgcagattcgtagtgcgcgaccagggtgtggcacgatgcgtagggcatcggtgtggccaggcctaggagggtacttccgtggacctccgagtgatccactagatgctcgaggggtcctccattgtccagaccaatggtgactaccatttctgactcgacaaactagtatgtcaattggcgttagccacctggtagactagccccatctactcaatagtccccccagctttgtgtgctggtctcggggcttcagtggagatgaatgggcggggggagttggtggagtcactcaagagattctgtgcgttccaccgagggttccccccactccatctgatgctattcccgtgaggaaggaggcacaatgggcgggaggggctctgcgcttcagttctggcagttctatccaagatgtggtgcaagctcttaccctgcaagttcagagacccctggtctctgtggacgggtgtcagatgctccgtgggtctcaaactgctgtggtcacttttcggcctttcagcggggaccaaggaagggggtgcggcgtgtaatgcgcgctctgggaaccgatgtaggagttggcccccgtgacacgccgtggcgcaggattgggccaccgggcagggcgtccccctggaaggggcgctgttggaaaaaacccattggcgccggacacgatttccacccggagaccaggggagggaggcaccagagtgccacggctgcacaaaccccggaggccacaaggcgcgacc

SEQ ID NO: 592909 - DNA, 340 bp, Homo sapiens
acaatcagacaccagctttcctgagaagtgcagaagagagagccccatagaagcagtggggtgctcagacaggttctgtgggtccacaggggagcagaggctcctgagggcttactcagacagtgaagcagccccccaaaatatacttccccttctcctctcctctctgggttttgcaaccgcagagaagggaagaggtactcgcgttgaccaaggacgtcatactcccgcttgatgatcctctctgcgaatagccttctctggtttgtcctctctgcgtttgaaacgccagagaggaaacagcacaactgataaagcaaacctggacatacacactgga

SEQ ID NO: 592910 - DNA, 553 bp, Homo sapiens
ccctaaaagataattaaatagcttacacagaaaatattattgcctggaagtatatgatctttaagttacaggtctaaaagagttttatgttgttgttgttgttgttgttgttatacaacacacagtgaagaccgtctaataagcaaggccactgttcctcctgttgggacaatgatcctgtctcatacacctgtccttctgctcctttagaatatagaaccagcacagtgtgcacaccgacagcagttactaggggcataatcctccgggtcgcggagggtggagttgaagcagagctcagtggtgtccacaaaaagcattagtcttaggtactgtgttaaaacaatcaagaattcattcatgtttaagaggttaataaccataatattaaaggattaattataaacacctggcaaaaaaccacatcatcccttttcaaaaataaaatgttcatattcctctgagcaaacatcacaagagcagtggccatctgcctcaggcctgccttgtctgtaaacagctgtaaaggaaagctagcacagcgccagggaca

SEQ ID NO: 592911 - DNA, 325 bp, Homo sapiens
ttatatgtggatctaagaaaacttcaaaaattcatccactgggccaggcgcggtggctcatgcctgtaatcccagcattttgggaagctgaggtgggtggatcacaaggtcaggagatggagatcatgatggctaacatggtgaaaccctgtctctactaaaaacataaaaaaaaattatccaggtgtggtggcgggcgcctgtggtcccagctactcgggaggctaaggcaggagaatggcatgaacctgggaggcagagcttgcagggagcctagatcacgccactgcactccagcccgggcgacagagcgagactccgcctc

SEQ ID NO: 592912 - DNA, 255 bp, Homo sapiens
  misc_feature (43)..(43): n is a, c, g, or t
  misc_feature (47)..(48): n is a, c, g, or t
  misc_feature (50)..(50): n is a, c, g, or t
  misc_feature (69)..(69): n is a, c, g, or t
  misc_feature (72)..(72): n is a, c, g, or t
  misc_feature (86)..(86): n is a, c, g, or t
  misc_feature (100)..(100): n is a, c, g, or t
  misc_feature (106)..(106): n is a, c, g, or t
  misc_feature (112)..(112): n is a, c, g, or t
  misc_feature (118)..(118): n is a, c, g, or t
  misc_feature (173)..(173): n is a, c, g, or t
  misc_feature (181)..(181): n is a, c, g, or t
  misc_feature (185)..(186): n is a, c, g, or t
  misc_feature (197)..(197): n is a, c, g, or t
  misc_feature (201)..(201): n is a, c, g, or t
  misc_feature (206)..(206): n is a, c, g, or t
  misc_feature (211)..(211): n is a, c, g, or t
  misc_feature (251)..(251): n is a, c, g, or t
  misc_feature (254)..(254): n is a, c, g, or t
ctgggatggaacttcacccatactctctgttctttctataagnacanngngaaataaaaagtgagaagnagnttcaatcgtaactntgtcaacagtattntgaagngatcanttcttntaaaacttgtaaataaactatcatctttgtagatatcttaaaggtgtaaagtttncaaatttnaagnnatatatattancacngtggncaggnacattccttaaaactaattaaatgtacatttctataatanatnt

SEQ ID NO: 592913 - DNA, 964 bp, Homo sapiens
  misc_feature (105)..(105): n is a, c, g, or t
  misc_feature (305)..(308): n is a, c, g, or t
  misc_feature (311)..(314): n is a, c, g, or t
  misc_feature (365)..(365): n is a, c, g, or t
  misc_feature (383)..(383): n is a, c, g, or t
  misc_feature (385)..(385): n is a, c, g, or t
  misc_feature (423)..(423): n is a, c, g, or t
  misc_feature (435)..(435): n is a, c, g, or t
  misc_feature (439)..(440): n is a, c, g, or t
  misc_feature (447)..(447): n is a, c, g, or t
  misc_feature (449)..(449): n is a, c, g, or t
  misc_feature (456)..(456): n is a, c, g, or t
  misc_feature (471)..(471): n is a, c, g, or t
  misc_feature (481)..(483): n is a, c, g, or t
  misc_feature (485)..(485): n is a, c, g, or t
  misc_feature (490)..(490): n is a, c, g, or t
  misc_feature (492)..(492): n is a, c, g, or t
  misc_feature (495)..(495): n is a, c, g, or t
  misc_feature (497)..(497): n is a, c, g, or t
  misc_feature (502)..(502): n is a, c, g, or t
  misc_feature (504)..(507): n is a, c, g, or t
  misc_feature (514)..(515): n is a, c, g, or t
  misc_feature (517)..(517): n is a, c, g, or t
  misc_feature (524)..(527): n is a, c, g, or t
  misc_feature (531)..(531): n is a, c, g, or t
  misc_feature (536)..(536): n is a, c, g, or t
  misc_feature (539)..(539): n is a, c, g, or t
  misc_feature (542)..(543): n is a, c, g, or t
  misc_feature (553)..(554): n is a, c, g, or t
  misc_feature (915)..(915): n is a, c, g, or t
cagccgccgccggtccgcgcggcctcgggtggccggagctcagcctgcgcgcgccgccctgtgtctccgggtggggcagaagactcgccccttgaacctcccgcngggactctccgtggtgtggcggccctggggctctttcttaatagccccggactgagtcccctccagtcgaggaccctctcctagtccactgacgagcggtggacacctgccgctgtatctcccccagaccgagtccttgccctgctgcctcctcatacccacacggcggcagagaccctcaccatagcgttcgctcaacnnnncgnnnntccgacctccgctagttcctgcgggcctttgcccgcttcccggtgcacccnccccgggagacacctcananccccgacagcctgggcaggctcggtgcctgcgggtgcngttcctgatcancccnnccctctncngtggggntgatggtggattggnttgttttgannntntgtgntntgngngtgantnnnnttgtganntnttggagnnnnctcntaacnagnggnnagtgggtttnncataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcnagcctcctgggggaacggaacatacatggcctgaaggtgaatactcggg

SEQ ID NO: 592914 - DNA, 562 bp, Homo sapiens
ccgtacacaaatatactgcatcaggatatcttttgagtctattgctggtttggaattatgctttttaagttcaaacgttatttactgctttgacataattttagtttgtattgactttttctttttaaggaatgggaatggaaggcataggatctggaataaataaaatgggaggtaagaaatttaaaatgaagtacaagcataatcacttttaggcatagttttctctctttcctcttttctttcttgtttaaaccctgcatgaaattctctttggtttcagtttgagtctagaaatgacttcctcctgcctgtccatccttccagcgggtgtcttggcttttggttctggctgtctcactaactagctctgtgaccttgggcagaccactccatctctatgcctctttttgcttgtctattcattgagggggttggatcagaccagctttttgaagatgggtgatttttaaacaagggtgctagcattttttttgttcttcaaaagcctttaaacttggtcagttcttggcagaagatacccagttgaacatgtgatagg

SEQ ID NO: 592915 - DNA, 303 bp, Homo sapiens
tgtgttaggcatggaccttaaagacgagaaaagattacagaagaaagaaccattatacatccagcatcaagaaaaaaatgaccaacgttgcagaagcaaaaaaagtaatgaagagaaattttaacgtgaatacgaagataacatttactgatgaaggggagttggttcagcagtggccacaaatgcagaactcttttatcacggatgctgaggaagatgatgacacaggtggtatcaacttacatacagcaaaggaaagacttcaagaagaggacaaatttgaccaagaagaatataggataa

SEQ ID NO: 592916 - DNA, 659 bp, Homo sapiens
caacttcgtgcagtacaagtttagtcacttgccatcgaaatgagaggcagacaacgatcgagctggccaagatgtttctgaaccgcatcaactactggcatctggaggctccatctcagcggagactacggtctcccaatgatgacatctctggatacaaggaaaactacacaaggtggttgtgctactgcaatgtaccgcagttctgtgacagcttacctcggtacgaaaccacaaaggtgtttgggagaacattgcttcgctcggtcttcaccatcatgagacgacagctcttggaacaagccagacaggaaaaagacaaactgcctcttgagaaacgcacgcttatcctcacacatttcccaaagtttctgtccatgttggaagaagaagtgtatagtcaaaattctcctatctgggatcaggattttctctcagcctcttccagaaccagcccgctaggaatccaaacagtaatcagtcctcctgttactgggacagcattgttcagttcaaattccacttcccatgagcagatcaatggagggagaacaagtcctggatgcagaggctcttctgggcttgaagcaaacccgggagaaaagaggaaaatgaacaactctcatgctcccgaggaggccaagagatctcgagtgatg

SEQ ID NO: 592917 - DNA, 340 bp, Homo sapiens
  misc_feature (51)..(51): n is a, c, g, or t
  misc_feature (94)..(94): n is a, c, g, or t
  misc_feature (264)..(264): n is a, c, g, or t
  misc_feature (298)..(298): n is a, c, g, or t
cgtggaggtggatgacctgatccaggtcggcctgatcggcctgactgatgngctgtcgcgcttcgatgccgagcagggcgtgcagttcgagacnttcgccacgcagcgcatccgcggtgccatgctcgacgagttgcgcggcggtgactggatgagccgtggcacgcgccgccagcagcgcgagatcgaggtggcggtgcacaaggtcgagcagcgcctgggccgcgcgccgagcgaagccgagatcgcggccgagatgggccngccgctgaccgaataccaggagctgttgtccaangtgcgcggtacgcagctggtgtacctggaagacatgtccggc

SEQ ID NO: 592918 - DNA, 401 bp, Homo sapiens
  misc_feature (9)..(9): n is a, c, g, or t
aatgtgtcnctcgaggtatctattaccctgctgtctatgttagccaaagtacatctgttagcctgctagctatagtgaatcaccatactgaatgtgttagccacagtaaatctattaccctgctgtctatgatagccaaagtacatctgttagcctgctagctatagtgaatcaccatactgaatgtgttagccacagtaaatctattaacctgctgtctatgttagccaaagtacatctgttagcctgctagctatagtgaatcaccatactgaatgtgttagccacagtaaatctattaacctatggtgatctgtaatctatggtccatctgtcagccagtggaaataacttctctacagtcatcactgcatcagtacccagcagtaaatatgtccatg

SEQ ID NO: 592919 - DNA, 188 bp, Homo sapiens
tgcagagtcctggcaagccatagctaggccaccaatcagcttaagaaattctgagaaatctcgctgaccgacactgtaggtgtccagttacttcatcctgcggtcaaggacacccacgggtccttctagttctatgtgaagtgcaaatagttctgtattcctgacacgcttacggatcctctgcgccg

SEQ ID NO: 592920 - DNA, 536 bp, Homo sapiens
agctggggtgctactatgacaatctcggtgcactgactaacctctgtctccctggggcgacagcagatctcgtgcctcaggctcgtgagtagctaggattacaggtgtccacaccacgcccagctaattttttgcatttttagtggagacggggcttcaccatgttggccaggctgatctcaaactcctgacctcaggtgatccagccaccttgtgcttcccgaagtgctgggattacaggcgtgagccaccgtgcccaacctatacagctgtttttaataaagtaacaatatcagactaatcttgtccagagttactcaagtcacaagaacttgaaacagaatgtttggcttcgttgctatatttctgagagctttagaacatgtttcatataaatgctcatgtctctctaagccaatttgaatagaactcctttacgggatttgattaattaacttggtaataccatcagagggagaataatttcacgtatacataacatacatgcgtagacttaccgtatgtatgcataaaac

SEQ ID NO: 592921 - DNA, 395 bp, Homo sapiens
catagaggatccccctgagagtaaatggggcagtgtcaccaaagtcagccctgccctattagtctgctcagccccttgaggtctggagggcggccttggttcccagggcaggggctgggcccagggggctcttcattcttggaaggtgggaggaacatgaggcgaggggatgcaggaggccaggttagtgctaaggggaaggggcatccggccggggcgggtaaggttcacatgcgggggtgcatttcccctcccgcccggacgggattggacagcccccagcggggggagccttaaagccaaggacttgtgtctccattttcctcaagaaaacataagccgcatgaggccagggatgtggtcggtgtacttccttgaatgggagcgaaagggta

SEQ ID NO: 592922 - DNA, 377 bp, Homo sapiens
atgcccacgtacctgtgcctacaagtagactcagtggacccacgcatcgccaacgtcttcaccaatgccttcctgctacgggcacaccctcatccaagccttccttgtcccgcctgggcaatcggtaccagcccatggaacccaacccccgtgtccccctcagcagggtctactttgcctcctggagtttcgtgctggaaggtggcattgaccccatcctccggggctccatggccacccctgccaagctgaatcgtcagaaccaaattgcagtggatgagatccgggagcgattgtctgagcgggtcatgaggattggtctggacctgcctgctctgaacatgcagcgaaggggggaccacggcctcccaggatac

SEQ ID NO: 592923 - DNA, 852 bp, Homo sapiens
  misc_feature (809)..(809): n is a, c, g, or t
tcattttgccaatgagtctgaggctgtggtctctggatccagtcattatgtttttatagaataattaaaccggatgctaacggtgttttaaaaaataataataaaacaacttgtttccttttggccacccccaggaagggctgatttcaaaatctgggggcgagcaacctcaaggaacacaatttccctccctatcaacaagaggattttaacagcaaagaagagaggcagcacctcccattggcagaatgaccgctgagccaggctgggtttgggtttcttctcttctgattctgctgctcactgtcatagccttttgtgtatagtgatgtgtctgtatctttaatgtaaatagagagatgatgaaaaaagagtctattttagtgttaggaagccccagcaggggagtcggaagagcttggaagagctggggagagggtaggggaaaggtttttccaggggccactgggtttgagccctgcttctgtgcacagccacaccaccctctcccgacagccctcaaagacgtagcaactctttctctcaaggtgctaaaggactcagaaggtgcagcacgtccagtgggtaggtacttgttgcatgcaaaagctgtagtgtatctggtccttcctccccagcttttgtgtggggttcttgctttgtgtggtattttgttttcccctctaatgagagggcatggcctgagtcagaagagctaccccaggtgaaactggaagtgcatgaggcagagcgtccgtagcatttccagtttgttctgtataggaacagaggtgcctccgggaaggagnagcgaggtaggtagctatgataggcacctaatgcttctcaagg

SEQ ID NO: 592924 - DNA, 905 bp, Homo sapiens
  misc_feature (307)..(307): n is a, c, g, or t
agggatggaaaaagtgctgaatacaagaaaggaaggttgaattttatatatttgtctataaagtgtcactctgggaataaagcttaaattgtctcacttatttaaaaaacagttccagtttgcccacgtgcaacattagtgagtacctaccctgttcccatgggttctccacccacccgaaacaagcacacactgggacaatctgagggtgctcacgtctgccggtgataaggaggtgttcatttgcatgatggcatttgtgcataaaatggtactgctccagaagtggttctagtgccctgtcttnaccctagtgtggcaggccgatggaacagagcatctgcattgactgccatgcgccgattggaggcattgaccacaaacctcgggacggctttcatctggtcaagtatgtgggtcaggattctatttcctaagtactcaaactttggggtgttgggctgtttttattccagctgataaagtgatactcaagatagtactaattactccagtacatgtgggcctgtgtcatattgaatagcaatgccaaagtcccagcagtcacacagcagggaggcatctgatctgttgttggatccctgggccctgaaatgcaaagcaggctaccctttaacagctgtaatatgaatacaggtgtcttccttttgggccttgggtgcaccttctgtagaactatgcatgacataaacagatgctctaattcacgaggacatctatgtctgcaggaccacaacctgggcatccgtctgtctcagcagatgccatctcacttgccagcaatcttagctttctccattttttattttttgagaaaaatgaaggagacagacatagtcttatgaaataccagccttcagaatccaggtacaaatccgatcggg

SEQ ID NO: 592925 - DNA, 147 bp, Homo sapiens
ccgtagctagggacctgctgtaagaagaaaaagcacatggacaaaatgtatttatagttgtagaaaaactagaagcaactaaagaatagtaacagaggaatagttaggtacaggtgcatccatattacgtggataataagtacatgt

SEQ ID NO: 592926 - DNA, 433 bp, Homo sapiens
tagaggatcgcgtcgaatcgacggtttctctctgatagtcctatgctctcccctcaaaattaaggtaattctttaacaaataactttaacctgtacagtcctacctcaggggtttagaaatagcccacatttattcagacaagttctagtgaaaatctaactgagcaaactcttgagcgggggataacttctgcagtaggtagataacccccttatctgctccccctccacaggactcgcatagcaacatgtggtacaaaccttaactttctaaaagaaggaaaatgacttttgtctaattcaaaggttataaaggtaaagtggtcatttctgggtagggaaggctataacagaagagatattgtcagaaccaaaaaaaaatcttgtcatggtaaaattcttgtccttaaagtcaaaatgcactgcgtggttt

SEQ ID NO: 592927 - DNA, 451 bp, Homo sapiens
gccatatactagtctgtgccctgacacaagaggcccatgtgtaattagtaactggtacatcatctgcttcagtcctcctccatgtgctgctatgccagcgctcacagtggaactcgtgtgttctgtgtggtgcccccctgttggtgcctcccaagtttcgaaaggcttccctcagcacctgggacccaacagagaccatcttctagcacctgcggagcgccgttcagctgtgacgatggcctgaagcacaggattatgactgaagcgattatttccccttccctacttccccttgcggtcctccctgtgtcagggcacagactaggtcttgtgtgctcgtctggcttgcggcgcgaggatggttctctctggtcatagcctgttcccgtttggaagtcccaaaggaggcttacaactcctgcatcacaagaaacaggaagccactgccagc

SEQ ID NO: 592928 - DNA, 204 bp, Homo sapiens
ttctcagttaagcgagagtctattcatgtggaaacgaggctaggtgattaagagagcaaaagggagagtttaaaaacaggattagtgaaaacaaggttgggcattacaacacaaggaacaaaattttgtttagcatcaagaggaaaaagattttggagcaaacgctatggtaccagttttgagggagaaaaggaagaaaaaagg

SEQ ID NO: 592929 - DNA, 301 bp, Homo sapiens
  misc_feature (50)..(50): n is a, c, g, or t
  misc_feature (71)..(71): n is a, c, g, or t
  misc_feature (74)..(74): n is a, c, g, or t
  misc_feature (80)..(80): n is a, c, g, or t
  misc_feature (86)..(86): n is a, c, g, or t
  misc_feature (111)..(111): n is a, c, g, or t
  misc_feature (122)..(122): n is a, c, g, or t
  misc_feature (144)..(144): n is a, c, g, or t
  misc_feature (174)..(174): n is a, c, g, or t
  misc_feature (209)..(209): n is a, c, g, or t
  misc_feature (218)..(218): n is a, c, g, or t
  misc_feature (243)..(243): n is a, c, g, or t
  misc_feature (247)..(247): n is a, c, g, or t
  misc_feature (264)..(264): n is a, c, g, or t
  misc_feature (287)..(287): n is a, c, g, or t
  misc_feature (291)..(291): n is a, c, g, or t
  misc_feature (300)..(300): n is a, c, g, or t
agagagagagagagagagagagagagagagagagagagagagagagagangagagagagagagagagaganctnagtgtntcctanagtacaactacattgtttatggggnttttgctgttntttcaggagctatgtaattaanagtcttctgattctctacttttactttttnagaaattctgcagttttctgcttcttctcaagagnagtagtcancctttatgagatactgagcttggcncctntagcagaggtatcgggncacttttattaaatgcattttcncggnttactgttnt

SEQ ID NO: 592930 - DNA, 339 bp, Homo sapiens
cgtagtcggtgtactcgtaagttcagtaccattggtggcccattgatttgatggctaagggacggaatcgtaggcctcgatctgttatgtaagaggcatgcgtatagatgggagggcgatgaggactaggatgatggcgggcaggatagttcagacggtttctatttcctgagcgtctgcagcatgttagtattcagttcagttttgttgtgcagtgttaggcacaaagggccatacaggcactaggaagcagataaggaaaatgcattcatgcagggcgtgcatcatgaaaggtgcataagctcttctcatgcatcaggggcagtagcgccgtagcgg

SEQ ID NO: 592931 - DNA, 274 bp, Homo sapiens
tgctttaaactgtctcctactttaaaacgaatgtcagctaactaatcatatatctaacttatttgcataaaagacaggctattctattctaataactgcttactcaacactaccaacttttccttatactgtatataattattgcctacaatgttttatttgttatttattaaattgtgattgtctcattattgtttattccaaatgttaactgccaagcttggagtgacctagatgcatttattaaaaagcatgggtcgatttacttcagcta

SEQ ID NO: 592932 - DNA, 301 bp, Homo sapiens
ttggttgtaaacatatgattgttcattttttaaagtaacaatttatttgttctctgatctttattagctctttccttcaactaatttagggtttggtttgcttctgcttttctcatttttttaagatgcatcattagaaggtttaggtgaagttcttcctttttttgatgtagacagttatagctataaacttccctctttgtactgcttttgctgggtttcggtatgttgtgtttccttaatcatttatttcacgaaatttttcaatttccttctcaatttcttcattgacccactggtc

SEQ ID NO: 592933 - DNA, 977 bp, Homo sapiens
tttgactgtgcactcgttcaaccaatcacgccttgaggatagccaatcctatctataggccagagactggatcatgttgttgcaaagaagtctgtcccccatttctcagatgaggataaggatccacagtcaagagaagatgctagacgaaaacccacattacctgttaggcctcaccatggcttatgtgcacctgtaaatggagcccctgcgaatgacagtatgttacctaccctccatcatcatggatacaaacgcagatgtaccgtcgatagcggccttgtccttcataccggaccgatttcgccttctctgctatccctagaataacgagctttcacgatactagcggcccgagcaacggcaatcccgcccgacccccacaactaacccacgccaatgatcaccaactcacacaccttgcctactcaaaccgtccccaatactcctccctctctcacacctcgcacactccccgtcgccttatctttccccacatgcctcgcacacgagttcccttctactctcaactatactgacgctctacccgctcatgcgccatcccacacctctaccgcaccacacctcctctcaacgaccaccccctcacacctctatgctcctgatctcctcgcaacccaccaccacactaccctctctcactattatattatcactgtcatcctccgcagacacaccccgacctccctccctattcatccctctcctaaccgctcctccgcaccccacgctcacctcccccccttgtccgcgtactattccagccctataacccatctcatcaagtatcaccccaccacctcgccccccgccagcgcaccaccgttactcgaatacgcccccgctcttcccccgcctccacgacatccccaccctatattatccccactccttccccccgtcacgtcctccatccacttctaaacctcccccccgccatagatgcgaccgtatcg

SEQ ID NO: 592934 - DNA, 836 bp, Homo sapiens
ggttgagtgcgggtctctgctgcggacgccggggtgcctggcgctggtgttggcctgcccccgtgcctcgcctgagtgcagcgcgcccgaaggccagtgcctgcgctccgatccgcggccctgtgcgcccagtggatgggctgcgggatgtgcctgcctgatgcatgtctgccgcactgctacacctgctggctgcctgtcgctttcggcgtccctgcttccgggccacctgctggcctgccatttttgttcggcgctggaagcagcctgctgggtacgggttgggacacccgaatgctgggaggatgccgccgcggattatgcgtgcctgcctgcgcagtgcctgtcagtccccagctgcgcggtggcagcgtgcgtgttgctcagatgcaaaccaggaacccggagcatggatgtgctgcacaagaatcctcagggcaacacgggggattcacgctgtcccgatccgtttggaaacatggcgactcacggtgaacgcttccaggacgcagactcccgagcaaggcccaaagtgtctactgatttcaaaaagccacatattgaaccagatgtacaagtgatcgttcttagggaaagacaaaggaacctgtattcccaagcgggttgccctttaaaaaccccccgtgtggtcctcccctggaaggtgttacgttgtggctcgggcacaggaggcgtgtcacccttgttgcaggtgcacacacgttggctcctctgtacttatgcgaggagcttggttacctattccttggtgccacggtcggatcgtccacgggttagttcccagtgccacccatggcagtaagccgtgcgttgag

SEQ ID NO: 592935 - DNA, 166 bp, Homo sapiens
gcggctgtcggtcgctgcagcatctcccatggccgcgtatttcgccgtatgggcctcggtcccgagtcccgcatccatctgttgcggaacttgctcacagggctggtccggacgaacgattcagcaccaatggcgcgttttgacgaaatgagggctacggagaagt

SEQ ID NO: 592936 - DNA, 535 bp, Homo sapiens
ggggacatctttttccaaaccattgaccaggtaaagtataggcaatataatttgaaacctgccgcattaaatatagtcccgcaggggaaagatgaaaaatttacccaagcataatatagcagggactaccccttatactttttgcatagtgaattaactagaaatatcttttcaaggagagccagggttaaaacccccgaaaccagacgagctacttaagaacagttaaaagagcacacccgtctatgtagcaaattagtgggaagattattaggtagaggcgacaaacttaccgagccgtgggatagctggttgtccaggatagaatcttatttcacctttaaattggccaacagaaccttataaatccccttgtaaattaaactgtgagtccaaagaggaacagttctttggacattaggaaaaaaccttttagagagagtaaaaaatttaaccaccattagaggcctaaaaccagcccccattaaaaaaagcgttcaagcttaacaccgacttcgtaaaagaattccaaagg

SEQ ID NO: 592937 - DNA, 192 bp, Homo sapiens
gtaaggcctgttcgcacatggatccagcatgaagtacaccattacaaccagaaataggcacacatgcaaatgtgatcggggattgtagccaatatacttaatgtaagtgctgacaaccttaacaatttcctcatatctcttctaggctgtagggtgcctcagtggaatccatttagtagctgctggacgacg

SEQ ID NO: 592938 - DNA, 234 bp, Homo sapiens
gatctgcccaccttggcctcccgaaatgctgggattataggcgtgaccaccaagcacacaccattaggtttctattttatgttagtatgaacaggatgatgccatttattttataaattttatatgtacatttatgcatatacatatttgagttggatggtagacatataaatgaataataaagacatgacccaaaagttttggtgctagtgatctctcaatgatgcaggtata

SEQ ID NO: 592939 - DNA, 175 bp, Homo sapiens
ctcgtcaagtgaacaggtgatactggactagacaaggtactagatatacaggtggtcgtatcagacgccacctacttaggccagctaccgacatgtccagtaaagtccagtgtctgcagcagcctgaacagtgtcaacagcagtgactcccggtccagcggctcccactcgcatt

SEQ ID NO: 592940 - DNA, 111 bp, Homo sapiens
tagtatcctggaacgcgaatcatcttgccgtctttcagtacagctcgtcccccgtcattggtgccacattacagaaagggcacactgagtacccagaacgcagtcatggat

SEQ ID NO: 592941 - DNA, 557 bp, Homo sapiens
cgcaaagggtggtggggtccctaaagcggggggggggtggcaaaaaacaacctttaatttcggagggtccttaaggaggttttggtccaaaaggtttggcaattaaaatggagatttgtgggtttagaaaggaggagtccgtttgcaaataaatggtagtaaaaaagtttttaaataggggcaaagtaaggcctcctggtggttgggggggcatccggccaaagggtggtcaaccaaaacgggaattcctagggttccgaaaaaggttccatggcatggtggacagccagggtttaatgaaggtggagcaacgcgaatgccttgttcggtccaagcagtcaggtggtgacccggggacgtccgtcttagctagagctcagtgcctttttcccgggtatggttagtcacagggattaatgggatgcccgcgctagcttgtcagatgtcaagagcgtagagtcattgctcacgaagtcgataagcctatgttcatcaagttgccaataagtgcatcctttttacgaggattcagtgcctatcacattagtagacatgag

SEQ ID NO: 592942 - DNA, 218 bp, Homo sapiens
agtcactcagtggtagccccagtgtaaatggcctagcctcagttgaatatgtcatgaacagaggagaacaggcttatcttgagtacacaattactgaccagactatgaggcctgaaggtactggtcgatggactaactacctatataagccaactaatgccactgatcctaagatcatcaaagcaggcagtggcctttacgtttgactcctttgctga

SEQ ID NO: 592943 - DNA, 346 bp, Homo sapiens
  misc_feature (122)..(123): n is a, c, g, or t
cttaaaataaacccccacgagggtggtgggtggggttttttaaaccaaaaaaaacccacacaccccctgggggggtcccctgggggggggggggggaagaaaaggttttttttgggaccaanntccccctttgccccccccccccccctttttccccccccccccttttttgggggaaaccccccccgcccccccccccccatttttttttcccccaaaaagcttttttttttaaatttcccccatttttttccccccccttttaaatttttttttttttttttttttttttgggttttttttttttttctttttttttttttttaatttttaaagggggggccca

SEQ ID NO: 592944 - DNA, 933 bp, Homo sapiens
agcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactactagctgaagcccggaatcttcctccactaacagaggctcagaagaataagcttcgacacctctcagttgtcaccctggctgctaaagtaaagtgtatcccatatgcagtgttgctggaggtcttgccctgcgtaatgtgcggcactggaagaccttgtgattgaggctgtgtatgctgacgtgcttcgtggctccctgtggaccagtcgcagaccgagcaggcgtcgaggttgacatacgagcgatcgggcgggacatccagcgccaggacctcagtgccattgcccgaaccctgcaggaatggtgtgtgggctgtgaggtcgtgctgtcaggcattgaggagcaggtgagaccgtgaccagacctagcacaaggagcagcagctgggcctgaagcagccagattggagagtgaggttgccaaccttaagaaagagaccgattaacagttacgacggcagcagcagccgcagccacatctcaggaccctgagcaacacctgactgagctgagggaaccagcttcctggacaaccaaacagcgtcgagccagactaagaaagcctcacaatgggcaagtgggctccgagggagctgccatagatatggtccaagatcgaattgcaagaactgtcgttatcctccctggggatgtggggtcccaaggtgcctgcctgcctcttaggagtcctcagagaggccttctgtagccccgtgagcagatgatcaatcctaggttcaatgacccttcaactccctaacccaaaatagatca

SEQ ID NO: 592945 - DNA, 1141 bp, Homo sapiens
gggttctggaagacggcagatctgccgtgcatttagcgtgaagaggaggcgctgtacctgcagagctgcttttcttgcctagactcttaggaacttatccagagacatcctactcgccacacaacataactcaataggaacgagagagaaccgtggaactcgcgctctgatggggaacccaggaaactgatctgacaggatggcatctgaatgagcatattgactcctagctgatttgacgcgccactgctggtaatgctcccctaataataacaagaagaggatgagcaacaaaggataagaacgttacacataatggattagtcctatgcatgtaccaaccatggcagacacccagggaaacaggttggcacatagagaaccctagtgggaaagcagggcaacgccagtacgtggggagcacagatgcaagtcgttcatgtccgtacgactcggggaatacgagtattagatcggtagcaaatagtactgtgaggcccgaacaagttccgagagtcgcctagttgtccatcaaccggtagaccagtatcttgtggcaatcgatcgacattggaaatgctgaggatcgtgaaagttcgggatccaacctgtcgtgacgagcattcgatgtttccaatttgacatcggcagattccgttcgcaagttgtgccccaactggggataattaggacttgtaaggagctactacgtaacagtagattcctcgaatttccacaagaacgcagaggagaccgcagttcgaaggtaaaggcccgactttgcactagatttgtgaacagtccatggacggaagccggatgactgaccgcgaacccagggaagtcgtggaattgaaaggttagacaagaccgcgaattggcgggccttcgagaaacctggacgggactgtgttcgttctggcatgggagggaaacgtctggcgagttacgacgatatgagacaccaaacatccgcaacagagaaagatgcaaaggggacataccgaaagcgggaaagcgtaggcaaaatccaggcctggtagccctggcccgtcagggcttagcatgggaacacaatcgaagaacatgccaatcaatcggacaaggactaccaggggaccaaaaacagactgagcaagtg

SEQ ID NO: 592946 - DNA, 528 bp, Homo sapiens
  misc_feature (105)..(105): n is a, c, g, or t
  misc_feature (146)..(146): n is a, c, g, or t
  misc_feature (224)..(224): n is a, c, g, or t
  misc_feature (485)..(485): n is a, c, g, or t
aaagggaccccaaacccaaaaggtattaaaaggaaattcaggaaaatgggagacctcgggggtttagaagcctccttaaacatgcataaaatgcaaatggcagancggaaatggttgatcaatttgattacatcaaaaaaatatgnatatcgtcccaaatgccttaaagttaaaagcgagcaaaaaactgggagaaaggaactaaaatatgtatattaccttangtaaataaatgcaaattggggctgagctcagtggtacatgcccataatcccagtgctttaagaggctgaggtgggagaattgcttgagcccaggagtttgacaccagcctgggcaacatagagcaaccccatctctacaaaaaattgaaaaaattagcctataggtggcatgcacctataggcctagctgctcaggatgctgaggtaggaggatcgcttgagctcgggagttcgaggctgcagtgaactatgattgtgccnctgcacttcaacctcaacctgggggatggagcaagacgtttct

SEQ ID NO: 592947 - DNA, 536 bp, Homo sapiens
  misc_feature (163)..(163): n is a, c, g, or t
tgagcctctgttggcggcatatcctggctggaattacatcaatggccaccccacatccaatgctgcgctcttcctcatcgagcgtagacctcaccactggccagccatgaagtttcgcagccaccctgaccattccacctatgcggaggtggagccctcgggncatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgctcgcttcgtcagcacaccccgaatattgaagagggggccaaaaaacaaccacatggattttttataggaacagcaacctaatctcatcctgttttgctgcaccggttctcttctgtgtcttgtagccatgaaacaaaagaagaactaacataactaactccatttttgtttgaggggaaaaggccctgggggct

SEQ ID NO: 592948 - DNA, 1549 bp, Homo sapiens
  misc_feature (1)..(1): n is a, c, g, or t
  misc_feature (133)..(133): n is a, c, g, or t
  misc_feature (139)..(139): n is a, c, g, or t
  misc_feature (865)..(865): n is a, c, g, or t
ngcccctctgtgtgtggcggtgctctgattgcgcaggccgttgggttctagcggctgctttgctgtcgtgctcgactcgaggcgccgttgtgtcgaccaaatgatgcaacgcgccgcctgtggggtttgtccntctacncctccgtcgtcgtgtgtgtccctcgtagtgcccccccctagttcttcccgggggcctctttttctttctgcggggcggggacgtctttggacagacccccctttggtgctgtgagtcgtggaggcatgtggtgcgcccaccccggtctctggtggacttcgcggtgtacgcagcaaacgtgttgtgtgcccccacggcgggaccgccgccaatactccctttgttttatgtggcggtacccagttcctcccgtctcccccggggttaatgaaatggaaaagggggcggttttttctacccacgggggcgaacgaagtgtgtattctgccccagcgaaaggcccccccccaactgggcctgtggtagctcccgcggcataatgtgtgaactggggagtgatatataacctgcggccgggggtcgttgccaccccccctgagctgttcccctttggtaggtggaacggcgcacagaacttgggggacgttgctaaaattcgttgtagacccactaggcctcctctgttgggacttcgtccgttggagggcccccccacgcggcccccaaaggggcccccccttccggctttcaggcctgtgtcccctcatcggatggtgacaccctctgtggttcgctttcgcgacttgagaatgtgtatactggcgccctcatggtgatgtctccgcgcactggagtgggagacagccaccctctctctcttgctgngcagccctcggcccaataatatttctctgtgggagagaaccccccctttgaatacacaggagccgtgccttgtgtcccccctgttgcgctatcctctacggaagttttttctcgccctttcccccctgagatggagaacctctacgctctctatggagcccgttctactttgagggcattgcaccatatctgtcgcagtctcccatgtggagatgttttctccagacgcacctggggacacaagactcgcagcggaagtaatagccccttctgcccaggtggtctataccctttttttgggacacaccgcaccaatatacaccagacctcccatattctctgtgggagtcttgggtctttctcgcagagcccaggagcctttccctttctcccctgagtcccagaattggccaggtgtgactcaccgcagtctcataccaccatggccgggtatacctgggatccctggccagcgtcagtgtagacccacgaacagcatggttcgagagtatctttgtcctgggaagggggccttccacagcaatgtggcgccaagcccttccaatacacagggcacaagaatccttcacagtgaacaatctccttgccatcacccttatgcttgccctgcaacctggcccttacagggagatgggggtcatttaaggaaactgaacccttgta

SEQ ID NO: 592949 - DNA, 396 bp, Homo sapiens
cgagagtcggtcctaccggcgctggtctccccgtatgccttgaggcacgagcatggatggagggagcctgaggctgcatgcagggtatgaccgggacaggcctgggctgcggcagttggaggtatggtcactggtagggcacagagcgttaggcctcatgttgtggggccagggacagtggaggaagggcccatggaagatggggctgcttggtttgaggctggagcgcttcctttgaaatttaattactgtttttcaagtgcgctggctcacagactgtgagaagacctgtgtgaagtgctggtggccacctacccaggtgtccctcccttttgttttggaggcctgtgtccttgtccagtggcagccctccttcccaggtgtggccagaagaac

SEQ ID NO: 592950 - DNA, 306 bp, Homo sapiens
  misc_feature (242)..(242): n is a, c, g, or t
atcgtgtgagctagcaaaaacatttaagttgcaggtacaccttgtcaaaaagatggagaatgtgttacatccatagttcagctaccctcccagcaggctcgagctgtgcattagcgctctcaacttaccacattattgagtgagaatgtcttctaagaaagcaaaaagcctctgaataaaacaagcacactcgagaggcctaaaaaggaaaattgggtgataaagcatattgagagagatgnactaacataaacttggccatacttacatctctaagaactatgcgttaatatttttaatttgtag

SEQ ID NO: 592951 - DNA, 115 bp, Homo sapiens
gagctggcacccgatttgatgtcatctggaatacctcggcaagactgcgccactttcaaatggagcccctgccccattatccgtgaccgccatggattcatatgcaccgagccgt

SEQ ID NO: 592952 - DNA, 147 bp, Homo sapiens
ataaacactaggagagagaactagtacgttgaggccatgcaatccatacgagataggacgacggaacaacagcgccagccagacagtaatgcgctatgtaaacaagctaactaactacgtaggttacaggatagctagcgtaagtac

SEQ ID NO: 592953 - DNA, 364 bp, Homo sapiens
  misc_feature (195)..(195): n is a, c, g, or t
gggaaaagggctggcaccgcccaccccagcagccgtcatggccctgcctggaatcactcgtgggcagctgtagcaaggagtgaaagacaaaaatgatcctgaattgtggcctggaaatatgagctttgtatagaggctcgtggtgtttaatgttcagaatattaaatgtaactgtgatgataatgacagcaactnacattcactgtacgcttactaaatatttttcatatattatttaaattgatcttcatcataagtctgtggtgcaggcactgctctgattcccatttttcaaggggaacccttaaggagggtcaggaatgtgtgggggtctcatggtagtcagcagtggaggtgggcgtta

SEQ ID NO: 592954 - DNA, 1895 bp, Homo sapiens
tgttacactttgtcggagccctctgtaggcctcctccctcctccccacgccttgctctcacaccccatctccgtcgatcccatccatgagtcagtgcaccacgtactctattatggtacctggctcacagaaaacaccgagcccacacatacctgacatcattaccggactagtagacccatccgagaggccctagcctggcaccactggctaccacccaagactacctaccttgccctagcaacccagaacctcaggaaccacccactacctaggacattagcccattcaattctatattagtatccgcacgacagtactctagataagtggatactcacagacacatacgcaatattacacacaccaaaatgcgaacttaacagactttgcacggcaagcgcacccaaattcggtagatcatccaacggcacccattgaacaccgcatgcatccccccaaatcccaccggaaacctcacacgacaactgttataactgacagttacatggatcactacccatccacccagtacactcaatgagactacacaatgagtccataataaatccccgccagttccaacatcccagcacatccttgtgcccacacccataggcagcccattccaagcggagccacccgaaaaaaagcgacacagaacacacactcgcggcactcgactcactcacacatcaacgcgcacacaccgagccacagcatccatgcacagacgcacacaatacacaagacaccacgagccggaaatatccaccacctcggacacgcagtgccgcacaagacgcagcgactccacgtacaggcatcgaaacaacttatacccatattgactacacacacccacgctaccaacaacagcaacggaccacactacagacattggacaactcacgaaaatccgccccatacacactcatgaacaaccaggccaagtcccaccgacaacgcgcagtgaccacaccgactacttgactaacaccgacgaacctcggcgacaaccatactccgccatggcagatacacattaaccatacccactcgacacgcgccacgcagacgcagacgcacaccaatcaccacagtgtacgacaccgaggtcactcgccgcacccgagcagtacaatcacatcatactacaatcaacacttctgcgtatgacaacaatgtacgcacacatcggtggacgacgcaactaaccgccaaacgctgtaggtcccacctcacgacacacatacatacacgcaactggccctgaccaacaagctacatgactgcaggacacatcacccaagaaaacagcgaagagagggaacgagccgcgcagtcgcatcgaagcacacactcgctccatcctactagctagcacgcgtcccccctccatcaccatacacagacgtatacaccacacagagcaacatcactgctccacacaccaacagcggaggcacaacaccaacccagtacacctcactacgctacaacacacactcccaaccaactccgcgcacgtaacacaatacccaaccacactacgtctcccgccgacgcacgcatcgagtcacacacagcgatcacctcgcgcatcacgcacccacaaacacagagacgcgagagcaacacgcagcggaacaacccacccacccacagagagcagccccgagctcacataacacaacgccagaacaaggcaccaccaacgaccagagcacacagaacaacacagccgacacgcagacaaaatcgcacgcaaaacagcctacccgcaccctcacaccgaacggccaacacgcatgatctcaccacgcacgcacatcaacaccgtaactatatgacagcaccacctagtcacagccagctgtatgcaaaagcaccat

SEQ ID NO: 592955 - DNA, 215 bp, Homo sapiens
taacttgcctggcaggctcatcacatttctgtctgcagtggtgcgatgacatgatacttggcatgtaacctggcacagtgcctggggtttccaaaggcgcctcgcatgcctgtttggagcctacattgtggtagtgcaaggtcagaaacatgaacatccacctgaaagggctgtctcccaggtcccttatagcaagccatacagaacccatgccg

SEQ ID NO: 592956 - DNA, 212 bp, Homo sapiens
gcaacttgtaaaactacgctatttatggcatgctgccaacaaaaaccttcacagaagaacaaggagggcaaggtagcatctaatatccagatgagtatatcccagaggatatgcttaagaatatagtagaggacccagatctggagggtgagcctcgagagctggcccaaattctgtagttcagctcaggagccatccagaccccaaagtca

SEQ ID NO: 592957 - DNA, 101 bp, Homo sapiens
agaggaggtgcaggaggctgaagtggggacaagggcaccaaaaagccagtgggggcaggtggtgccggccaaggtcagaggctgatgcaacaggccctctt

SEQ ID NO: 592958 - DNA, 460 bp, Homo sapiens
caagactcatactactaatatatttgagcctaggacataaacaacgaaaagctaaactagatattagacatatatataactaccaaatttaacattaacaagaaataagaataatctctagtagctacagttaaacatcaacagaaagcttcaacagatgattctagaaaataggcaggcacgattaactatttaataagtaaggcaattactataaacctggaaataaggctaaatagcatactaagtcatagtagggtacaacatccacattgcagtataacggtttcccgtatctagcttttatttattttttagcaatgacattaacaagatatagccaggtaataaaaaatagagggctattctagagacttacttatagtataccgagttgaataggcagcgcgcacgtaagccacatactggaggtaggatggatgacatactcccagtactg

SEQ ID NO: 592959 - DNA, 121 bp, Homo sapiens
ctgcaaagggcccagaataatcaggatagaggagtaaataatttgtatcataagtaggctaagcacccaacgccttgccatattgctatggtaggttttcaaatactcgcccccgaaccgg

SEQ ID NO: 592960 - DNA, 527 bp, Homo sapiens
tccactagtgtaggcatcctacatgtagtcttccctgcttaacttctccaacaaagatctttatgattatggagattatatcagaccaaggaggccaatcaagggttgcaggtagaaataggatttgactttgagtgttacagagggaaagcccagtttcctgtgaagcactagctaatattgctttctaagtcaaaactttagtgtaagttaaaaaaagcactcaagggtaactccctgccacaaacgttgggcacacagccagggcactgtgctattagcctcggggtgagcccagattcccagaacatgcaagtcagcatttttcatccaacgatagaggtgtcctgctgaaatctaaaatagaagaaacaggtctaccatctctgcaagcaaggatgttaattagtttttttttttccccagaagaatgttttcatctttcataaagcattatggtcaccagataaatgtaatcatttataatcataaagtacataagctaaggtctatatgccttttttttc

SEQ ID NO: 592961 - DNA, 905 bp, Homo sapiens
cgcagtggctcacacctataatcccagcaccttgggaggccgaggcaggtggatcacgaggtaaggagctcaagaccatcctggcaacatagtgaaaccccatctctactaaaaatacaaaaattagctgatgtggtgacaggcacctgtaatcccagctatgtgggaggctgaggcaagagaatcgcttgaacccaggagtcggagtttgcagtgagccgagatcgcgccagtgcactccagcctgggcaacacagggagactgtgaaagaagaaagaacagaaaagaaaccaaaggaaagaaagagacagagagagagacacagaaacgaacgacgagagagaaagacagaacagagaagacgataaagacagaacagagagacgacaaagacgaaccgagagacgagaagaggaagaggaggacagacggaacgaagagcacagacggaaagaccgacgaacgaccgacaagacatagaaaagaactttcaagttaatgaaatataattcctgagttttgctaaactaagcatttgtcaggcccgtgtaggcgtgcccttcaacacagtgcccagcaatcagtgttctgctctactgcagccccaaggctggagcaaattcctgtagtgctgcctagcatggcatcctttttactgaccaccaaaaacagggcgattgcaagacaggtctattctagcactgtttattcgaatcttggaatcctgtttggaatggctattgcactacaagtccactaaaatgttttagtgctggcatccctcagaagtctttttaaaagaccatcccctaggggaaatgacgggttctgaacaaacggcacatgttgacaagcgccgtccaaccgtgggccactggttctatcagacgcgacggctcgcgga

SEQ ID NO: 592962 - DNA, 373 bp, Homo sapiens
  misc_feature (242)..(242): n is a, c, g, or t
  misc_feature (275)..(275): n is a, c, g, or t
aaaaaatacatggaacacatatattcacttcacccacagtatggcactttgggtccaatacagtagtcgctttaagtttaaaaattctgaatattatagttcacctcttctcttcttttaagacgcttacgcatcttttcggcactggtttctattttcttggttttccgcttttctccctttacagcttgtttttctcttaattccaaagatttcttttagaacgcagatatcgaaaaaanccacgcgttaaatatagcagaatatataaaccncagtattcaaaagaccacccacaacgagaaccccattttagtaaaccaatctccccatagagccagcattacacagtatttttttaacataaaaaact

SEQ ID NO: 592963 - DNA, 290 bp, Homo sapiens
cacgaggccgaaggttacatttccacccttcctggttccagtgtggtgttccactggcctcggaatgactatgatcagctattgtgtgtcagactgacggacgttcccaaatgaatttggtctgtcggatttgaactcaacacaaataattccttccataacaacatgagggataccttcagaaacagcatcttcctacaagtggtaattactctccgaggagctatgtatatgatctcatttagtgacacatatcagttacctcctcctttccgaattgacaacttttc

SEQ ID NO: 592964 - DNA, 253 bp, Homo sapiens
gtggaggatcaggcgtcgcctacaaaggagtggtccctatctagccccaagtctggagcagaaagggcaggtccaatctggcccaagtgacattgttacgatcctgtacccacccccaatcactgctgctatgccaggatgcctcttacacagtacccatgtggcagcagaagtggcagaggcagacgtggacttatagtagatagcagtacagatacatggacacaatcatggacaaacagctcgaggaccc

SEQ ID NO: 592965 - DNA, 271 bp, Homo sapiens
aaacacacacttctccctccgtggccaggacttgtagtaataatcttgaccactacggtaagaagcatactatggtaagggccagtgtggtggctcacgcctgtaatctcaacaccttgggaggtcaaggctggtggaccacctgaggtcaggagctcgagaccagcctggccaacatggtgagaccccccccaacacacccccaccatctgcactaaaagtacaaaaatcagcctggcatgacggcaggtgcctgtaattccagctactt

SEQ ID NO: 592966 - DNA, 128 bp, Homo sapiens
gaactccgcggctgagtaaagcttcggtatcactcacatcagcgcagtcctgctccgaccgaactttccatagtgctcagatcacctgactccttgctctagtgagcctccataacacatcacgccag

SEQ ID NO: 592967 - DNA, 490 bp, Homo sapiens
gaggatgtcgtagcggatcaaataatagaggtcattgctgttctccgtcgctcaaaggctggctgcgcacctagcgcagacaccgatatctgtcgaaacgtaccaagggcctggaaaattacaggctggccacgggcgccgccaatgcacgcccgaacatctcagccacctggtcgacttcgccagcggtgatcaccagcggtggcaggaaacgcaccacactgccatggcgcccgcccagttccaggatcagcccgcgcttgaggcattcgcgctgcaccagcggcgccaactggcgatgcacaggtgggtggccctgactatcaggcgtgccaagtcgggtctaccagctcaaccccccagcatcagcccacgcccaaggatataccccaggtgcgggaagtcgcgctgcaggatgcgcaggtgttcgcccaggcgctcggccatggtcgccgcaatggcctgccaggtcgtgatccgcagggacccc

SEQ ID NO: 592968 - DNA, 1196 bp, Homo sapiens
  misc_feature (123)..(123): n is a, c, g, or t
  misc_feature (198)..(198): n is a, c, g, or t
  misc_feature (246)..(246): n is a, c, g, or t
  misc_feature (300)..(300): n is a, c, g, or t
  misc_feature (328)..(328): n is a, c, g, or t
aagctctgtggtttccaaatcatcgaatgctagagctgaagagggcctcagagagcaagactccagtcaaggaagaaaaagccatctcagaaaaaaaaaaaaaaaaaaaaaaaaaaatcagantcctaaaaacatattaagcaggttttatttctaaccttattattttgcaggtgaggaaactgaggcacaacaatnttaagtgacttgctagttaagcaatgaagccagatttgaacctggacnatctgactgcagaatcagtgctcttaaccattgtttcttatttagcttgctacntggcataaggctcttaaagatagtgacntgatgcagggtttctcaggatacaatctatagacagcattggaacagcagatgttgcaaatgagaaagtcaaactgagttaagcacacctccaaacctacaggtgaggcactaagctctgtggtttccaaatcatcgaatgctagagctgaagagggcctcagagagcaagactccagtcaaggaagaaaaagccagaccagaaacaataaaaagaaaacgagcaaacaaaggagtcacaaagaaacagaactgtggcaaatgacgcattagacgaagaccagcaattccacccacagaggagataccagcgggccaagtgtgagtcagaagggactggtgaggacttgcgcaccagtgagcctacagggaggggcctgccatgtggaaacaggagctgtgcctcagctcctgccatgtggaaacagaggcccaccattgccaggttcccaatttttcaaaaaaagccagatattcacattttgtgtgaaaattcctgttcttgaaagttggcaactaattcaaatctgagcttaggggtaaccccagccaggctagccctatcaggacagggacaaaggtgttcctgtttttggctgtatccccatatgtctggcatatggactttcaataaatatctgttgaatgaattaactaaaatgattaaaatacaacttaaatgtagttcaaaagataaggcttcctgacagaatagcaaaatttgacagtcaccccaaaccctgggctttgtgaaatcccaaattgctgtggaacctggctgaagaaggaggacttcgtaaggagagatggagaaagaagtttaactggagcttaaaaataaaatggctcaggagccctcatatacaacc

SEQ ID NO: 592969 - DNA, 981 bp, Homo sapiens
ggagcaacgcgtaagctcccacgtcgaccgaataccgctcacggctccgactggcacagcaccaccgatcgtgataggttgacaggccagatcgaatgccacaaagccacgccttcaggcatcagaccgtcgttggatcgcattccatctctattgtctcctctaacaatttcaacgatgcgccttgttctaccggacagggggcctgagccacgcctctgacgtaggtcctttaccatcagcacaagcagcccgaagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctaggaaccttgtaaccttgcaagtagcttcaaacggtaggcagctagtttcctcaaatagcacggaagggcagcccaaagtagccgctgccaaccccgctacacaggagtagacaaagttgtgaaactaggaccagttgcttgggaagcactagtccgcaatagggggcacctgtgctagcctccccctctaggcatagcccacggtagccgatagcccacggggcttcacagggcccaaatgcacccagcaaagtgtagtagcgggctactggtgccaacaacagcactgcactagtcaacagcggcaaccagcccagtagcaatagctacccggctctgagcaacgctgcagacccggagtgcctggcacctgtgaaaccttctggctgccaaagctgtagaaggtccgaaatgcgggccgccaccttcaggaccggggcggacccgtcaccgcgccaagtccggggcccccacgcggcccccgccgagcgggcccacacgcccgcacacagtctccaaaaagcgggcccagcgggaaccacaaaccccccgcggaggaaacacggcacc

SEQ ID NO: 592970 - DNA, 877 bp, Homo sapiens
ggcaccggggactcccccggaagggcgcccccagggggccccgaaaaaggccccccggggagacgacacgatatgcgcgaaaagccaaagattctctggcagatcaataagcagaacccggggaacggggccttatgacgagcgcaacgaagggggagaacccgcgtccaccaccgatgattccgggtcggcccccaacgttccgagaagagtcgtaggatctaaaaaacgaccccgaacccggggtcaacgtcggagcacgggctaacagggggtacagaaaaaaaaaccggggccaacggggtggagaaccacgggcaacacccaggcggtggcttttccaggggggaacactattaacacacgaccggggatgtcattggaagacaatatgaaggccgacgccggcaaggcacagataggcaggagagcccccctcgattgtagaagagcgcccgatcaggagggagggccagaatatactgcgcgcacccagctcgcgccgcagaagacttgtgagatacacccgtgtaccggccgctcctccccagagaggaggaccatcacccctccagaggaatagcgtggaaagtggcggccaacataagagaacagttacagtagagagaccaagagggcgccaaccccctcgcgaacaagggtggaaccaccgccgcgagacaagtcgtcggcccccagggatccaccctcctccgggcaggcgaacccccccacgcgtgccagcaggcaaccgggggggcacaaggcaaccatcttcgaactaggtgcccaggtcaagaagacgccacccatgcttgcaaacagccgcgcggcaggccccaaaaacaaaacacccgcaaattcttcccacatgaca

SEQ ID NO: 592971 - DNA, 109 bp, Homo sapiens
  misc_feature (29)..(29): n is a, c, g, or t
  misc_feature (79)..(79): n is a, c, g, or t
gaaccaaccggttgtttggtgaccctacnccagagcctcccccggcccacagagcacagccctccttacagcctagaancaatgacagatctcgtagccgtttgggatg

SEQ ID NO: 592972 - DNA, 127 bp, Homo sapiens
gtaatttcattatcaaattcatttaaaacatgaattacagtacagcaagagaagtgacagcataaagtcttatataattcatgttttaaatgaatttgataatgaaattatactattatcattcttg

SEQ ID NO: 592973 - DNA, 117 bp, Homo sapiens
tcgtgctcggccccccattgtctaaataaattggatccattgtgctattttcaggttgcaatctataacgatttttttctttgtagaatcgtttaactgtagcctcatcatcttctg

SEQ ID NO: 592974 - DNA, 1376 bp, Homo sapiens
tgggtctctctgaccagcaccaggggggtgggcaagaaacaagcgcctttacgaaagggggcaaaagagggagccaagaagaagggtggtttgatccattttctaagaaaagaatgtggtatgatggtgaaagcaccgtgctagtgtttcaatataagaaatattgtggaaaagacgcctgcgttcaccgagaacccaggggaaccaaaagtggcattctgagtggtcctcagagggtcggtggtgttggaaggtgagctctgggcgtgattgtgccacgaaagtgattgaagttgtgccattttagaaaaaattctcaaagcgtgaatatcactgtggaagaattgttctcgaggggttaaacaagcgtgcgcgtgaacctataaacttctcacaaggagccatgtgggaactctttattaccgcgtgtgacaccacaacctgtggtgtttctccccaggtggggttcaacacaaaacagagtgggcccgagacaccacaagtgatactgtgcgagagaccctcccaccgtgtgctgaaagtgtctcgaaagaaaacttcacgcggaagggggggataacaactggggcctctgcggactgcgtggagtcccgtgagagagtgggggatacttattacactactaaacaaaaccaacacgcggcaaacacacaacctccaacagaatatcacggggggaaaagagaacccctctccttattatgtcgcctacaaaggccaagccacaaaaccagggggctcccccggcccaaaaaactccacgggggacacaagaacacagacgtcggaccggcgggaaacacctccatatgggaccccggagaaaaaaggtgtgcgccaagcaccacaatattgggatctttgggcacacagacaaaccgtgcgtggtacacaataaaaattttggtggattctcccccgggaacagcggtctctttgggcgccacccagcagacccttttcaccaacaccagggcggcttgggcccaaaatcccttaatataaaatccccttctccccatgtggaacgggccccaccccgggtcagacaacacaccatggcacaacacctccgcgctgcaacagaaaccccccaaacatgcctgcggacctcgcggggacacacaggccccacggtggagggctacccgggggggcgaaaaggggcacagcaaagaccctcggggcacaaaggccccagtggtggggcacccggagaacacgggggggaccaaacaaggtctgtgaacacacaacgcgtcgtccgtgtcatttatttgtacaccccccagcggctcgcaacaagaaacaccgctgcggtcacaacgggggccaacacacactccacacacatg

SEQ ID NO: 592975 - DNA, 287 bp, Homo sapiens
accttgcctgatgatgaagacgatggtgctgctggagcgtgtcctgctgctatacatgtttagtgggggtgatgctgctgccctggagcgccaagtctacatggaacgctaccaatgccatatgcatggtctggtgcccatcaagacttgtccctttgaggcctgcacacccctcctcatcagcctgtccaccctcatatacaatggtgccctgcgtgagtgtctgtgatgtgggttgatggggcttatgtggggacccaacctgacttggccaacccttctcccac

SEQ ID NO: 592976 - DNA, 260 bp, Homo sapiens
  misc_feature (13)..(13): n is a, c, g, or t
  misc_feature (15)..(15): n is a, c, g, or t
caaataaaacaantnttgtaaagctacaatagttatataccaaagcaatacctattacatgctttacacaatcccatgaaaaaataatttaatagctcctaatccctgatgcaaggcacttcaaagcacccgcacaaaactccatgaaacaacatacaatacatcatttaaataacataaacgactttcacacacttgacctaggaaaaaataaaatccatacaaccacagctaaaaacatgttaagattcacaataaga

SEQ ID NO: 592977 - DNA, 371 bp, Homo sapiens
accaatcctcccacctcagcctcctgagtatctgggactacaggggcacatcaccacgcctactttttgtattttttgtagactcagggtttactatgttgtcaggctagtcttgaactcctgacctcaggtgatctgcccacctcagcctcccacagtgctgggattacaagcatgagccactgcgcccagccgggattctacatttcttttttttttttcccttttttggtgttttgggacagagattacttttgttgccaggctggggagcgaggctgatcttggatcacttgaaccctcccagtcgacgcggacggaaattattattattagtctgcccggggaattcggaccgggacccggggggg

SEQ ID NO: 592978 - DNA, 390 bp, Homo sapiens
  misc_feature (374)..(374): n is a, c, g, or t
gactagagttggatggcgagttccgtacggatgtagcaggataatccgctatctgaggcctggctactctgtactgagccactatagggcacgaggactcaagaccagacctgggaggagactaccgctctgtcgagaagctttacctcgctgaccctatgaaggctcgcagcattctgagagataggcatactgatgggaacttgagtgtatccagatcagacgagatagtatgtattgatgattcaaccagacgatgctgaagatgacaagaagactgacatgttccacagtcatgtaaggcgactgatggtagccaaggctgcccgcaatgagaccatggctgagtgatatggttgaaccgaacactttgncgtgctctcatggcgt

SEQ ID NO: 592979 - DNA, 263 bp, Homo sapiens
agaggccgagaaaatatatcccatagttgctgagtcaattcccagttcatgagacattggcgttgctgccattgagagagttggacgaccaccgtaattaaaagccgtgaccaaaaaaatcatcgcaagaatgtagtcgcgagtttttggtatgcttggctctttgctgagtcacttacagcaatattagtttgcagattatccatatacaaactctttttaataatcgacctatttgcatatccgtgaaataggtgacgtca

SEQ ID NO: 592980 - DNA, 244 bp, Homo sapiens
ttttttttgggggggggggcccccccccaaagggggggttttttcaaaccacgggggggggtttggtcccctttttaaaaaaacccaaagcccctggccccctttttttttctttggttctccctttaaaacccaaaaaggggcccctccccccttttaaaaaggggggggaaaaaggcccctaaaaaaaaaaagggttttcttttggtttgggttttaacccgggaaatttaagggttcccca

SEQ ID NO: 592981 - DNA, 125 bp, Homo sapiens
tgtctcatgctgccttgctgttcgtgccctgtcccaggtgtctgtgttccattttgttgcggctggtgcctgggctttgtcctgggagcactgtcttggagctcatatgtctcctatgcttgtct

SEQ ID NO: 592982 - DNA, 175 bp, Homo sapiens
gtgaagacaggcacccatggattataaacgcacacgttatattctctgtatgctgagtacggagcgaaaacgatttattttggcggctgggagtatgccagtacaattctcaagacattaaagaagaacacgcaagcggttctgcacgcgtgccgggtttattatgcatgtgtcg

SEQ ID NO: 592983 - DNA, 193 bp, Homo sapiens
agaaccgaagcctgcagagaggccattctgacaggctgggaaatgtagcctaccgccagaagctagaagcaagcacttcctcctaaccgagtttttgaaagactaagggaaagagaatagagaagggatattcccatctaccggggaaaagatgcgcagtaacaaaccatctagggagacagccttctaacag

SEQ ID NO: 592984 - DNA, 132 bp, Homo sapiens
aactgggtcaatatcaaggatgccaatggtgcctgtggggccaggcctggcacactgctctgaatcattgaggaatttcagccgtagcacgagtggctcctgcggggagtccggggctgtcggagctgctga

SEQ ID NO: 592985 - DNA, 370 bp, Homo sapiens
cggtagtctcagctattcaggaggctgaagtgggagaccacttgagcccagaagattcagtgagttccctccactccatgatggcaccactgcactcaaacctgggtaacagagtgagaccctgtctcaaaaaaaagagatgttgaagaaataatttctggtatagtttgtatatttgtccccaccaaaatctcatgttcaattgtaatcctcaatgttggaggtgaggtttggtgggaggtgattggatcatgaggacagatccctcatgaatggcttgggccatccccttgtgagaagtgagctctcactctgagttcacaccagatttggtgatttaatgtgtgtggcacctccccctcactctcac

SEQ ID NO: 592986 - DNA, 292 bp, Homo sapiens
gatgactcttgttttagccgcagttgattggcttcggccgggaattgcactggcgtgctgcacagcgcctgatagcgcgcagcataggcgggtgcgtaaaattcgatgctaaggcgttctgcctgtatcgccatgccggccagatcggcaagttgcgcaagccagccgtcaagcagtgaatcgaccacgaagcgtttgtaggcgttgcaggcactgatggaatagaagcgcaaccaagcgcccttgtcatcttacacgaagctggaacggccacgttagttgactgcgtaca

SEQ ID NO: 592987 - DNA, 661 bp, Homo sapiens
cacgcgtcgccacgcgtccgagagaacactaagaggtgaacatgtatgagtgtgtgcgacgcgtgtgagtgtgcactgtgtgtgtgtgtgcaaaggtccagtacaccccggtcctcgcagcccgcaaggggtgtttggcgccttgccctgacatccagcaccactctccccctgagccatgtgtgggggtcgatcatgaatgtccgaagagtggcctttatcccgtagccctgcgccccctttctgtgcgctggatggagtgagacaggtcagaggccccccaccctctgccagcccctgcatgcaaatgactactgtacctggacagtctcctcttctctagaagtctatctatattgtcattctgataacacgtctagcccctgcccttattgggggacagatggtccctgtcctgcggggtgggccctggcaggaaaccatctgcctgatagaaccatggttcctagcccggtctagcgctagtcactctagagcgggccattcacagtgtcttcgacgtcgagtttatcaatataaaaatccgttgccgttaaccaatagacaaaagccacctctgcgtctgatccgtgcctaatcaacagcaggcctacttctcctatctctcccagtctagcgtgctaggatgactatactactg

SEQ ID NO: 592988 - DNA, 744 bp, Homo sapiens
ttctagcggctggatatacaatgatgaataggtctggctactaccttcatggagctcagccttattgaatagatacataagcagctgttctccctggactaggttagatgcccttcctctgtggctcttccatactttgtttaccgatcagcatatctgttgcattgagattacttgtgaattgcctcttcctttagaagctatgctctttcaggacagagcccgtgccctgtgctccataatatccccagctctggctcagtgtcagactcacactgactgctcaataatctttgttgaatgagcaaatgcagtgtgctacatgctattatcaactcttgggcacagcatcatgaaagtgaagagctatcagccgggcgtggtggttcacgcctgtaatcccagcactttgggaggctgaggcaggagaatggcttgaacctgggacgtagaggttgcaatgagccaagattgcgccattgcactccagcctgggcaacagagtcagactccgtctcagaaaaaagtaaagagctatcaaattagttgggtttaatcccatgaatttgcttcctgttgcaaattaatttattccttaaaaacaaaaaatagctttgttccaaaggtctcagttgaaaaattccagcatattaaatatccaaacttgccagaatttggataattttcagcagtaacaaattgagatgtaataaaatgatctaaattaatattttaaagttcaaa

SEQ ID NO: 592989 - DNA, 166 bp, Homo sapiens
  misc_feature (52)..(52): n is a, c, g, or t
ggtctgggtaggcatgtgttagtcaggggtgagatgagtgtgaggcgtattnatacatagcgctagtttaagagtactgcggcaagtactattgaaccagcgatgggggcttcgacatgggctttaaggagttataaggtgggagtccggtaaagagggtatcttt

SEQ ID NO: 592990 - DNA, 157 bp, Homo sapiens
agtaatcgatataccccgatcatcctcaccacctcttcaggtttccttagtacttctatataaactgtgtatccttcgtactttttctgtctcctcatcgactggtcaatagctgcccaatcatccaatccagcatcctcagtatcttcttcttctt

SEQ ID NO: 592991 - DNA, 526 bp, Homo sapiens
  misc_feature (7)..(7): n is a, c, g, or t
  misc_feature (34)..(34): n is a, c, g, or t
  misc_feature (57)..(57): n is a, c, g, or t
  misc_feature (80)..(80): n is a, c, g, or t
  misc_feature (83)..(83): n is a, c, g, or t
  misc_feature (516)..(516): n is a, c, g, or t
aaaaccncctaagggcaaatcaaataccccaacncctcacttaaaaaactgtctgangaaaattcaaggtaaagtgtgcnacngggcctttcccggctcctctctcccagtcatttccctcgtacccagcacaggcattccagaacaagttaccccactgtagaggttgggccttcgggtgttgctgtggacttacagcatatatctgtgttatgtttcagggatgtttaaaagcatgttaaaaatatgtcccaatatttctcttttcctcctagcttattccaagtctcaagagcagctacactgctcagtatcagttcagagaccacaggacagaggtaaacccagcccagccacccccagctgatcctgcagggcactgggaagccaccaaggtcattagaataagtacaggttttaggtcgggtgcagtggctcgtgcctgtaatcccagcactttgagaggccaaggcgggtggattacccaagagtttgagaccagcctggcaaatcgtngtaaaatccc

SEQ ID NO: 592992 - DNA, 272 bp, Homo sapiens
actctatggaatcgggtcgaggcgccccctcgcgtggtcccctggaatgtgacgctcttctcgctgctggtggccgcctcctgcctggagatagtactgtgtgggatccagctggtgaacgcgaccattggtgtcttctgcggcgattgcaggaaaaaacaggacacccctcactgaggctccactgaccgccggttacacctgctccttcctggacgcctacctggctcgctcactcccttgctcgctagaataaactgctttgcgctctc

SEQ ID NO: 592993 - DNA, 371 bp, Homo sapiens
tcggcccgtctgagctgtgactaaagtctcattctcatgtctctctgggctgataaactttgcatacctcacattcctcatactgctgagctatttttttttctcttcataggaccgagtaggttttttttgttttgttttgttttgttttgagacggagtcatccaggctggagtgcagtggcgtgatctcggctcactgcaacctccacctcctgggttcaagccattcttgtgcctcagtctcctgagtagctgggattataggtgcccactaccacactcggctaatttttgtatttttagtagagatgaggtttcgccgtgttggccaggctggtctcaaactcctgacctctggtaatccgcccg

SEQ ID NO: 592994 - DNA, 1054 bp, Homo sapiens
aattccttgcaggatcgctacggttcctactgatccgagctctgtgactcaggcttacgatgcgtgacggcaaccagaactccacagttcccaggctggcggatgcttcgcctatgtggaagctcggggaggatttgttacttcgtatagtagtaggtagtagtgtgtggggtggcctaccgcacggcgctcacatcctgtgcagcgcgagaataggtcagctaccagcccattgtacctctgagctgtaggcactgcagccctatatatacaccctcatcacaccactcctccgctgtgtcagactcttgatccttactgctcctgcaccccacagctagctagctcactatatacctgccatactcgggcaaacggggcgttcccccaaccgaagcgcctccacccactagggctccccagcactatctccccagacagtcaccggcaacagcccgcgcaacggccaccacagcgctcactactcgcccggcctctacaggcgtaccctacaccaagctcacaggcaggccctccggcgcgcccacaaatccctctatgacaacccaacacggagaaaagagccacagacaaacgcgaagctccacggtcgccgcgaccccacgtacctgatggcgcggacaaaccacgccaccgaccggacagttgccaacctacgagccctacatcggctacgccggaccagcacaaccagggaacctggcgagcgacacacggccacaatgcacctctcgctcacgagcagtctcggccagaagcacacgacaccaagacacaagacgcggaacacacatgcgcaccgcagcccacggctgcgaactagtcacaccccccccttcccatcggggacccaccccggcacccgaacccccgcgccctcaaccccccccggccctgccgcgccccgcgcgccaccggcgcggcacaccagggcccccccctgccacccacagggtcgcgccaggccacgccctacggggagggtatgagagccacgcacgcgacacaggacacagacaccccgaccgcagag

SEQ ID NO: 592995 - DNA, 261 bp, Homo sapiens
  misc_feature (63)..(65): n is a, c, g, or t
tttaaaactgcattttgttttttttctgtgaaactacacaagtttacaagtgaggagagaacnnngcgccatgctcccacccccccacccatcacacttccaacctgtcccagtctgcccggatctttaatgggaggggttccactctgacagtcttgtaaaatctgagatgttgagggatcagatggtagctagtcaggagaggatggacagtgtgatgttactttcccacatctgtttgcactctcttcctacatgatt

SEQ ID NO: 592996 - DNA, 648 bp, Homo sapiens
  misc_feature (141)..(141): n is a, c, g, or t
  misc_feature (146)..(146): n is a, c, g, or t
  misc_feature (162)..(162): n is a, c, g, or t
  misc_feature (213)..(213): n is a, c, g, or t
  misc_feature (216)..(216): n is a, c, g, or t
  misc_feature (226)..(226): n is a, c, g, or t
  misc_feature (258)..(258): n is a, c, g, or t
  misc_feature (280)..(280): n is a, c, g, or t
  misc_feature (317)..(317): n is a, c, g, or t
  misc_feature (352)..(352): n is a, c, g, or t
  misc_feature (377)..(377): n is a, c, g, or t
  misc_feature (393)..(393): n is a, c, g, or t
  misc_feature (398)..(398): n is a, c, g, or t
  misc_feature (471)..(471): n is a, c, g, or t
  misc_feature (491)..(491): n is a, c, g, or t
  misc_feature (540)..(540): n is a, c, g, or t
  misc_feature (545)..(545): n is a, c, g, or t
  misc_feature (562)..(562): n is a, c, g, or t
tgggtcatttcaaaaaaaaatgtaaggaaaggggcagaggcataaatcaaaacggagcaaaccctcaggctcgggcaatgagacggggtgtaggcagaggcctgtggggtgaggggtgagtgcgtctagaggaaatgtacngtttngcagataataagtatngatcagacatgcatttttacctctgctgtgggattttagtctcattacttngtngatctacttngtagttaacctagagaagttaacacagccatngctacagagctttctgccactngagttccagaattccagaatccagtttcctagggatngtggggagtaaaaagaggtatagggtatggtcccngtatgggagcaatacagtctttatngagtagtgtctatatngtctngtttactcaagtatttcatatatacattaaaaaaaccgacaataaaaatgaacatatgaaaacttccttattngtgatacatgagtaaatgtngatgagattagagaaggggtccaaaaaggtttctctgaggatatgagtngagtngcccatcaggatggatngggtagtggatgctgatgtgggcaacactggaatagacctcagatgctgcatgatgtgcctgtgtaacacagttgaaatgtccaca

SEQ ID NO: 592997 - DNA, 304 bp, Homo sapiens
gaattgccaggctcagtgccccggctcaagtcaggggtagggtttctagggtcagggatcctttcattcctggccctcagggcattggtctattcccagtctagcagtaccggtcttaggaggtacagagtttggtcagagcttttgggcaaagctaccctccaggtctgtggacatggttatatgccggaaggggtcagggcccaggatggccccatccacttgtttatttgtactgcacctataaatacctttagcattcatgacaaaattaatttttatgaatattatatttcagtctaat

SEQ ID NO: 592998 - DNA, 429 bp, Homo sapiens
cagagtatctctgagggaggtgactaagaagctgaactccagaggcaagacaaaggaattgagtgagcagtatcattctcttaactctgcgagtagggagtctgtgaaggttaatgtatgctctttttgcgagggagaggatccctttatatttgattgtcgtggggatgtgtggccgagagtagagtcagcagtcccgggtgtataggctttcaggtgcattatggttgtgatctgaagaccttggtcacctctgtggtaggtgtcatgggatgctggctacgtgagtgaaggggctcctgtgggttcgtagaagcgagggtgagagaggatggggtggggtgccggtttgacgggagagagctctcaagggagaattttggtacccaacttggaaggtggaaaattgccaagtacagcttcgtgtta

SEQ ID NO: 592999 - DNA, 701 bp, Homo sapiens
  misc_feature (238)..(238): n is a, c, g, or t
  misc_feature (379)..(379): n is a, c, g, or t
  misc_feature (426)..(426): n is a, c, g, or t
  misc_feature (436)..(436): n is a, c, g, or t
  misc_feature (438)..(439): n is a, c, g, or t
  misc_feature (441)..(441): n is a, c, g, or t
  misc_feature (447)..(447): n is a, c, g, or t
  misc_feature (449)..(451): n is a, c, g, or t
  misc_feature (453)..(453): n is a, c, g, or t
  misc_feature (474)..(474): n is a, c, g, or t
  misc_feature (483)..(484): n is a, c, g, or t
  misc_feature (492)..(492): n is a, c, g, or t
  misc_feature (494)..(494): n is a, c, g, or t
  misc_feature (496)..(496): n is a, c, g, or t
  misc_feature (504)..(504): n is a, c, g, or t
  misc_feature (506)..(506): n is a, c, g, or t
  misc_feature (510)..(510): n is a, c, g, or t
  misc_feature (512)..(512): n is a, c, g, or t
  misc_feature (518)..(518): n is a, c, g, or t
  misc_feature (525)..(525): n is a, c, g, or t
  misc_feature (541)..(541): n is a, c, g, or t
  misc_feature (544)..(545): n is a, c, g, or t
  misc_feature (548)..(548): n is a, c, g, or t
  misc_feature (557)..(557): n is a, c, g, or t
  misc_feature (563)..(563): n is a, c, g, or t
  misc_feature (571)..(571): n is a, c, g, or t
gtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaancttatccggaccatccgtaatgccatgaacgattcgtgatgtcaccaagtgcctggaagagtttgagctcctgggaaaagcatatgggaaggccaaaagcattgtggacaaacgaaggtgtcccccggttctatatccgcnatcctggctgacctagaggactatcttaatgagctttgggaagatanggaagggaanannangatgancnnnancaatgccaaggctctgagcancttgcgtcnnaagatccnanantacaaccntnattncnagtccnatatcanaagctacaagcagaanccnnagnagtctgcgnatgaanatgctganaaaaatgaggaggattcagaaggctcttcagatgaggatgaggatgaggacggagtcagtgtggaattttcttgaaaagaaatcagaagtccttctggggagagtcgaagttctcaaagattggatgata

SEQ ID NO: 593000 - DNA, 184 bp, Homo sapiens
gggacctgctatctggcaagattttaagaaaccgaagaaagaaaaatgagaaattcaagattaaaaaatggactgggcatggtagcatgcacctgtagtcccagctacttggttagctgaggcagggttgcttgaacccaagagttggaggccgcagtgtgctataactgccctattagaactg

SEQ ID NO: 593001 - DNA, 831 bp, Homo sapiens
cctttatgttttttttttacagacaagttattaactttttataacccgtgggcccattttgggcctgtggaaaggtggggaggtgggccagggggcacagggccacaggattagcaccccacaattaacttagtggggagcatgatcaccatcacgcccaggctctgcgtgggtcccggggccacagggtaaccgcgccggtggcgggtgtgcgacggtcacacggtggagaagacgcaggggcgaaaagacgcctagagagcagccaacgactggggggccaaaacaagaagccgggggagctgacgggaaaacacgggacgcgggaccccagagagcaaaacggggctagtctccgcagggggggcccaaagacaggggccatgaggcccgtgacccaatggggcatcgggggacctccaagagacaggccgggacaagctgtatggccccaaacgcggggccaagcgcagccggggtgccacaacgggggacacagcgggaggggtgacaaagagggggaaacaccccacagctccccacctcgaggagcaaagaagacggggtacatcacaaggcctggcgcgaaccccggaggcgcaccggccacctacccccaattcccgggctgcgcaccacggaggaagggaaagagtgggcccaggcgagacccttccgagggaccgccacagaagcagccgagcaacgcacagtgggaaaggggttccccgaaatgtcatagaggataggccggcatgcagcaagcgcacacacctgcacacgggggctcggagagggcgggacagagggcacactcagagggaccaatcg

SEQ ID NO: 593002 - DNA, 845 bp, Homo sapiens
gagcagtgcggtggtcccgagggtcggtctctgcgttcaacagtgttgggaactggaacagatccagtggtactctcttccagcctccgacgccctccgattgtcctctcggacgttggcgacctccgggacccagtcattctgcggccgaatctcctgctgctgggacctgacagcaacgtgttgtgtgttgggttagcatccgttcttggcaagcaatgcatgagctcccaggattctgtcatgaagttattcgcacggcgaggtgaacggcaggcctgtctagacatgcctgtgtcaaattttgtagccgtgcaggcctcctctgactaacactacacttctgcttcgtgggggctgtgctattttccggacccggcgggatagatgtaggcgcgcacctgagtaaagggcggtgggaggccaattattctgtcccctggcggaaagcgtgggcctgtacggtaagaaaaaacccgacgggtaagggggccttaacgaagcgccgttccgtccccttggaaaaggattgcaaaaaaacccagtgttgttgggggcaggccccggggcatctctctttcccaggacaatcttgccacagaaacaggccaggcttggacaggaattgacggtgggggtaaaaaacccccccaaggaacggcctatgggaacacgctttgcccagtggggcccttgggaaggaaaaaaaatgcctggaaacccaagtgccccttttgtagggactccttcatggcccccttgggagtttacttgcgcactgcacggggacccccccaatcttctggtgaactttcccgtggaggaacttcactcttcctaagaaa

SEQ ID NO: 593003 - DNA, 81 bp, Homo sapiens
  misc_feature (30)..(30): n is a, c, g, or t
  misc_feature (45)..(45): n is a, c, g, or t
actggagtcgaaaaggccatcaaaaactcngattactgaaaatcncaaatgtcaccaacaaaaggaatgttgattagagtc

SEQ ID NO: 593004 - DNA, 855 bp, Homo sapiens
ggttgttgaccatatgtatgtcttcttttgagaagttttttggtcatgaaatctatttcgtcccatgtgtgagccaccatgcccagctcaggatacaaaatcaagtgtgcaaaaaccacaagcattcttatacaccaataacaaacaaacagagagccaaatcatgagtgaactcccattcacaattgcttcaaagagaataaaatacccaggaatacaacttacaagggacgtgaaggacctcttcaaggagaactacaaaccactgctcaaggaaataaaagaggatacaaacaaatggaagaacattccctgctcatgggtaggaagaatcaatatcgtgaaaatggccataccgcccaaggtaatttatagattcaatgccatccccatcaagctaccaatgactttcttcacaggaacttggcgaagaactactttaaagcttcatagtggagaccaaaagaaaagaaaaagaaagaacaacaaaaaaacacgtgggggggggcgcaaggggccccgagagaaaagcttttcaagacacccacgggtgggggcgcggggcgcccacacatacggacaaggcaacacgtggccacaagacgggtgtttacatggagaggaaaccgcggggcacagaaacaaggtggtagcggagaaattaccaacaccagaaaatgaaaaaagagaggcgggggggtggaaaacacacgagcagggtgcttagcgagagacaaacccagggagggaggatcacgaggagggcgaagtaaagggggggacactcataaaacgcaggggagacccacaaggggcaggcgcgggaagcataacaaataggcccggcaccgcgga

SEQ ID NO: 593005 - DNA, 772 bp, Homo sapiens
gactgagttccttcgcactcagcccactcgcacccgggtgaataaacaggctttgtagctcacacttagcctgttcaagttggtctcttcaattagatgcgtcgcataacattaggtgccgagagcccgggataggggaaatcctccgggcagacctctccatctatcctgcccggtagccagcgttctcccagtgcaagagacttcccctcgccctcaggacctcagagcagactccgggagcactccgggctctggtctagtggatagtgaaatccaacgaccggatacagggactcctatcttggggagacagccgtatccttcagtgttggtgcaatgcccgggacgcccgccttggccagtttgaccgaggcacacaatgccaggagactccaagtggggacggcgccacatgaggagtcctagatgggtgctcgtttgctagatctcattacatattccacccacagtctttccttgttctatcatgggcaattattcccgacatatccatccctctttcttctgtctggcttgtgtcctcagaaagctcaaacctcttcacttgcagccaatctaacggctaagcgtctaatagtgttctgtaacacgtcctggccccaggtataaattagacaatggcgctcagtggcagaaaacagacttccaatttctctattttgtgggacttagaaaacttctacggcaatgggcaaatgggtctgagggtaccattaatgcaggctttggacataggattttcctagct

SEQ ID NO: 593006 - DNA, 233 bp, Homo sapiens
taccaatctgtgttaagtgtctgtggggaacgagccacaggaagtagtgagcagcctttatgactcctgtctaatcatcacttccaaacattaggaacacgtgggcaaaggccaaggcggccaggaggccagggctccatatggagaatgacactggcaacgggggcaaatatctgagcagccagcctcgggggatcgcttcctgagcatggagtctgtggtctgtctggttt

SEQ ID NO: 593007 - DNA, 1092 bp, Homo sapiens
gtttgtgcactgatgtgtgctggatgcctgtgatgcctgtttacctggatgcctggggcctggcctgtgtgcttgcttcgatgtgccctgagctgtgcatgtgatgctgcatgctgctggatgctgcttatgccatgtgctgcccaatgtctgctgagaatgcttgcctgcctgcgctcttccctgccctggctgcctgcgagccccgtggctgtgtccagttgtgtgtgctgtgtgcactgtgctgtctgctttgcatgtgctgcctgtgcatgcccctttgatgtgtgcatgcctgcattagttgctgcttgctgctacttgtcccctgcatgtgtctgcatgccaagggctgtgctgtggtgctgctgcccatgcccctgtgcccctgtgatgctgccctgcctgcgtgtccccacctccattgggactgccgttcaatggtgtgtgtgcattgatggcctcgggatgctggctttgccctgtgatgtgttgctccgtgcctgcctgcctgcctgccacccccattgactttatgggtgccccgtgccttccaccttggcccctgtgccctggcctgacccctcgccgagcctgctcggaggaacttcctggccagcggaggtccgtctagacaactggatggcttgcccagagaaggatgcctgcctggctgggggaaaccccgaagggttgtggccctgatgtggaaacatgtttgttttttctggtgtgaatgtggcaactgtgggctttgctggctggcctgctaggaacggacacacaaggccccaaaggcacagaaacgcaagcgaggccttgctgggccagagcggtcactgccactttcgacaaaaggcccatgctatgtttgcagaggaggcttaggatgggcccaagcgtttcccatgagtgacaccgggcttacccccgcactttaagcatagagggggagggcgatccgccggtttttggacacgaaccttcaaccagagccgccgcggtacggggttcttggttcaacggacccggggagccacgttgggcgtagggcgaccctttaaccagcagcttgccttttctagggttgtc

SEQ ID NO: 593008 - DNA, 148 bp, Homo sapiens
tgagcggtgttgattctgaatcacagtagaatcctatcgtagatggtgttgatgtactgaatcacagtagaatcctaccgtagatggtgttgatgtactgaatcacagtagaatcctaccgtagaaggtgttgatgtactgaatcaca

SEQ ID NO: 593009 - DNA, 237 bp, Homo sapiens
tgaggatccgtcagcataccagcacggggttaaaggcagcatagcgagtttcagtcacgttatcgtaggacttcgtaacagcccgggaccatccctaccttatcgagcaaacttaaaatagaatccccactatgcacttttaatttctccgacatactcggattctaccctagcatcacacaccgcacaatcccctatctgggccttcttacgagccataacctgcccttacgtcct

SEQ ID NO: 593010 - DNA, 584 bp, Homo sapiens
  misc_feature (175)..(175): n is a, c, g, or t
  misc_feature (240)..(240): n is a, c, g, or t
  misc_feature (242)..(243): n is a, c, g, or t
  misc_feature (253)..(254): n is a, c, g, or t
ctcgcgcgcggtgtggtggcagcaggcgcaccaagcctcgaaatgcagaacgacgccggcgagttcgtggacctgtacgtgccgcggaaatgctccgctagcaatcgcatcatcggtgccaaggaccacggatccatccagatgaacgtggccgaggttgacaaggtcacaaggnaaggtttaatggccagtttaaaacttatgctatctgcgggggccattcgtaggatgggtagtcananngattccattnnccgattggccgataggccagattgtgcgatcgatcgtcaagaggtaaggttgtggggctcacagtttgagtgccatgacgttgagatggtactaggatctgtctctcagaagcgacgatggatcgttaaagcgcttgtgtccgtttttccgcacgtggactctcttcagcgatacatttttggcactcgggcacgcaggaaaatcaaccggagcatttgctttgggcatagttcatttctggtccgattattatattacattattaaagtgggacaattaagcatgaaagaagatacccaaaacccccttatacccgggggcaacgacca

SEQ ID NO: 593011 - DNA, 550 bp, Homo sapiens
gcgcgctcggtacccgcattggagcaacactcatggcctctcagcatgaaagggggccaatagggttggctgtcgtgtgtaccacaccaagctgagatgcagacacccagtaggcgcgaggcaaatgcgtcccataaggaagaggcttgtatatatgagctctttgctccctccctcccactaacttaaaagaattgctctccatctccttaggcaaagttccttggccctttgtcttatgggagtgcacccctccaaggtcatctccagtccatttgcatccaagtctggcatctggagggagagcggtctcatatgctatggtagtaaaggtggactagtatttatgtgtagagaacagtggctgtttgtcaggaaaggtgtgccaaaacaaagagtacggccggccctagaaaatgcatcagaaaaacccatttccccggtgcactcattctgagcttccttccttcattgctgtcattatggctgagaactggactgtgcccagatgacctttcccttccttgccctcatcttgctgccagggtct

SEQ ID NO: 593012 - DNA, 172 bp, Homo sapiens
agagttacctgaacatcaggtgatcggcgtgttacatattcaatgaggagtatgcgctggtcactgacagccagctgatatccgaagaattggatgccaactgcggtggcagcggaaccatcctggcggtttttcacagcatctacggcaagagtgtcgaaggatcgctcat

SEQ ID NO: 593013 - DNA, 122 bp, Homo sapiens
ctgaaggaggtgaggacaaattggggaagggtggctttcattccaaaatccagggatttggggaaaaagaaggaattttatgttttttggggtgggaggggagggtgtgtttttttccccca

SEQ ID NO: 593014 - DNA, 250 bp, Homo sapiens
aagtccgaacgagctgctgagagagccaaggatcatactgtgacgtcaggagcatacacagtagaggacaggtgacatgccaacacagacatccacatatgaacccaacccccagcgacacggaggtggacaggggatccggcatgggtgcatgtcatactatgcaatgacatgaattatgatgtggcccgaatcaccccctggctgtagcgggtgacgcagaatcggaagcaaatgaatgaacgagaaa

SEQ ID NO: 593015 - DNA, 959 bp, Homo sapiens
ttctggggcgttggtgtcccgcggaccgcgcctgtgtacgccaaggtcggggcctatgagcattgtctgttttgcgtgcctctccagttgtggggccggacacccggtcccaacgatgcggcacccttgttgcgcggttatgtgcccccttgccttgggtggtcccccacttccccgccgattggtacggggtgtcaaactgcgttcggtcctgatcttacaggggacctcccagtctcccacgtcttggggcgtccccctggcagtcgtgacctcccccgaaggcgccacttctatgggagaaggagtctgggcctttgaagcagtgttcatcagcggggctacctattttccttagggtgtgggccgcgccatttcctggctctcctccgccctggtggaccaacgtgtcttgttctgcgccgtgctcaccccacagttgccacagcccacggcggaccgcacgggtcagcaacacccgctggtcgctcgcagtcagtgttctccccgggcaacctcagggttgcttgcccattctcgcccaaattaacttccagtgtctttgtagacgcccctcatggtcattgtcccctcagggtccaacacccgtgccccgcccccactgagtgacacactactccacaataagcaccccttcccttctctgtctacaacacattacctcacgcagaccaattacttgcctattagaaccttcccttcaggccaccttccttcgcctctctgatcttaagcacccactattgaagacccactccataaaatctgcgatcataattctgttgattctggcgccgaacaaaaattactgatcaataaattctccttatgacgccccgcactccacctcctctctcttccttcttttaccctcggcgtcgatacaaggcttttctttgtcccacacccaaaggtccaaaaaatcacaacatacgcaa

SEQ ID NO: 593016 - DNA, 230 bp, Homo sapiens
gcctcacggcatctaagtgaggaaaccacaattagtcaacagatcatgcaaatatgtatacatgtagaggtattacaagtgcttttaagaaaagcaggatacgcaggacaccagagtagccagaagattccattttaaatcatttaagcaaaaattaaaatattcatggttgcaacagttcaatgtgatttttgtcgatattccgacagttgacacatgtcagcaccttc

SEQ ID NO: 593017 - DNA, 365 bp, Homo sapiens
gtattcattccctcatgcccctcctaagtgttgactggtgttgaccccactcttatctccgggggtggacaccaactggggaagccactcactcaatccatcatatttccctggccacagtaactgtttcatatataatgacatgttgtctaagtagaatgaatcagaatggatatgaaatagttttagccacatgggtaaatcctggagcttctgggaggcctgaagatggagatactcatggaagcatagcctgctgatgtcaagctgggtggcatgctgacatttggtgaattcccttttggttttggttttaactggtgagaagtgagttgtctttcacaataaagaccctacgtgctaaa

SEQ ID NO: 593018 - DNA, 438 bp, Homo sapiens
cccatttaactgccctaactggcccttgcctaggatggctgaccagcgctgctctcaatgagccagcctctcttttgggggaatcaagcatttgcttcctgtagactacagtaaggaaagggaggagaaatctgatgactcaactggctcatgatgcccattctcggaactatccagagggcataagcttgcagtttgtacgcttagctactaccactgtactaccttaccggggcactttaagggtacaggggcctctgtctctatgcctatatgggacaatcaattctgactgagctaccacattctccgtaggtgaggatgactgttatatgcgtcgctgataacgtgtaatcccacgggtttatactgccctttactcaacctttcctagatacatctgacaatgaatgtcttgattgtgactggctacacttt

SEQ ID NO: 593019 - DNA, 354 bp, Homo sapiens
ggtgcgtaactctaagcgcctgattgcactcatctctgcaatcggtatgtccatcttcctgcaaaactacgtcagcctgaccgaaggttcgcgcgacgtggcgctgccgagcctgtttaacggtcagtgggtggtggggcatagcgaaaacttctctgcctctattaccaccatgcaggcggtgatctggattgttaccttcctcgccatgctggcgctgacgattttcattcgctattcccgcatgggtcgcgcgtgtcgtgcctgcgcggaagatctgaaaatggcgagtctgcttggcattaacaccgaccgggtgattgcgctgacctttgtgattggcgcggcgatggc

SEQ ID NO: 593020 - DNA, 819 bp, Homo sapiens
  misc_feature (15)..(15): n is a, c, g, or t
  misc_feature (21)..(21): n is a, c, g, or t
  misc_feature (23)..(23): n is a, c, g, or t
  misc_feature (497)..(497): n is a, c, g, or t
  misc_feature (563)..(563): n is a, c, g, or t
accaggattatgagnggagtngnttcagcgtcccggtgtggctgtgccgttggtcctgtgcggtcacttagccaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaaattcattcagatgcattggacaaaatccggtatgaaagcttgacaggatcccaggtaaagttagactctgggcaaagagctgcatattgaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttnattattctgcttatttggttgctgagaaagtaactgtgatcacgcaaacataacgatgatgagcangtacgcttgggagtcctcagcagggggatcattcacagtgaggacagacacaggtgaacctatgggtcgtggacacaaaatgttatcctgagcacctgaaagaagaccaaactgagtacttggaggaaacgaagcattacaggagactgtggaaagatgccattctgcagtttattgggatatgccattaactctttattggtggagaacggaccgtgactaaatgaaggtaagtgattgtagaaaggtggataaa

SEQ ID NO: 593021 - DNA, 448 bp, Homo sapiens
aagactccaccatattggtgggtgcagaaaaataaaacatttctctacctcacatactgaaagcccttgggtcaaaagacctgtgtttccattcccatagatcgcaagaatggggcctggcagttagaacaaatgctggacaactgtaacaaagacacccagagtcttgtcgggtgccgtggttcatgcctgtaatcccagcactttgggaggctgaagcgggaggattgctggagcccaggagttcaagaccagcctggccaacatggtgaaaccccatctctactaaaaatataaaaatcagccgggcatggtggcatgtgcctgtaatcccagctactcaggagtctgaggaggagaatcacttgaacctggaggcagaggttgcagtgagtcgaggttgcgctactgcactccagcctggacaacagagggagactctgtctca

SEQ ID NO: 593022 - DNA, 375 bp, Homo sapiens
gcgggtctctagcgaccctttaaacagggagtggagcggcgagtggaggtttgcagtgagctgagagcacgccacttcactccagcctgggagagagagtgagactctgtaaaacaaacaaacaaaaacaaaacaaaacaaaaacctatctctcaccatatataaaaatcaaatcaaaatagattaaagatgaaagacataaatgtaaaacctgaaagtatgaaactactagaagaaaacattggggatatgcttcaggacactggtctgggcaaagattttttgggtaagatctcaaaagcaaaggcaacaaaagctaacatagataagtgggattatatcactcttataacctgctcagccattgcactccgg

SEQ ID NO: 593023 - DNA, 330 bp, Homo sapiens
agagaacaccagtctccacgtcggccaagaggaacaggaccaataccaccagattttgtagacatccatgggagaggcaggcgcaagggcttgtcagtcggacgagataggtggctaggatgcaggtcctgagcctctaatgcagcgtggtaccactggtcattgccatcctatacgggtagactttccactccctgtgaaccgaaggcatgtatagcactatggctccagagatgtaagtcaccgattgccaaccagcaaattggcacaaactgctactagtgtcggggcttgtagcacaattttcttaattgtaatgtgctgacttcc

SEQ ID NO: 593024 - DNA, 393 bp, Homo sapiens
tttttttaaatacttttctttttttgagatgaagttttgctctttcgcccaggttggagtgaagtggcatgatcttggttcactgcaacttccgcactctgggttcaagcgattctcctgcctcagcctccgaagtagctgggattacaagcatgtgccaccacatctggctaatttttgcatttttagtagagatggggtttcaccatgttggacaggctggtcctgacctcttgacctcaggcaatccacctgcctcagcctcccaaagtgctaggattacaggcctgagccgccacaccaggcctctttttttttagacggaatctcactcagtctgccgccactgcaactccagcctgggctacagagatggattcaatcttaaaaaaa

SEQ ID NO: 593025 - DNA, 1435 bp, Homo sapiens
gagacgtccgagtgcgccttgcttcagtcagtctgagcgcgatccgccggagactgccgggggccgaagaagcggcgctaaccagcagaagagagtgtccagatgtgcacgttaggagagcagcaccaagccggacgagctgacaacgaattgcgacccacaggacagcattacagcatgagaacttgagtacgtaccaggcgtgccaagaggatacacgagtccatgggcgcttgggacagtcgtgcgaactatcgtcgatgccgcggctgcacgagtgtcagtaacttgatagtggcaaagaggagtcgatcccatggtaggatactatgaaactcgatactttacagtaaccgtagctctgcgcgtgtcggtaaccagggaactgcatgagtgctagggaactagccttctttggcttcattcgtctgtgaaccactgtcgagccgcagcagaatggcctaatgagttacctaacctgatagtaactttggcactttgaagcacggagaaagacagcgcgtaggtgccatgtcgtgaagctgcgctgtatggtaaagaataggcacgcatctatctgaaaaatatgaaaagacgttatgcttacaagacatacttgctattaacgtacactttatgggcagtattggggccattaagaaattagttctaccattactaggtctaatactacctggggatgccattccccatccttctatgtcgcgggaggaaagataacgtatactttgccttattgcctattcggctggtcacagggaccctgtgagaacaagttgattgcgtaccgaagactcttaccagtctttattgttatgccttacgaattagtgtacatgagggtaagggtaaggatacacgaggtctattagtggataagaattccttaagggcccccgctaaattggttgcctaatatttgagacgtccctttgcaaaatccagtgcttattttattcccaccgattgggtttgaaatcatcaacgggtcgttttccctgtgaggtcaatttctgatggcctctctaaccaagaaaaaaaaacacaaagcacaagaaaataaaacaaccactccgattggcggcaaagttgccataattgaatacacggagggccgtggcacgtggcagcaacacccaacacggctctcactcttgtaacatcgattggggcggcgcccatgacggtgtgctttcaagacagggctgggcacctctggtcgaggcaacaccacgcctatcttcttctgttgcttgtgctcaacccggctgtggctgtgagccaatacctggcgcggacgggatctaccccccccataaaataggggaggcactctgcccaaatacaaacaatttccgcgaacaaaacccccccgggtttaacaccggtgctttgaaaacagcggcccgacaaa

SEQ ID NO: 593026 - DNA, 153 bp, Homo sapiens
tagtggtaactacatgtcgttagcggcagtgctggtgtaggtgggtacattcttcagagggcactagcggttgaggacattccatcttagcggagagttcatgcggaggtgcaatacacatactcacacatgccgtccttggagttaatacat

SEQ ID NO: 593027 - DNA, 907 bp, Homo sapiens
  misc_feature (348)..(348): n is a, c, g, or t
tggagaggcggtaacggaggcactccccctgctgcaccccgccgtttctacggtggctcatgaaaccagttgttgtttcgtcggggtagtgtcgacctgtctgacgggcgtcgcccgagataggacggagtcaaacccgtggtatcaactgaagacgagatgtcaggtgtggaagagtctcagtgccccctttcagtctggactgtgagtctgctgctggtgtagacagtcttggtttctcttttcagggatgtcattttcaacatattgcgggatggtaccatctgctttattaagccccgtaggaagactgccacacctagactgatgcttattagtcatcagcgnttatgttcgctactaacgtcctggtgtgcagctgagttttttagatgtctaggcatatctgtgaaagatgccttaggaaatactgaatcatggggaagtatgtgagactacgagaagatggagaaggttcatttggaaaagccattcttgttaaatctacagaagatggtgacagtgatgttatcaaggaaattaaatctcatgaatgtccagtaagaaagagaagaatcacgagagaagttggggtattggcagcatgaagcattcaagtatgtccagtgtagagaatcgttgcagaaaatgggtctctctacctagtatggatacggggaggaggggactgctgagcgaataaatggtcaaaaggcgccggcaaggcctcatttgtcgcctgccgatttttggccgacgggtcgtggaaagtttccgggggggaatcccaaattttgcgaagggcgaggcccgggatggtgcactaaacggggggacggccccctttcggggcaccaaacaaagggggttactgaccccaccacaaacctcgtgcgaaccagcagct

SEQ ID NO: 593028 - DNA, 119 bp, Homo sapiens
aatgccaactatcagtgctaacataaaaacattttaaaaatgaaggtcaaaaacaattagactggaaaccaaagccttattttcccatagatgagcaaaactgaaaatgaaaggggtcc

SEQ ID NO: 593029 - DNA, 213 bp, Homo sapiens
tgtacctgagcatggagaccacctgctcacactcttctactggagagggagcgagcccccaaatgttccacactgtgtacccaggacccccctactgacctgcctccctgtcgagttcctcctacaactaccacttcaatgggggtcctggctcacttacccccagaaccaccctacagcttcccaggcctattcccaatctagcaggcccta

SEQ ID NO: 593030 - DNA, 623 bp, Homo sapiens
ccggtccctagatattctggcgagtagctgggatacaggctcccaccaccatatctggctaatttttgtatttttagtagaggcaggtttcaccatgttggccaggctggtctcaaactcctgacctcaagtgatccgcccgcctcagcctcccaaggcgttgagattacaggcgtgagccaccgcacccttcctgcttcttctttcttaatacttatttatttctctttactgattgaatgcacccccaatataatgttacagtagccatccttgccttccactggcagtgcttatagtattttataattaaacgtggttgtaacttaaaaaaaagtcttttttagttcttctgtgaatcagctttgttccctttagagattcagtgagtcttctctgtctgcatccaaatgttggttcaaaccttgagcctcacaccctgcctgaggcacccttctctggtttgatgttgaactattgttcaacagtcaactttttggttgtgcttgtttatctggcaacaggtccttcgatcaggacatacagtttactgttgccattgatttcacaggcctatgagagataccctgtcaagggcccctaaaaacccagaaatatcacgg

SEQ ID NO: 593031 - DNA, 223 bp, Homo sapiens
atgcgcagatagggccgcatcctggctgacaggctgaggccctgcaggtctaagaccagaggaatgcacgcaatgcgccgtgaatatgcgcctccagtgccagagagggaggagatcatcaagactttatccaaggaggaagagaccaagaaataaaacctcccactttgtctgtacatactggcctctgtgattacatagatcagccattaaaataaaacaa

SEQ ID NO: 593032 - DNA, 333 bp, Homo sapiens
  misc_feature (112)..(112): n is a, c, g, or t
  misc_feature (259)..(259): n is a, c, g, or t
ttgctgaaattgaatgtcgtgccagagccatcggaacgatgcacgatgttgattttagtgtcgggaagatgtaaccccggattggcgctgatgattgctgcgtcattccacntactgatcttccctaggaaaatatctgcaagcagtgggcctgtcaggcgtagtttgcctggttcgatgttgtctagattgaccaccggcacgacgccacctatggccgatggaaactgccctagaccgcttgggtcagttcgctgcngtcaagttggcttatcagaaagaaccaagatcgattggttggggggcttttgaatttgggggcaattaccaccc

SEQ ID NO: 593033 - DNA, 390 bp, Homo sapiens
  misc_feature (179)..(179): n is a, c, g, or t
ctgggcccgaaattctaagttacgcacacacacacacacacacacacacacacacgagtatgtcagtaagcccgagggttgtacctcgtgtgtgtctaaccaatgtggtctacagtatgaggaggctccagaggtatctcactccttggtgtgcaatttattttccatagacgcagctncacagacactcaagagaaatattttacttgagtggtattaccaatcatattagtgaaaggtgatgtcatctcaagaaacagcgcagagttggaaacagtatgctatatgggtgagggtgaggagaagagggcacgagaatcttatcagcgtgctcaccagatgatacggcacttttccccgcgtaattgagggttgcgggggcatcctcta

SEQ ID NO: 593034 - DNA, 115 bp, Homo sapiens
gcacatgatgaggcgtcttctcagtgtaatgcaacttctgtcctcgcagatgttgaacagaggagcagagaatgcactcggcagacgtgtcatcatagctggtaaccagcttcca

SEQ ID NO: 593035 - DNA, 367 bp, Homo sapiens
tattcaactagcgaatagtgatctgagggcactactgtgacatgacttatgtcattacatgtatgtcgtgactgggatgatcctagggagaacttatggcatattttcacccccacaaaagtcagttaaatattgggacactaaccatccaggtcaagaaaagtcacatgccatagccatggtattgcacatcattcatcttgcattctttgagaataagaagatcagtaaatagttcagaagtgggaagctttgtccaggcctgtgtgtgaacccaaagtctagtttagaaatagaacaagtaagttcattgctatagcataacacaaaatttgcataagtggtggtcagcaaatccttgaatgct

SEQ ID NO: 593036 - DNA, 397 bp, Homo sapiens
ccattggtgctatctgtggttcctggtgtgaggctgatcttttcagccatgtccacaggtggggagggctctggtgggtggcctggcatcagggtttggtcatttcagtgtatcctgtgtgtacagagcctggcgatgcctgccctgtgaacatgacttactagactaggtcccttccccaccctgccactgtccctctcagagaactcaccttgagagacccacacttgttccggtggcggtgctgctgccccacttcctcttggagatgtatctttgggaattggtggcagctcattcttttgattttcctcagtgggcccaaagctttggcccaaggacacagtgcaaggttgtgaatgagactggatatgaaatcagggactatgcttttcca

SEQ ID NO: 593037 - DNA, 584 bp, Homo sapiens
  misc_feature (170)..(170): n is a, c, g, or t
gcctttgggctctggaagccaccaggataattgagagttgtggatagctacttcagaaggctctggaaggtgaagcatgctcacagccagcttggagcagctgacctctcgcacagagcccctcttccaccagcagagaaaggagaagagttcccgtgcctccggaagcnacagaaatatccaggaaacgagtgtttctgtgccctcagtgtccactggccaaaaagagcaccctgaccactcggtagcagcgcccgtccgtccctgagcctctgtttgagggactcacgtccagctcccggcagactcagcgcgggggtcggatgccttctccgcaccatccctcaccgccacgagctgctgtggctcacattctgccatccgagctctgtccaggaggcagccgagaattggagcagttcccacgccaagtagggccttgtgggtggccggtcccctcctccagcgtggcacggaggcgccggagcatgcaggtctatgcctctgcagagtctggggcatcttgttccatttccttgctgcctctcctctcgtccgtgatcatccccccctccccctctgtt

SEQ ID NO: 593038 - DNA, 692 bp, Homo sapiens
gagatggacgagggcggctgctctgtggggaggggcctgccgcctccctggcagccccaggcccccggccctgtggatgggacagccagtgcagagggcagagagccctccccacagtgtggcggttctctgagcgaggagagttagggccaagaacgtaactctcccaggtgacacggggggagacgagcaatgcagcactctaggaagcctgctaggcgcccttccctggctcacccggggagcccactctgcttctgtgctgtgggccctggggttgccagccctgcagtgtgagtgaacggttatttaggactcacctggcacttgccctgtggcttaagaacaagtagaagcttaaacttctgaaagtgcttcccggggaagattttttgtttttatttttgtggggtaaaggcgggggggtgtatgtgggcttttgccacgtttttgaattgttaaaaaaatacacattttacagcaaagcaactgtgtacggaaattagaagaaagcaggccagatttaggcgtgggtagagtaagggagtcctcgggtcatagggggaaatgggttcagagaataaggttaatagaaatcagggagtttggtaagaaggggagaagagtgtcacttcaggaaagaggcagtagagtggcgggtcctaaaggcacagaacacagcagatatgtgc

SEQ ID NO: 593039 - DNA, 287 bp, Homo sapiens
gctgaccagggctccctgacctatacaggcctctgctattgggggtgatggccagtccctggtgttcttgagtttattcccaagggcccaagcaaagggaccaaggtttcccagaggcctgaaggacagggggtaacatttcacaaatttggggctcactttctgcacatctcctatctatagcgctgtgcagctgtcaagtatcaaaggtctcgtatctcgtcctatctcatcctcgctatcatatctcgctatgtgctcgctctccagagttttcgtgtatctct

SEQ ID NO: 593040 - DNA, 476 bp, Homo sapiens
  misc_feature (170)..(170): n is a, c, g, or t
gcctttgggctctggaagccaccaggataattgagagttgtggatagctacttcagaaggctctggaaggtgaagcatgctcacagccagcttggagcagctgacctctcgcacagagcccctcttccaccagcagagaaaggagaagagttcccgtgcctccggaagcnacagaaatatccaggaaacgagtgtttctgtgccctcagtgtccactggccaaaaagagcaccctgaccactcggtagcagcgcccgtccgtccctgagcctctgtttgagggactcacgtccagccgagaattggagcagttcccacgccaagtagggccttgtgggtggccggtcccctcctccagcgtggcacggaggcgccggagcatgcaggtctatgcctctgcagagtctggggcatcttgttccatttccttgctgcctctcctctcgtccgtgatcatccccccctccccctctgtt

SEQ ID NO: 593041 - DNA, 296 bp, Homo sapiens
ggccatccgctggccgcttcttgacgggtgtggtccttcgtgcattcttgcaggtctcgcagtcggcgcgcaatagctgtttgaggtgtgtcgtgggttgaactacatctcccagaatcgagaggctgacatcctgacccctggtgcctgtgagtaggaccttatgtggaactagggtctctgcagacataggccaatttaggcgaggccacaaggaacggggtggggcctgatccatcgacgggtgtgtttagaagagtagacagagacacacaggggagaagctgtggcggacg

SEQ ID NO: 593042 - DNA, 370 bp, Homo sapiens
  misc_feature (269)..(269): n is a, c, g, or t
gccaggctggtctcgaactcctgacctcaagtgttctgctcaccagcctcccaaaagtgctgggattacagatgtgagccatcgcaccaggcctacaataaaatttaaaaaaaaaatagtcgggtgtgatggtacatgcctgtagttctagccacttgggaggctgagaatggaggatggcttgagcccaggaggttaaagctgcagtgagccattatcgtgatcaccccactgcactccagcctggggacagagcaataagagacccngactcttttatttatttatttttattatttttttttgagactgagtcttgctctgttgcccaggctggagtgcagtggtgcaatctcagctcactgcaatc

SEQ ID NO: 593043 - DNA, 677 bp, Homo sapiens
ggttcttcccccacctgccactgtacagagcccaagttctcgctagtgcttgtatgggtcagctgcgattggcctggggccctgcgcgagcctgcgagcgaggtgctggcggtctgcgaacgggcaacctgatgggggcctgtgaccacctgctccccgcgactgccccgagtccagtgtgactcgctgttcgcccattcatgctggagacctgctgtcagatgtgctgtgctgtgcctgctggccatccagcaatgcctgtctattctctacgacgttgtactctactatgaagcactcctgtgacgtccactcatgaactgtgaccatgtatggactctaacgtgcggaacgctaactccactcaacacgtctcaacctatgagaggacgggcctacttcctgtgcagaccagttgtccccttagtttccatttagactgcagtaagcaagttcgttatcacccgttgttaagtgcgacgttgcccacgctacaaggggtggcctttcggcttggcacatcgccgacagctggcggtggatatgggtacacatgagatggtgaaccacacaagcggtatctatgtgagggttaacgttggacattggacaacagatcaagcagccagcagacacacagggctaaatgcacggcgggtgaaagaagcggacatcta

SEQ ID NO: 593044 - DNA, 356 bp, Homo sapiens
  misc_feature (343)..(343): n is a, c, g, or t
gtatatgaaagagtgacagatgacatcgtctttacttgtctgtaagtatcgtgctatgttgtattacatttacttttaggggtatagagacaattttgatagaagttaggtaaacaaatatttcttaaactaaagacgaagcaaacagatttgctgtcatgacaggaaaggatacacccactccagtttgagcttctcaggaggcagttctgttctgatgtcgtcatagcgcgtttgagccctggtatatcgcaaggggtcaaagccataactcactcatagattagataaccattcactctgtaatacaataataattttaattcataaagtctcataaatntcatgtgaatgtg

SEQ ID NO: 593045 - DNA, 110 bp, Homo sapiens
ggtcttcatatcaaggtgatttttgaagaacgagtctcgggtctgcaacattggtcacagttggagcaatttggtgacgtctctctctatgatctctcttaatttcatta

SEQ ID NO: 593046 - DNA, 473 bp, Homo sapiens
tcttcaaccccaggcaacctagagtctgtctgaaaagatctgcctattttggccatttcaggtagcaaaaggtcaaaaaatttgtgtgattgaagccatgaaaatccagaatagtatgccagctgggaaaactggcccggtgaaatttgtgccctgtcaagctggaaacccagttggaaaaggggatctgctcgtggagctggaataaaggatttataccctttcagtcatcccccaatttaattagccatttgcatgatgctttcccacccaattgattcaagcattatacaggaacccccctgggcaggtacgtttacgtcgtcatttattccccaaagtcaagaccaatattttgccaaaaaatccccaatggaaattttcattgatataaaaacttgcacatatgatttggacttcggctgtgaaattccctagtgtcaaaattaaatcaataaacctgggcctttggt

SEQ ID NO: 593047 - DNA, 633 bp, Homo sapiens
taaaagtcataaaagtttattatatgaaagaaataaagtggttctgtacatctatttacagaacagagacttatttacagtgagatggaggcctgtggtgttggtgagggacagacagagagttgtgaggaggcgtgagcagccgtgcctcccagtggctcgaaaacagggaaccccagcaggaaggggagcagcaaaagcgtgggtgggggaaccggcgtccgtgttcttccctcaagtggagaccgtggtgagcattgtagcagggtgggagtggaacccagagttccacgcaggacccgtggaggtgcaagggagaatgcttgagtttgaacccagaaacattctcgggttgactcacagggtcctgggggtgctctggggaaagttgtgtgcccctcgtgcccctgacgctgtccgcagctgcagaggggaaatgtcccgggggtcacagctcgctggaccggacagcaggttccagtttgtggggacagggcatgtgaggaccttgtcaggacttctcatagccgccgggcctgggctgctcgctgggccccctggattggcccagaaaaggccgcatctgggaactccggggctagaacacctccaggagctccggccggggccttg

SEQ ID NO: 593048 - DNA, 699 bp, Homo sapiens
tgccagagtacttccaggtcaagctgatctttgacaaagcaaacaaaaacataaagtggggaaaggacacccttttcaaaaaatggtgctgggataattggctagccacatgtaggagaatgaaactggatccttatctctcatcttatacaaaaatcaactcaagatggattaagggcttaaacctaaaacctgaaactataaaaattctaaaagaaacattggaaaaacccttctagacaatggcttaggcaaggatttcatgaccaagaacccgaaagcaaatgtaataaaaacaaaggtaaatagctgggacctaattaaactaaagagcttttgcatggcaaaaggaacagtcagcagagtaaacagacaacccacagaatgggagaaaatcttcacaatctatacatctgacagaggactaatatccagaatctacaacaaactcaaacaaatcagtaagaaaaaaacaaataatctaatcaaaaagtgagctaaggacatgaatagacaattctcaaaagaagatatacaaatagccaacaaacttatgaaaaaatgttcaacatcactaatgatcagggaaatgcaaattgaaaccataatgcgataccaccttactcctgcaagaatgggcataatcaaagaatccagaaacagtagatgttggcgtggatttgggcacttcagggggga

SEQ ID NO: 593049 - DNA, 292 bp, Homo sapiens
cacgtataacttaaagcaaattgtgaggatgttgttattattctcccaggtgcaatgatcatatactatcaagttgttgttatatggaagatacactttgttttcaaaaaaccatgaaaatatgaatgaccaattgtcaaagtaatttattagagacattaaatttataccaatcatataatacaaatcacatataacaatgataattatctttttgtacttacaaccaaaccatattttcccagcaaagaaagaacggaaggaaggaaggaaggaaggaaggaaggaagga

SEQ ID NO: 593050 - DNA, 313 bp, Homo sapiens
gaacaaataaaggaaaactaatgtaaaaaaattaaatatggtactgaagcatatgaaccactaatagctgaaaaaaaaatttaatctgacaatggtagttttttaaccgagtttacttcattgacttacattgctagaatggatcagtattattgcgtcctaccatcttactttatgcttcttattatgctaactatggttttttcatttaaatattcaattgctctgtctttttatgtagttacttttccgaagatggcatgatcggtcaacttctcattgtgaaagatgaggattaatctctaggaaacta

SEQ ID NO: 593051 - DNA, 917 bp, Homo sapiens
  misc_feature (72)..(72): n is a, c, g, or t
  misc_feature (76)..(76): n is a, c, g, or t
  misc_feature (78)..(78): n is a, c, g, or t
  misc_feature (80)..(80): n is a, c, g, or t
  misc_feature (82)..(83): n is a, c, g, or t
  misc_feature (88)..(88): n is a, c, g, or t
  misc_feature (93)..(93): n is a, c, g, or t
  misc_feature (95)..(95): n is a, c, g, or t
  misc_feature (98)..(98): n is a, c, g, or t
  misc_feature (100)..(100): n is a, c, g, or t
  misc_feature (106)..(106): n is a, c, g, or t
  misc_feature (114)..(115): n is a, c, g, or t
  misc_feature (118)..(118): n is a, c, g, or t
  misc_feature (120)..(120): n is a, c, g, or t
  misc_feature (133)..(134): n is a, c, g, or t
  misc_feature (141)..(141): n is a, c, g, or t
  misc_feature (149)..(149): n is a, c, g, or t
  misc_feature (158)..(158): n is a, c, g, or t
  misc_feature (160)..(160): n is a, c, g, or t
  misc_feature (166)..(166): n is a, c, g, or t
  misc_feature (224)..(224): n is a, c, g, or t
  misc_feature (336)..(336): n is a, c, g, or t
  misc_feature (359)..(359): n is a, c, g, or t
  misc_feature (377)..(377): n is a, c, g, or t
  misc_feature (469)..(469): n is a, c, g, or t
  misc_feature (482)..(482): n is a, c, g, or t
  misc_feature (499)..(499): n is a, c, g, or t
  misc_feature (514)..(514): n is a, c, g, or t
  misc_feature (517)..(517): n is a, c, g, or t
  misc_feature (520)..(520): n is a, c, g, or t
  misc_feature (524)..(524): n is a, c, g, or t
  misc_feature (557)..(557): n is a, c, g, or t
  misc_feature (564)..(565): n is a, c, g, or t
  misc_feature (572)..(572): n is a, c, g, or t
  misc_feature (576)..(576): n is a, c, g, or t
  misc_feature (588)..(588): n is a, c, g, or t
  misc_feature (608)..(608): n is a, c, g, or t
  misc_feature (613)..(613): n is a, c, g, or t
  misc_feature (677)..(677): n is a, c, g, or t
  misc_feature (690)..(690): n is a, c, g, or t
  misc_feature (734)..(734): n is a, c, g, or t
  misc_feature (908)..(908): n is a, c, g, or t
aggccgcggcgcgttcactgcgagccgagccgagccgcgccgagccgcgccgatcgccatccggcctcggcnctcncncncnntcccngccgncngcncngcccgncgggccgnncgncncccccccaccctnnccctccnccccctcntcccccccncngctccncctcccggcccgggaaggtagcagtggaaatcgcaaagagcaaaaacaagaaatggcngcagatactccagttccctcacatcaaccagtgcgaagagaatgcagctcaaacctacgagcatgactatcacaaacctgtgcgagcggcagcacccttgggcgacctgatnttccgcgagttctatgccccggngccggagctgaaccactncgtcgacttcctggatggggtggccgagtatgaaatgaccccagatgacaagcggaaaaaatgtgggcgacagctacagaaacattttctgngccacacgggtcntaaactcatccctgagntcacccggccgatgntgncgnaatncaccacgcggctggcgcagggtccctgccacgnccttttnncggaaancccncggctgaacccngcgtacctaagcgtggcccnttttnccgactacctcgacagcatctacttcaaccgtttcctgcagtggaagtggctggaaaggcagcnagtgaccaaaaanaccttcaggcaataccgagtcctgggcaaaggtggctttggggnggtgtgcgcctgccaggtgcgggccacaggtaagatgtatgcctgcaagaagctagagaaaaagcggatcaagaagcggaaaggggaggccatggcgctgaacgagaagcagatcctggagagagtgaacagtaggtttgtagtgagcttggcctacgcctatgagaccaaggncgcgctgtg

SEQ ID NO: 593052 - DNA, 282 bp, Homo sapiens
tctagaggatcccgagctagacgtacacagtaaaaactggaatgaactccagagctcagagacagaagcaagacttaaccactttttcttcagcctccgtctcccgggtgcaagcaattctcccacctcagcctcctaagtagctgggactacaagcacatgccaccacgcccggctaatttttgtatttttagtggagactgggtttcaccatgttggccatgctggtcttgaactcctgacctcaagtgatccacccacctaggcctcccaaagtgctgg

SEQ ID NO: 593053 - DNA, 157 bp, Homo sapiens
cattcattcaatcattcactgctgttcagcagcaaatgcaatgcagcctcacagcatgcatcaggcatgtctccatgtaggtgtcatgcgcatcggggtcagtcctgcagtcacacggtcggtggccattccagcacatcaggccgggggatcaccg

SEQ ID NO: 593054 - DNA, 315 bp, Homo sapiens
gtgcataagtaccgcctgcgtagtaagtgcgatagatgctgtccgtgcgctgttgctggagtctgtggtccgcgcccttcgctcggaggcccggactggtctccaacaaatgcttagggttcatctttcatagctgcaaggaagcttccatgtgcctctaacactcatcttcagatagagtgggactgctgagactgtcctctagtgtcttgaagagcgtattctctggacgcatgaatactctctgttgatcttgtaagaaactggtgcgtgtcttgaagtatcggtgatggtatttgtccgcggttacttggg

SEQ ID NO: 593055 - DNA, 1007 bp, Homo sapiens
  misc_feature (10)..(10): n is a, c, g, or t
  misc_feature (575)..(575): n is a, c, g, or t
  misc_feature (704)..(704): n is a, c, g, or t
  misc_feature (710)..(710): n is a, c, g, or t
  misc_feature (941)..(941): n is a, c, g, or t
  misc_feature (943)..(946): n is a, c, g, or t
  misc_feature (967)..(967): n is a, c, g, or t
tcagacacgntgtggagccctacaacgccaccctctctgtccaccagctggtggaaaacacagatgaaacctactccattgataacgaggccctgtatgacattctgttccgcaccctgaagctgaccaccccccactacgggacctcaaccacctggtgtcggccaccatgagcggggtcaccacctgcctgcgcttcccgggccagctgaacgcagacctgcgcaagctggcggtgaacatgtgcccttccctcgcctgcacttcttcatgccccgcttcgcgcccctgaccagccggggcagccagcagtaccgggcgctcacgtgcccgagctcacccagcagatgttcgactccaagaacatgatggccgcctgcgacccgcgccacggccgctactgacggtggctgccatcttccggggccgcatgtccatgaaggaggtggacgagcagatgctcaacgtgcagaacaagaacagcagctacttcgtggagtggatccccaacaacgtgaagacggccgtgtgcaacatcccaccccgcggcctgaagatgtcggccaccttcatcngcaacagcacggccatccaggagctgttcaagcgcatctccgagcagttcacggccatgttccggcgcaaggccctcctgcactggtacacgggcgagggcatggacgagatggagttcaccgaggccnagagcnacatgaacgacctggtgtccgagtaccagcagtaccaggacgccacggccgacgaacaaggggagttcgaggaggaggagggcgaggacgaggcttaaaaacttctcagatcaatcgtgcatccttagtgaacttctgttgtcctcaagcatggtctttctacttgtaaactatggtgctcagttttgcctctgttagaaattcacactgttgatgtaatgatgtggaacncnnnnaaaaattacagtattgtctgngaaggtatctatactaataaaaaagcatgttgtagaaaat

SEQ ID NO: 593056 - DNA, 513 bp, Homo sapiens
aggaacagcactgagaggggccaggagcccaggaaggggagggaagggctttcgtgggccaggggtgagcctgcgggccacgcgcgacccccggagccttctcagccctcttagtgtccccactcccagcccaggtactaggctctggggcagtgaggaactagatccttctctcctcagcctagggtggaggtcactgcactaccacccacctctggaagactggctgttaaaagtcatgtggcataaacttgtggccacatagtagccttatttttttttctgttttttggctctagaaaatcagttcttgtactgttagctgagaagttgcggtcaatacataatactgtccataatttttgaagggttttcagaaagtacttttatggttttttcccctctcattattgctggtaattagctggtgttcttaatactatgatgtgtgcctcaccttattataacctatgtttgcttttccttctttatatatatattatatcatatcta

SEQ ID NO: 593057 - DNA, 481 bp, Homo sapiens
  misc_feature (75)..(75): n is a, c, g, or t
cagctacagttcagaaagaacaaaaggccatcaaactccagtcatgcaactggagaggcggacaatggcccattntgctgggaacccttaaataggcctctgagggactttgactgctgttttgccgaaacagcaccccctgtcagcaggaagcagttaagatcggtctttgtccttatccttatccttattctaatggcagttagatgcatttctttagagggggcaatgagacagccaggtgggaaggggtccccagagaaactccagcctgcacactgggaggagtgtgcactggggtgaagccacagaagtttgcgccatttccagtggggaagagcccagcccctcctcttcctgggtggaacctgaaattcaaactgccaggtgggaagcccacaagcagggagtctggctttgcagaaggaccgtttccctcttttccttttcacccaataaacgctgccctcctcacacttca

SEQ ID NO: 593058 - DNA, 274 bp, Homo sapiens
  misc_feature (186)..(186): n is a, c, g, or t
  misc_feature (221)..(221): n is a, c, g, or t
cgtaggaaacgtcgctcaatggaattctttggtaactcgagctttgcgttttcagagtcgctgcatttagggtcaactctgacatcccatgaggttactcaccacctacaggggagcactgccacatgacaagactcagtgaccatcactgagttcccagctccttactaaagagctcattcctgnaaaaatgaggatagcatcctgccaaccacacatcnagtggagtctcattcttgcttactgcagccctctctgacaccgtccacctgat

SEQ ID NO: 593059 - DNA, 400 bp, Homo sapiens
gggcggtctccttctgagctcctgtgccctgctacacactattataccagctgcctagatataaggaaagtgggacagcttgtacgggaggggcttctttccataaatccctgaggaatgacacacacccattttttcttttggcgaccccaagagatttgggaggtgtgggtaatcatcaagagaatttggggcttccaaggtgtgtcgggccaaggacctgagacctgaagggttgactttacccaattgggtgggagaggtgagcatctgtccccctttagatctctgtagccacacaaaggaagcttgggaagactcctagctgtgcttttttctcttcacacagtgctcgggccgcgtatagtcatatatatcacccacacatataggggacact

SEQ ID NO: 593060 - DNA, 584 bp, Homo sapiens
aagggtctgagtcgtcggcaatagatttgaggatgaaaaagtggggcctgtgaatgagaagactgctgcaaaaaatttccagatggaagtgatatcatctcattccctgctggaataaaccatgaccgtgtggtggggtaccactattctgaacactcatcatacttgtggtggatgaaaaaaggttaacttgaggtggatggtccccactatgttgcattgggaccagggtctgaaagacactgttctgaatctgtttggcttgtgttccagtttcttctccatctcctgaacttgaggtctgaaacatggtagtgccaggtgttgcaacctgctgtgtggtagtagtagaagtttcatttccagaaagggcgggaggagaagaaaacaattcacagtgcatttgcatatcctcattggtagacaatgcactcatcatgtgagaagtctgctggtaaagtggcgattgctgaaggtttccgttggctgaagcagttgaggggaataactctgactgaatctgggcagcggtctggcagatactctgttgcatctccatcagcaagagggagtgacgggcggta

SEQ ID NO: 593061 - DNA, 390 bp, Homo sapiens
ttgggggcaaatcgaagaactctcccaggctacgccccagtctgggggctggccggtccctgcatcatctgggcaaccagcaagagggacaaggacagcgcgaaatggtggcaactgggaagatgaggcaagacagcagagacagagaggcagcaatgggtgagagacaagagacagcagtgggcaagacagcaagagacggtgaagcagtctgtgatcgaggatgtggtgaaactgagtggacagccaagtgtccatagtacagctgcctcgtgtgggacccactgctctaacgagccagcccccgacacagaagctgagcacccccaagctggggaacctagagagacctgcacccgggtcccacgtggaagacgggctggtgccatt

SEQ ID NO: 593062 - DNA, 221 bp, Homo sapiens
  misc_feature (2)..(2): n is a, c, g, or t
anctctctttctttctttctttttgagacaaagtctcacgtctgcctcctaggttgtaatgcagtggtatgatcttggctcactgtagcctctgcctcccaggttaagcaattctctgctcagacccctagtacctgggaccacaggtgcccaccactatgtccagctaatttttgtactgtcagtagagatggggtaacgccgtgttggccaggatgctc

SEQ ID NO: 593063 - DNA, 609 bp, Homo sapiens
taaaaaaggaaaacccggtagggatgtcggggttgaggaataggaggaaaagtgggggatagggtgtatgaacatgagggtgtttccttcgtgtgtaaagtgagggttaagtgtggtaaatgttggggggtgagtgagccccatggggtgtgggggctaaagattttgttaaagggagctaatagggcgtggtgacatagtatagtggtgagagcctccggtgtaagtttaggaaaggtgattatttggacttcagaaaaaacgggtggggttacatagccccaggagagtttcctcctcagatagggttaacatagggggggggggataaaggcagaagcgtatagcaaaggggcttgggggttaaaaaaagtttccatccaaaaagaggcttcaataaaggcggggcggagtttcaaaagtttggggaaagctcctttgtggcagaaagagagggcatatagtgaagtcgcccacactggggtgaagttgggcagatctccgaaaagatgtggggagttgtggggcaatagggcggcagacaaataaggcttaaagtggaggggaattgttaagttccccgggggggccgattttttgcacgaactg

SEQ ID NO: 593064 - DNA, 865 bp, Homo sapiens
  misc_feature (325)..(325): n is a, c, g, or t
tctgaatgtgtctcgtgcgtgtggagggccctccgtgggtgtactccccgcccgcgtgggttgtcccccgtgtggcgccgccgttgacttttggttggccccacggaggagtcgtcttgtgccatatctcgcgggagcgtcgtctaatttcgggccaagtgtcgcccgtgtgggccccgcaaatgtgcccaccttcgggaccataccgggggtttcttaggccaccggggcaccgacttttctctgcccctcacgcagtgaccccgccgttgttggtcaatatggcagccgggatgccccagggtttggcggcacccagctagantacgccctcagcgttcggcccattaggggcacggggtttctgcttgcagccaccccagtcggcgacgttcctcctgtatacgccacgaggtccagtccccaggccctacccctcgcccggcggaccgcacggaggggaagttgctggtctctacaagcagattgaccaccgggggaaagccgaacatggccccgcataaattttcggggggaaaatggttgtcgcccgccggatgccttttttttgttatgcccacgggcaccctcttgagacactgcgagagggtttttgctcccactttccagacatcacgtgttaccacgcccggcacatatatttcaagcggacttcctcagggggtctcctcattttcgtggaaccatcctcctctttggcccgggggtgtgggtgcacccgcgcgccgcaggccccccacatgtggggatgtgcggtgccggtccgttccctagcgtcacggggcatcctcccccctcctgtggcccgagaccccggtccccctaaggggcccccaaacataac

SEQ ID NO: 593065 - DNA, 401 bp, Homo sapiens
gatccccggtcatctttctacactataaaagattagaaaaaaacttagttttttcaagttatggagtatcattcaagtctggttttgattaaggctaccagttttctaggaattgtggtttctgtcaaatgcgtgcggaaggcactgattggggttctggttggagttctggtttcccttcagaaaactgcagaaacactctttgatgttatttgtgcaaatgcattaacatctcagggacagggtcagtaagggtgcacttgtacagtgggtgtccattacagcccattactgctgaacataaaggcacaaaaagttgaactgtttgtgaatgactgtaatacatgtttgttttctaagctgccttctctaaacgctgtggattgcacctaagcctttct

SEQ ID NO: 593066 - DNA, 776 bp, Homo sapiens
aacaacctaatgattagcatcatccctctactattttgtaaccatgtcaataacagtctattaagatgtccgcaaactattactcgcgagccctctaaaaaactcacctcctagctacgtgaagctacctgacgtcgttatcgcctcacatatcattggcaagtgtctaagagcgtcaccttatccgagtcgaatcactcatcgacgtgccaagcaaaactctacggctctctattctaagtctcgctatgaatctccttaattataacattcacggcacagaactaatcatattttatatcttcttcgaaacacacttatccccaccttggtatcatcacccgatgaggcaaccagccagaacgcctgaacgcaggcacatacttcctattctacaccctagtaggctccttcccctactcatcgcactgatttacactcacaaaccctaggctcactaaacattctactactcactctcactgcccaagaactatcaaactcctgagccaacaacttaatatgacctagcttacacaatagctttttatagtaacagatacctctttacggagctccattatgactccctaaagccatgtcgaagccccatcgtggtcaatagtacttgccgagtacattcttaaaattagggggtatggtatataagctcaaactcatttacaaccctgaaaacaattgtaccttcttgtatattctatgaggtaatttaacaaggtccattgctagaaaaggactaaaatgccattgaaatt

SEQ ID NO: 593067 - DNA, 119 bp, Homo sapiens
tgggtatacatcatacttttattagtgaatatccctctggaaatcagcaacaatattaaaaaaaataatgatggccctactgggccaagcagaactagcaactttcattttaaaaacct

SEQ ID NO: 593068 - DNA, 195 bp, Homo sapiens
ccgacctagcaggatcccgtgattacgagtgaaggagaaaattgccttccccatggcagcttgttcataggtatacaccttgtattgcagcaacccaaaagataaaccagaccaggaaaaagcccaatattaacttgccactaacaagatcacctctgacaaaaggcaaatgaaaacaaactttctggccaggat

SEQ ID NO: 593069 - DNA, 1108 bp, Homo sapiens
  misc_feature (1108)..(1108): n is a, c, g, or t
gctcttaaacctagactctggcacgttgtattgcgctgttacgcatgagttattggtgatgaataacagctcattatatcaggacctggtaaatgctaagaacagtggccacaggggatgttcaggctgtgcacccggcgttcttcccctgtgtgaagggaaacttggtggtccaacgcaaccatctgggggctccagaaatgtgagcatgtagtggtaggccgtgattctccaaccctcggcactcacactgcactcttgtgaacccaaggtcgctgagtgcatcgggtgtggctcaggagaaatggagcgcagccagcaaaactcgagctgtggagttcggtgcgaggggctcctcctcagcccagggttcccgttcccctttccctgctgggtagatcgcattctagtctctttaaggagtgtttggccgcgacgagttggacaagcccggatgctgtcctttcgagtttggggccgggaggtgtcatcagatgacagtctgcatgggagggtctcaaaacgggccttggggtaggttcgtgcgatcatgaactctcgtcgatgcgtaacttgtgttcaatggcaggtggcctaggattgtgttgccgaggggggtcagcgagcccagttgttgcggaacatgggaaactgacctggctgttctgtccctccagtggagtcccctctgcatgagacatccgaatcgcactctgggaagctgatgcacctacagcctgtcgctctgtgaccctgtccgagggaccatgtatagtgccgcattgagactcgttggccatcgctgaattggtaattggctacgtggagggaatttccccacggccggagaccatgagcgcagcacaaggggagccccctgagccaagggtagggcggagcacgcacgtgaactgagtaatcggccgaaaaagcaatggacggaaccacacgcctgtgaccgttgtgcacgagactgagaccagtgagcgaaacttcatggtacgacgcgagaagcagacgaatgcgaagcggagtgtcaaacatcgctagagagagcgtgctcgatcgagagatgaatggagctgagtagcgttgactaggactcgan

SEQ ID NO: 593070 - DNA, 460 bp, Homo sapiens
agcgcggttttttctgtcaaccatttttgcccaaagtcatcggggcgtcttaaagggaaatttttcaccccctgaagactatcattaatctcaagcactcttcctcactgcatccttacaacagccgttgcatctaaacgcatcaacaattacctcctcaaccacagtacctaaggccaccagtgtgccactatctaccccgcaaatactcctttaccactgcaagtgccttattctccgcctcatcttccacagccatgcgcacctattcactcactgctgtgacggacccaatgatctcatctactacttaacagtcctcgaactacgaagaccccttactctattgcacctgctgccttgagccccattttattgacttttatccacatctacgtacttgcactaatctcactcgttctcactcctagtgcactttaatccacatccttttctctcc

SEQ ID NO: 593071 - DNA, 125 bp, Homo sapiens
  misc_feature (37)..(37): n is a, c, g, or t
  misc_feature (92)..(92): n is a, c, g, or t
atttcggcacgaagcgttttgttttcggaagatctgntttatacaacagtaaataaataagccctgttacagaacacaggcacttagggttngaacaggacttcgtcctttttgtagggacattc

SEQ ID NO: 593072 - DNA, 769 bp, Homo sapiens
gcgcagatacgatgactggcgtggcgaatcgagtcgaggctccatcctattctctcatccttgagtacacctggcttgtgtgctgtcatctcctcatcggtatcatctgtagccaatgtgcctggaattgtttgcttggccactgtcactggtctgtactgacacttactagccaaacgcatggcaatggaaaaactgcttagtgaagaacttagaagcttgtggagaccttggtgtgtccactgtccaccatctgctctgataaaacttgtgaactctgactcagaacctggatgacatgagtgcccacatgtgtgtttgacaatcaaatccatgaagcttgatactgacatgagaatcagatgtggttgtctctttttgacaatgacttcatgctaccctgtgctttgctacttgtccatgaatttgcatgtgtcttatgtacacatgtggcatgttgtttacatgtgctacaccatgtgaaaatcctacctattcttaatgctgtgtgcatgtttgcagagagatgcctctgagtcatgcacgtcttaacatgttgcatagatgcttgtgctttgttggtatcctgtgaatggagatgatgatgaaatgatacgccataatctgtcgagatacccttcaactccaccaacaatgtaccagtatgtctattcataatgaaccccaacacatcggagccccaacacctgtttggtgatgaagtgctgcccagaaagtgatcctagactgttgcagctctatctccttc

SEQ ID NO: 593073 - DNA, 210 bp, Homo sapiens
  misc_feature (77)..(77): n is a, c, g, or t
  misc_feature (142)..(142): n is a, c, g, or t
  misc_feature (171)..(171): n is a, c, g, or t
  misc_feature (199)..(200): n is a, c, g, or t
tgtcacggtgcgtttatcctctctacactctctgcgtttactttggtgcagcaatgtctaccaagacactaagccangttaggcgtaaactttgtaggaacagcaaacctgaagaatgcctcctcacacagggtaacatctnattccacattttttgacgttgattcactngtttcctggaacatatttgttgtcgtgnntgttgcattt

SEQ ID NO: 593074 - DNA, 405 bp, Homo sapiens
tagttgacggattcatcacttattgacgtcacgtcaatcaattatcacgtgagtctcgtgaaatcccatgactcagacaaatggtaacccgtagataccgtcggaactggtccatggatactcgaagtattataaggctcgtagtagggtatcatagtgacccagtgcaatctgtaataagcagtgcttgtagtcctgggtttcgtgtgtcatctagtagactatggtcagccccgttgagtaatcctcgtgcttcaagtagtccgtatgtgtgcctgagtgcacattctatcagacgtagctgcgtcttatgtgctccatcccagtgcagtcgcagttgatgggtacgctctagcttaaagtgatatagggcacatcctggtcctgggaataaaagaacgtctg

SEQ ID NO: 593075 - DNA, 176 bp, Homo sapiens
  misc_feature (134)..(134): n is a, c, g, or t
ggatggcgtcggcagaggtgctgcccaggtagaaggcctggctcaggtggcctggtccagtgctctgatggagtgtccccatccttgcatggagctgtgtgagcgttcgccatgcactgtgtgcactgttcacnctcacatgtcgatatcttggtcatgttctggtgcagcatggt

SEQ ID NO: 593076 - DNA, 214 bp, Homo sapiens
gacactagagatcccgtgtgtcgagataagcaggtactgtactaggggaatgtaaaacttgcaaacttaaaaacctgcatcttcttgaagcatcagttttgacttaccaaatggtttagagtcataagatcacctatttttatataaaagttatattatagcaataaaatgttcatacgccatagacgtgttaagattaaaaaaatagtgaatc

SEQ ID NO: 593077 - DNA, 733 bp, Homo sapiens
  misc_feature (712)..(712): n is a, c, g, or t
actccaggaattcggcacgaggatcgaccgccgcatgtatcacagactgatcctgaaggctaagggtaatgtgggcaaatacgagctgattatcatggatcacattcactggctgaaggctgactgggaccgtaagaagctgctggctgaccaggctgagggccgcatgtatatgaccaatgaagcacgtaagtgccgtgaatagctgcctgcaggccaagaatgaggagagcatcaagactatattcaaagaggaagacgtcatgaaatgaaacctggcactttgactgtacatactggacctcgtgacttcattgatcaggcgttacaatatgacatggctactgaatacatacagaactctaggggatgtccggtacccaatagcgcctatagtgagtcgttatacagatgagtggacgtcgtctacatacgcttgactggggctagggtcatagctgataggacagtaccgatgtgccttccgacaattgaagagcctgaatgccataggtcacttgtaagcgtaatatattgttagacaccgggttaaatctatgacaatcaagcttattcattgacccaatgtgcccaaatgagaagagagccttatagttaaaggattgaccgagaaagggtgacccgttttcccggttggtaccaatgcctgttttcaagaaagggcgcttcaacatgaagggcgaataccccntttaggccatgggccaatatc

SEQ ID NO: 593078 - DNA, 1654 bp, Homo sapiens
  misc_feature (7)..(7): n is a, c, g, or t
  misc_feature (14)..(14): n is a, c, g, or t
  misc_feature (76)..(76): n is a, c, g, or t
  misc_feature (88)..(88): n is a, c, g, or t
  misc_feature (204)..(204): n is a, c, g, or t
  misc_feature (220)..(220): n is a, c, g, or t
  misc_feature (385)..(385): n is a, c, g, or t
  misc_feature (548)..(548): n is a, c, g, or t
  misc_feature (583)..(583): n is a, c, g, or t
  misc_feature (603)..(603): n is a, c, g, or t
  misc_feature (609)..(609): n is a, c, g, or t
  misc_feature (767)..(767): n is a, c, g, or t
  misc_feature (801)..(801): n is a, c, g, or t
tgattcnttccccnttttcctacaccccccccttccccccgaccggaggagccgctctttccgcgcggggcattcnggggcccgaggncgagcccgccgccgccgccgtcgcccgagggaagcgagaagaggccgcgaccggagagaaaaagcggagtcgccaccggagagaagtcgacacccaagcagcagccgccgccaganaggcccgcccaccagnccgcccgtccccccgccccgtccacaaagcagcccgcctccgcaaaggggtacgaacgaagggacaaagtctccaatgaaaaaagtgtagaagacagaaaggaagtaaaagaaaaaaaagaaaaaaccaaacaaacaatcagttgtcccggaggaagtgaaaaanaaaagcattaaaaagaaaaagaacattaacacagaattgaaccaaaagaatccaagcaaaaaagaacggacagaacaaattaaagggggaaacgaaaaggagaaaccggccaggcaaggccaagggaaacaaaagaaagggcaaagccaaaaaggccaagggncgacatcaaaaaagggaaagacagggaagaagaancagatgaagacatgtctaantttgancgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaanaacttctctgcaagatttcataattgagagaatncctgagttgatagctctaaaggcagatatgctgtattgcctactttaacccatttttcaacctgtttgtttttaaaaggcttcactaagggttgatatgtaccattgtatggggcaattttaagtcagctaaaggcaataacctttattgcatgaaacatttcccccagactttttcatgaaagcttgttgagggttccctaggggcacaattcaattgcagccaggtttgcggaattaaaatttaaaaaaccatttcttcaaaccttaaaggttccttcccttttccttttccatttaaaccctttaggaattacttggaccttggatttcgggagaaggcatcctctccaggcatcttaagggccgcacaggacacgcacactctcacttttttaggaaatcttcattctggaaccaccttgggtttttccccaacaaggttggctcctgggggaccccaactgttggggtgtgttgacgacacccctttttagctgggcgtgaacaccgtgggggaaaagtctcctcccgcgaggggtgctgatcccctttctccggggtagtgggggtttcccccgcttttgaaacagtcttcctcttgtcttcttcccacaagagaccattcttttccctgtctctgcccactgtgttagtcctcctcttgtgggggtccgcggggggtcggtgagcgtgcgtgctcccggtggggtgttccccgacggggggcgtcttctttacgggctcgtacacctcgctcgagggaaatgtgtgcgcccttaaacgtttctggacggaggggggcttgggaggaaagcctttttctacacacgggggggtctctctgttgggac

SEQ ID NO: 593079 - DNA, 100 bp, Homo sapiens
ggaagcacaagaagcacaacacacacaagaaggacaagcgctgtcgcttcagcttcttcagcttcttgttcaccccctccagccattttcagcttgccac

SEQ ID NO: 593080 - DNA, 501 bp, Homo sapiens
  misc_feature (13)..(13): n is a, c, g, or t
  misc_feature (21)..(21): n is a, c, g, or t
cccaggtgtacgncccggtantatgtgcggtcgtgcccctcggtagccccggtgactatgttaagttctctgttgagcgaggatctgcaggtagacgcacagccaggacatctggaacctgggaaagggctccgcatatttgggtattgtgacatattgctgaactcaacacctaagggatgagagtctcctacctggtgcccttcctacaggggacattgtgacatgtctctgcattcctcacctaggagatgtgactctcatcttctgcttgcaccctgcctacatggaaagctgtggcatattgctgtggtcagcaaccagatgatgtgtttctcctgcctgggtcttaataaagacaggaaagatggttgacatattactgggcccagcatccaggtgatgttttgccttcaggtgacattgtgacatcgctgggccctgcattgacaatttgtgactcttctgcctgtgatttgcacacttgggccattgtgacat

SEQ ID NO: 593081 - DNA, 760 bp, Homo sapiens
tgggttttggtaggtttggtggtttatttttcctttttttttttggggtttttaaaaaaccaggaaacacgtgtgagggccaaaacaaaagacaagggccggggcggggggagatgtggggcgtgcgggcaccaggggaggcgcccaggctcggcacaaccacagactccatcagtgggtgacaaaacgcgggggagcctggtatggggcgccatcctccctggggacacacgggcacacgagcgaagtctctgggacgacaaacaaggggagaaaggggcgctggcggtgggagtcaccacaagccccgtaaggaggaggaggaggagagccaccccctcaagagcgatgagagaccaccccaacagactatgtgggccccaaaagagaaacactctcaccgagcagcaaacagggcacacaaagtgagggggccattgagcgccaaagcagaattggccagagaaagcgcccatcagaaagagagtgcaccactcgaagaaacaacaaaagagacaaccacaccacaccggggagcgaggagcgacaagagagagaaaacaccacatggggaccacataagagcaaaggagaaacacacaggagcaaggaacgacacacgcgggagaacaagccccccagcgtggaacacccaccacataacgtgagcaccaaacacaacggcacacaccacccaacctacaaaccaaatatatctacgaaaccagaaaaatccgaaacaagacccgagagagccaca

SEQ ID NO: 593082 - DNA, 1758 bp, Homo sapiens
  misc_feature (1024)..(1024): n is a, c, g, or t
  misc_feature (1560)..(1560): n is a, c, g, or t
cgtgtggttgtcgtggtgtgtgggtgtcggtgttgtgtgtgtgttctgtggtttgtggttgtgttgttgtggtgtgcgtggcgctgtcgtcggcggttctgtgcgtggtgtttgctgtgtggttgcgcatctcacaccggttgggtgggtccgcttttgtggtgctctcggccgctcctgtttgttgttgtttgcagcccggttgttttgctcgctgctgcagcttgtgttttagtgctcgctgtgtttctctagtggtgtttgcgtgcgctcttggtggtatgttatttatgtgctgtgcgcggtcggtgctgtgtggggtggtgcgcagttttgtcgtcccctagtagtgctcgctgggttatgcctcgcgccggctttgtttttttttgtgttgggcgagggggggggttacctgttatctgttcgttcgctccgcctctgtttttggtggtccgcgagttccaccctggttgattacgttgcccccggtctttgtggttcgatcatgatgcacgcctgtggccggtcttttacgggggcgcacccctcttgttgaggtcactctccggaaagggggatcccccccccagagggtgtgtgccagcgatcgaaatacctcgcgagggcgtgttggtgtgagaaacaggcacggcgtccccatgtgtacctgtaatatgcaccgggggtctccttataaggttttccccgtgaggtccccctcggggttggcccccaaatttttcggggtcactccgcgggggcacccccaggtttctcacccgcaccggcgcccctcctgggggtacccgcccctcgctctcccctcgctcttatcttcacgcgcttgcgcttgttatagacctcgggcccgctcgcgcacaggtgtcccccgcacgcccacgtaggtgccccctatagcccaccacgttacgtaatatgtatatgtccacgtaaggtatattcgtctctcgcgacccccgtgtgtcaccgcaacgcaaatgtatagggtctttgtcattgngggcacaataaagcgcgtcgtatctgtttctctcctctaccggtatatgtaggagaccacacacacttgttgtcacttttctcggaagcacacagggacgctctttacacaccccgcgtgttcgcgcgcgccgtcgtgggtgagacggacacgcctcacgcacacacgctcttcgcacgccattgtgctcgcgcgcgagatttgggcacccccgcaccgcgtcgcgagtttccccccttcgagggactcgcgctctgtcttttgctctgtcggcctgggccccctggtgtttctcgttataatttgggcggggtcccccttaatcttgcacattatatcacaagcggacaatgtgcccaagaccttgggaacaggcttatcgtctcacacacgcgaatgatcccttgcaccccccctgttctcccctgtcacacactacagcgtgggaactctggagatgaccaaggcaactttgcgcctcaacgcctggtggaacgctattcacggagcccaccttacccactgaccacgatatngattgagactcccctccgtcacctcggggtggcccactcgctccctgggttcctatcacgctcctcgtggtcttgtattcccccagcttccccaagccccagggctataagaacattgcccctaaagcgtggggtaaaagtaccctgttgagttttctgtacatataaaataattgaaataataccaattttcccttc

SEQ ID NO: 593083 - DNA, 322 bp, Homo sapiens
ttttgtggggcccccccccccgccccccgccctcctttatagcagccgtagtgggttttccctcctgttttttgccaccttttattccaaactgtgctgtggccctgcggtagggctgggtttggccaaaagaattccaatggaaccccctttttttttttccgtccccccactttgtagagctctttgccccccttcccccttcccccctttggtttttatttttaaggccggggtctgccagggagctgggtgccagatagattctttttttaactgggctgtttttttaaatgttattaagccgttttgcctgagggga

SEQ ID NO: 593084 - DNA, 294 bp, Homo sapiens
ctatccatcacttcaaacatgtatcatttctttgccaatgccttgtcttttgtcgtcttaaagtacagatttgcatcatgctttttaaaatttaacattacactataattattttgtagctgtgtttatgtttttctgttttcaagtatcaatatatagtatggatttttaaaaaattggtactgtaaatgtacatgaagtttttctgtctttacaaaagaagtgcatattgttgtatgaattctagaaaatcaagataaggaagaaaattaaaatccttcataatcctaaaaa

SEQ ID NO: 593085 - DNA, 1070 bp, Homo sapiens
  misc_feature (996)..(996): n is a, c, g, or t
gtgttggaacttcgttgcttgcttgcctgtgcgcgctgtgcgcggtacatggccttcaaaacgacttgatacccaactatcaacccaaagctatggggcctagcccactccagctcgcggtgccgggctacttcccagcatgagtcgacgttcagcgcctagcgtggacagccaggattttacacggtggtctaatagcccaagatccatcggacagcgttccagagagtcagtggcccacggagcaagtcctcatgtcgttccttagtggctccagcacggcccagtacactgacaggcgtattggcacagttcatgctcatattcccacaagggtgatcattggcatcggcacattgagcagtgcgtaatgagccgagagtaggcgctggacaggcctcgccacaatacggatacacttgccgtggggtcccagcgcgagagtcccttccccttgaccccctggggcatcaatgagccaccgagacttgaggcacaaaggcttgcccccaagccgaaggccgacaccttccgctggggccaccagtgttctacccgggggtaatgccccacgctctatgcgttccacaggaatggcctagccgcaatgccccttatttgagggggcaacagatctctcacctatggacggctggagcggccacgacccttagccaaaggctccccagaggacccaacgaaacgtcggataagcatctccattaaccattggtcgtggcttgggcgcccattcgcagaggtacacaaaccgtccttacaaaaacaagcccgcttaaactttgtgtcgcgaccaccccatgaggccctatatgagcaccactcacgaagtaggcggcacgcatactgtgttacaatgtttgcacccccccccgctatatacgtacggcgggggtgccattaaccctgtgggaaatccctatttggtgaccaatgggtaattaccgatggcgaaaggcgtttcaaagccaaataagnctctatgggcgccctcaattggggccacaaagccttggtgggggcattgagcagcatttctggcgcgagacaac

SEQ ID NO: 593086 - DNA, 191 bp, Homo sapiens
agcacagaggttaatacttaaaacagcacgatttaggcctggacctccatcagaataacactgatgcaaaatatttatactaactgaaaatcctggggcggtgaacattgattctgcctcaattcttctgaaatcctggttccaagaccgctcacctaccgccaataaagtgcaaaggagtaattagaaac

SEQ ID NO: 593087 - DNA, 332 bp, Homo sapiens
gagaccagactggacaacatagtgagaccccatcccccaacacacaaaaaatctaatttttaaaaagctcacaaagtaaaataaatatatctttaggaagaattggcatggtcgggcatagtggctaacacctgtaatcccagcactttgggaggatgaagtgaatgcatagattttttcgtgaccagctgagaacacatcgtgcaaactgatatatacacaacatccaaacaagttagatgcgactgcttgactgcagaggctacaacaacccagcatcaaaacacaacaccccaacctggagagacacaacaacaccacgtctaagacac

SEQ ID NO: 593088 - DNA, 189 bp, Homo sapiens
agatattattaatcataacctcttgagacagttttcccaactctgagatactatttcaagtgatgtccaacttctaatgaaaatacacaaaacctgaagatttaataatgctttataatgtcaatatcatatagaagcagcaacaaagtcgatgaccaaatgtgacatttttaaaatgccataagatca

SEQ ID NO: 593089 - DNA, 263 bp, Homo sapiens
tccttttccttctcctcttcctcttcttcttcttcctcctcctcctcctctttttcctcctcctcgttctcctcccatcagcaagaagacaaaccgaggacagtcttgaaatatcgaaatttcctctttgggatttgccagcgccaagactgtcggaataaaggacgctgactattgtattattgttattttattaattagtcagtggaaagattacagatgaggaaaggggacgcctgtcacccttcctgtgctaagattta

SEQ ID NO: 593090 - DNA, 161 bp, Homo sapiens
  misc_feature (143)..(143): n is a, c, g, or t
accacctccctcattccctccaccacccacccaacacccagcgaacagcacaaaccctttatcacatatagtggcccagtgctatttagccggaacgaccgagcgcagcgagctgtgtagcgaggaagcggccgcaatatacntctgcatcatgcattcat

SEQ ID NO: 593091 - DNA, 359 bp, Homo sapiens
  misc_feature (342)..(342): n is a, c, g, or t
ccattactttgtcacagctactagactaggctgagtgcaggagattgcttgaatccgggaggcggaggttgcagtgagccgagatcgtgccactgaactccaacctgccaatagagcgagactccgtctcaaaaaaaaaaaaaaaaaaaaaaaattacctttgaaaaaaataccgcacttcagaggaaaccttttttcctgcttggtgtctttccaaagaataaaatatttgaagcttgttttctagccgatggtgtgtatgagggtgacctggctgaggcatcgctcaagctggggggtggtgtgtaaaaggcacgtggagccacaaaaggcccctcctgntgacaacggtgcttggg

SEQ ID NO: 593092 - DNA, 205 bp, Homo sapiens
gtagcggtcccagctagttttgcatttgtagtaaagatggggttcaccatgttggccaggtggtctggaactcctgacctcaagtgatctgcccgcctcggcctcccaaaatgctaggattacaggcgtgagccgcggcacccggccggtgacttttaacttctctgatgaattcaaaatctcttacagagctctcttacgctct

SEQ ID NO: 593093 - DNA, 1759 bp, Homo sapiens
ttgcgtggttgaatctctaacgtatagtgatgactcggtggtgtattatcatctacaacatatgtgggtgagatagactggtttgtcgcgcccctcattagtaggttgtggttggttatcgacgtgcctctcttcacacaaggtgggggggttccccccctacatttgtgctgacgacgggatattgttagtggcttcgccacgcacatgtgctcatgttccctgcatgaagtgctgtcataagactgccgtcgctccggtgggtggacatacaacaaaagagtggggggggggttgcccacacaccacccacccgaggggggcaaattgcttttgttgcacccgagatgggtggtttacctcccgctggcggaaacctatataattcgtgggtgagttgtggtctccgcccacacagacaccccctccgccccgcgttgggagtgttgggtggacaatgagttgggaaaagatgttataactttctttggtgaatttttttcgtcggttgtagtaattttttccgcggcgaccgcctctaaaatagggtgtttgtaaaaaaacaccgttgggggcgcaaagtatcaatatgtccccacagcaacgaagctgtcccatcttggagtaattgggggaatattttttggggggggggagaaacaacaagcgggccggaacatacccaacaagaagaggttggcgccctcccgtggtggggggacaatagggtcggggtgcgaaaataaaagtgggcgccaacgagacggggtttttttcctcctctcccccccgcgcggcacatatgggaaaatgaccgcccagcgacaagaataggaggggggacaacatcgtgaccccccatggcgattatagtagggggcagaaaaatattgtggtgagaggagatgagagagtgggcaactaaataaagaagaattggcgtcgtgttggtttgttttagaatattagcagcgcccccctcttatattggagaagagctgtctcctcctctactacagtcggtgcttataatagaggggagataattataatcaccccccccacttggggggccgctacaaatagtggggagatattaataaagatcgttggcgcggcgagagattatctgtaatatgtgagaagatcctccccctcggtgtggtaagataaagatctagtatctcacaggagatgtcacactctccgcgtgttcacacacacacagtggggattaaagcgcggagatgattattgggcacacttgagagagatattgagaagtatctttctctctgagagcgcctgtctcactcggggatgtctctctctcacatgtccccgcgcggaggttatacaccacgcgcgcggtatatcacacacccagcacagaggctataaagagagaggaatagaggggtgttgcctcacgcctccacacgagaaaaaggcgcacagagaacaccctcgcggggggaacacacccacgcagagaggagacctctaaaagagacctcgcggagacattaagtggaggctttatgggcgtatgagaaattttaaaaactaccacacagggagttaactcgaggcccttatggttttaataccacatggagcacgggagtcaccacctttgctttgagtttttttcacaaaatgtgaaatttggggtccccgaatccaagacctatggttggttttaagcttctccatttggggttttgtgaccaaataaattaactacttgttgggtgga

SEQ ID NO: 593094 - DNA, 449 bp, Homo sapiens
aactagggataagatgtcttaactggccattgcggtttatctgcgctgagagaactacaggtcttacctgccaacatatccaccataattatttgggaatacctttcatacaataacttgtttaaaaaagacctcagattgaaaaagcaacctagattactttcgctctctaatcagcatggcaatgtatttatattgagaatgttctcaaaaagtaactaaaaaattgtgtcggaccctacttttgagaaatctacgtttcccaagtgttatgggaactggctattccttgtcccggcacaccttctcattccttcctttcagagcctaaaacctcatttgataagcactcctagtctctggcctgtggatccagtgctattctgtcaccaacctaagaatcccaattgcaccttctgtttctgacagtcacaggtgacagctgtgat

SEQ ID NO: 593095 - DNA, 168 bp, Homo sapiens
actgaggatatgaagaaaactgatacttctacccttagggacctcttaatctaaaatataacatagtcatcaaaatctatggttaaggccaggtacggtggctcactcctgtgatcataatactttgggaggcctaggcccacggagcacttaagttctgaattatga

SEQ ID NO: 593096 - DNA, 456 bp, Homo sapiens
tcctggaatatatcataggagaaaatgtaggttaccttaggtacgatgatagcttataaatttttttcactcatttaattgttaatatctgtgggtacataataggtatttatggggcacatgagatgttttgatacagacatgcaatgtctgtatttttagtagagacagggtttctatgcttttttacaaacaatccaattatactcttttagtaatttttaatgtacaatttattgactatagtcaccctgttgtactgtcaaatcaaagggcatatttcatctttctaactgtatttttgtacccattaaccatccttgcctcctccccaaacctccacttacccttcccagcctctggtaacgatccttctactctgtatctccatgaatttgattgttttaattttccacaaagaagtgagaacatgtgaagtttctctttcaaaaaaaa

SEQ ID NO: 593097 - DNA, 288 bp, Homo sapiens
tgtagatgtcagctaggtccctccctttagtgtagattgcagcgtgagccttgcctgcacaatagataaacttcgtactggcagctaccgccagatcttccagccagagcaggtcatcacaagcaaagaacatgctggcgataactattgccgagggcactacaccattggcaaggagatcattgaccttgtgtaggaccgaatgcgcaagctggtaagcaccacatataaatatgcattcaatgtaggtgagatagttccagtgcaatttgagtggcgtgcctgacc

SEQ ID NO: 593098 - DNA, 361 bp, Homo sapiens
  misc_feature (305)..(305): n is a, c, g, or t
aggatcacgtgagcccaggagttcaagatcaggctgggcaatacagcaagacccctgtctctacaaaaacaaaaacaaaaaacaaataggcatggtagtgcatacctgtggtctgagctgcttgggagtctgaggcaggaggatcacttgaacccaggagttcgaggctgcagtgagttattattgggccactgcagtccagcctgggcagcaaagtgagaccctgtctgttaaaaaaacaaaaccaaaaacttgattgctgggggccaccctaggagtttctggattcagtaggtctggcggtnggggatggtggggcctgggtaattttgcctttctaacaagcgtccagggtaattgc

SEQ ID NO: 593099 - DNA, 654 bp, Homo sapiens
  misc_feature (32)..(32): n is a, c, g, or t
  misc_feature (62)..(62): n is a, c, g, or t
  misc_feature (119)..(121): n is a, c, g, or t
  misc_feature (123)..(124): n is a, c, g, or t
  misc_feature (135)..(135): n is a, c, g, or t
  misc_feature (140)..(140): n is a, c, g, or t
  misc_feature (151)..(151): n is a, c, g, or t
  misc_feature (177)..(177): n is a, c, g, or t
  misc_feature (179)..(179): n is a, c, g, or t
  misc_feature (234)..(234): n is a, c, g, or t
  misc_feature (238)..(239): n is a, c, g, or t
  misc_feature (292)..(292): n is a, c, g, or t
  misc_feature (333)..(334): n is a, c, g, or t
  misc_feature (347)..(347): n is a, c, g, or t
  misc_feature (362)..(364): n is a, c, g, or t
  misc_feature (453)..(453): n is a, c, g, or t
  misc_feature (457)..(457): n is a, c, g, or t
  misc_feature (460)..(460): n is a, c, g, or t
  misc_feature (463)..(463): n is a, c, g, or t
  misc_feature (465)..(465): n is a, c, g, or t
  misc_feature (471)..(472): n is a, c, g, or t
  misc_feature (486)..(486): n is a, c, g, or t
  misc_feature (500)..(500): n is a, c, g, or t
  misc_feature (502)..(502): n is a, c, g, or t
  misc_feature (508)..(508): n is a, c, g, or t
  misc_feature (511)..(511): n is a, c, g, or t
  misc_feature (514)..(514): n is a, c, g, or t
  misc_feature (521)..(521): n is a, c, g, or t
  misc_feature (542)..(542): n is a, c, g, or t
  misc_feature (544)..(545): n is a, c, g, or t
  misc_feature (556)..(556): n is a, c, g, or t
  misc_feature (562)..(562): n is a, c, g, or t
  misc_feature (568)..(568): n is a, c, g, or t
  misc_feature (575)..(575): n is a, c, g, or t
  misc_feature (578)..(578): n is a, c, g, or t
  misc_feature (593)..(593): n is a, c, g, or t
  misc_feature (622)..(622): n is a, c, g, or t
cccagaccaaagggaaaacaaatcaaactcantgccctcacacatgagccatctttgaattnggatttacaaatttatatattctttcctatggaaaaagaaaaaaaaaaaaacacaannncnntggggtaaggnaaaanttgtaggtganggcccaatgtctgcctaagctaacananagcagaatcatgattcgtgcttttcctgtattttgagtgggatgcagcctaacancccnnccctccgtggtagaccgaatccttcagcagccagaggcccccgaacactgggngggcaaaccgcaaccttccagattcttcagcgagtgccagnntgcaggctctgcntcagactgccaaagnnncggcagctttccttgcaagttttccactgcctaaaaaggccatttttccctataaaaagatgccaggtcaaaaaaaagtacaggggggnaaangtnttntnttttgnngttagattcttgcngtcgcaggctgatntngggcangtnccncgccgcngggctggtgttggttccccangnngccgggccctncttggnctcctnggtcccnccnttgctggggtctgtnattttgggatattttactttcttctggtncagctcgttctgagcccaaagtagtagtttca

SEQ ID NO: 593100 - DNA, 886 bp, Homo sapiens
catctttaagagcatgatcataaagagctatttttgacaccccccccccacttttttaacatttagagttagtaagggtttatatctcttctgtccatatggttttcaaaggaatgaggtgttaggtggctggaaaagcattgtgtaggaagttagatttgaatatagacaacggtgggttattcacgttgagaatgtcattcgacagaatgcctgtgaagccaggtgtgggttctactcagtgccatagatagactgagtcttctctcgtaggttaccattacatagctaattcggattctgaactttcaccatttaacatcattgcgagtttatacagacctaaatttgtacaaatccgtacatatattatttggactgtattacagatgacatatggctgattctacacatttaatttatgcacatagcttaacggaccagaaatgtctgggaaaagtaatgtgttacacataatgatatgtaacttttgaactttttaacataaagttaacaagattttcaatgtgttgtactccactccagggtggtccaccacgtctacatatatactccccttcaagttattacaatagggggtcacctcatatgtgtccgggaatctccatagccacccaactggccttgtaaacgcaatggctgcaaattaaattgggcttgggaattcacccaaggtggaggctaaaggcccactatacatccgggaacctcacaaattacctggtgcgaattaagatgaaggtgtgcaccctaaacttgccgttggaaacaattccccgacaaggccctgctacccccccaaattttggccccatcatgccatgtcctacaccccaaaacattggttcgcgcaacagctcgcaca

SEQ ID NO: 593101 - DNA, 862 bp, Homo sapiens
ggaggaggaggaggagaaggctctgggctcctctgcaaaaataaaaataaaaaactacaataaacattttaaaaataataaaaattcactatatacacatataaagaaataacacaagaagtctcagttgcagctattgtcaaaattaatatccatttcttctttatatacggtgacactattgcgcaaactatagatctggatttcgaaccacttaatgaagcggccacaccaggtgtccgaggtgtcggcattcttcgctgcaatcggctgtccccaatgtttacattattcccaactccatgcacaaatggttctgtgcacttggatgtgaaatgctgtccagttattatttctctgatgtgttatccttggatgtacaaaaaattccagaaaatgatctctgtagatattctgtgtttatttgggtcatctttagaagttatcaggaatgtgtttaaaacaagaagagaacttctctaaggaatgatacctagaaaaagattttattttaaatgagttgtaaacgctgtgttccttcgtcgtgcaagcctatctggcccaccggttatggcaagatggatcacatctcttatgtccgacgaacaccccacacacacacaccaccaccacccacacacccacacccagctacaaccgtgcgggcgccttctacctcccccccgaccggctggttgtggacaacccctgtgtaccctaaacatcaggagcgacaatctactcacaggcgcggcccacgcactcaccccagcgtgccccaattcttgtcgagccaacgggcaccgccatttatgtggccacatacatacacgaacgcgcgaggacctgcactaacgggcac

SEQ ID NO: 593102 - DNA, 405 bp, Homo sapiens
ccgcgcagtctggggctggttgaaggagctgatgaacacggagcaggccttggtccatctcatccagagctgctctctgagcttcaagcacctcactgaggccacggccaacaagaggctggcctatgtgacttaccaggatatccgtgctgttggctactttataggagcagaccgtgattgccgtcaacggcccctccgcagacgagactggaaatgcccgacaggactgaggaccacctgctgatctatctcacgagcaccctgggtgcccactcgatagtctacctgtgcccagaggatgtgcgctcgagccggacagtccttccgaggagcctctcccctcttcctccagcctctggcccggccctgactcttccacgcctcagctgcgggggtaccgag

SEQ ID NO: 593103 - DNA, 365 bp, Homo sapiens
cataaaaaaaaaattatatggatattgcatagttaagtagcacacccaaaatgcaactttgaggccaggcgcagtggctcatgcctataattccagcactttgggaggccaaggcgagtggatcacctgaggtcaggagttcaagaccagcctggccaatatggagaaaccccatctctcctaaaaatagaaaaattagccaggcgtggtggcagatgcctgtaatcccagctatttgggaggctgaggcacgagaattgcttgagcccaggacacagatgttgcagtgagccaagatcatgccactgcactcctgcctggctgacagagcgagactctgtctaagaaaagaaaagaagtcgacg

SEQ ID NO: 593104 - DNA, 215 bp, Homo sapiens
tgatgctgaggtgcttagaggatccccccggtcagtcgctctggcgtggaagtaagatacaagagaatcaatctaacggttccgaagaaacttttacttcctagtatcaaatgatcgcctggtattactggagtttctcagtgacatctcagcggtgcaggggctcacaccggtaatcccagcacttggggaggccaaggcaggcagatcacgag

SEQ ID NO: 593105 - DNA, 281 bp, Homo sapiens
tagaggttcctctctggatgcaagtgtccagtgagctgggtggtgtgggcctgtgcaacacccagtacgcccgtttggtggagatagtggagctcttttgccttcaggctggtgctcaccattgatggaatccttccttgactggcggtagactactggtgaagtgactgtgccagttgaatttgggggttattcaccagttagacctacagtgattcatgcttcttttttcccaggaaactgcctacctgtgtagaagtgctgtctgagtatccctggtt

SEQ ID NO: 593106 - DNA, 635 bp, Homo sapiens
  misc_feature (116)..(116): n is a, c, g, or t
ttgaaacagaagagctagacacagcataagtttgtaaattagatcctctttagaggattgcatggaaagttgaatgatctattgttttgatatggctgtttcatcttagttaattnaaatgtgtgatatttaaagtaagtaaatatgatagttaaaagaaagaggaatctttagtttattgtagttctaggatgctattgtgcttattttgctgtcccctctttctaaattcctgtgcttttgctccactgtagtgattcgttgcagttatacaacttgtgtgaattcagcaccctatctccatataagtagattagttgagtgacctcttgaagcagaatatctgggttcaagtccttatcgcaccttgactattctatttgccaaattttattagtaagctcttggtgtctgtttccaaacgtgtaaaatggggataatggtgatacctacctatatatgagattgtcgtaaggagttagatgagataatttatgtcaagagcttaatacctcttgtacccaacactgaataaatgtggactataattatgattattatccatgggagatattgattgtcaatcaggataaaaaccaaactgtagagtttctttaaagagcattaaaaaaaaa

SEQ ID NO: 593107 - DNA, 110 bp, Homo sapiens
tatatagctggtacccacgatggctctagtcacggttggctctatgtccacggttgtggagatggtagagctgtggcagccagttttctgcaagccaaccgtggactagt

SEQ ID NO: 593108 - DNA, 290 bp, Homo sapiens
tcgatctctagcaggatcccctccacgtcgaatatcaatccaacatatctattttagatcttatacagtgcgcccccgccccacttaagaaaaaatagtgcggggaactgggcgaaagcatgtaagtttacaggcggcttcaaaacagctaacagcttgaagctcaaattccgcagagaaccgtgtaacttcagcgattgagacgtgaatatcctgtccattaggaagtttatcgctattcacatttatctcgaataggtttgtctggaccctagtattcgcacgtgtga

SEQ ID NO: 593109 - DNA, 115 bp, Homo sapiens
ctgggtctaacggagacacagcgtcatcgtcgtgttcattggggaggctaatcggattgtcgtcgtgttcataggggaggcaacggaatgcgtcgttttcatcgaggagtgcttg

SEQ ID NO: 593110 - DNA, 419 bp, Homo sapiens
  misc_feature (110)..(110): n is a, c, g, or t
cggcgccagtggcgaccggattaggctgagctgagacattccggctgaaggttcgagcggccgctgcggtagtcatcagacattcgcctggttggggcttgtatgtcggntgcatcaccgacaccaggcactcaacacggtgcgttctggatgacctcctcgcggcgatgcatccaggccaaacgccggacggaccagccacttggccagccatacatcggcatccacgttgaagtccttcgtaaccccaagcaatcgctcgtactcgggcgtctgtgcgaagcgctcaagctgatccagctgacgccgctgatcggcggtgaaggcgccaacatacttcgtcatgtggaaactcaccgtttgtgggtaatcgctatagatcccgtgtcagcaggcgcgcctatcctttggagaggcgt

SEQ ID NO: 593111 - DNA, 229 bp, Homo sapiens
ggcatcagattcactgagagacatattacaatgaggacatctggttatacagatagccgctttgcaatcaggtaactcatgtcatctgcccacttttctaaattgaatgtgctttcattagacggttgacgacatactccagatatgagtcctttgtcagatatgtagcttgtccatatttagtccatgtgtctagcttgtcttttcaccattgcaacacggtctctca

SEQ ID NO: 593112 - DNA, 289 bp, Homo sapiens
acggacggccggtctggcctggtggctgctgtgaacggccgttcgcaatccctgggctcgacatagtgctattaggttccatacatcgctccatatcccattcccgcctggcccacgtgctcctgcgtgcgcgcagtctcgcagtttgtcgagtccagctcctactactagtacctccgcccgcccttcgactgctcctaggccatctactttgggaccttctgaccagatcttttatttgtgctcccagtactggaaccgcggccctcattaaggtccgtccacaccg

SEQ ID NO: 593113 - DNA, 324 bp, Homo sapiens
tgctgagattacaggcgtgagccaccgcgcccagcctattttttggtattttttatagaaacagggtttcaccatgttgcctagggtggtctcagactcctgggctcaagcaatcttcctgacttagcttctcaaaacactaggattacagccatgagccaccttggctagctgatttcttttcaaagacaacgtcatagttaaagtgttaagattataggtgtgaaccactatgcccagacttgcactaagttattattatcgttaatactgtgtctgatttagaatttaaactttatagatacatatgtataggaaaaaata

SEQ ID NO: 593114 - DNA, 141 bp, Homo sapiens
tgaaacgggggcacctcttgttgcagacggaccagcccatttacaaccctggccagcgggttcggtcccgggtctttgctctggatcagaaggtgcgcccgagcactgacaccatcacagtcatggtggagaactctcacg

SEQ ID NO: 593115 - DNA, 87 bp, Homo sapiens
tcagaacccagggactcagctgtgtacttctgtgccagcagtccggggacagggggcgtcaagggcaccggggagctgttttttgga

SEQ ID NO: 593116 - DNA, 263 bp, Homo sapiens
cttgtttcactttaatctctgcctcactggattacaagcacattcattctgcactcagctctcctagagatagagtgggacacacaaggcaccacgccaccacactcgcctaatttttttgtaatttttagcagagactgagcattcaccgtgttaaccaggatgaccttgatctcctgacctcgtgaaccacctgccttggcatcccagggggctgagattataggtgagagccactgcaccaggctggcgattgtattttg

SEQ ID NO: 593117 - DNA, 181 bp, Homo sapiens
  misc_feature (24)..(24): n is a, c, g, or t
  misc_feature (115)..(115): n is a, c, g, or t
  misc_feature (132)..(132): n is a, c, g, or t
aaatatagtacaaatcaaacacanatggggtgtgaggatttaataaatgaagtctggaccattggtgtgtggccaagctccagaaagcagtctgatcattcatgtactggcaggngtccatttatttctaantcatcctgagcttaacttcatttaaaggaataaattaatcggtttttaa

SEQ ID NO: 593118 - DNA, 1771 bp, Homo sapiens
tataatagtctggttttaataaaaaacaagttgtgggaatcaatcaatggtccatttcaggaagcttcttgtctgaatctccgaaggcacagcttggtgttctgttacccgtgtctcagccagcctgtgggggccgtgggttgtgtcctcctttgttccatccagcgtggtctccattcgtgctcgtgcatttttttgtgtctcctcttttgtggaggttcccactttgtgggtttgtgggctttgtgaaatttattagcgcgcataccaagtatactgtgtgttcacgcctccttataatttttatacgcttctcaattctctctatttgtgcacttgtgacaactgtggaactccatgtggtctcaaaacctcgtgcgcgtgtgtgtctcgtggcagagatttatagcctgtgtgtgtatattctcatgctcacaactgctccccatgtgtgcgcttctacatatgtgtaggtgacctatatttatctctatacccccttttgtgtgctccatgtgtgttacagacagaagacatctcacagaatgtggatctacatatagcgtggggctccccctccgagtggtgtattgtgttgaaagagagaagccgtgggatcatatatttctctacatatatttagcgtgggctgtgcaaatctctgttgtgtttctcccccctaatagttgttttcccttcttcacaagatgataaatatctgtgcgagggctgcgtgtctctttttcgaggagaatatttcgcgtgtggaaaaacacggtttatctctgtattaagcataggggggttgtggaaccctataagaaatttgttttctcctataaatttctcagcggccccaaaagttttcatattctctagcagccaatattagaaacctttgtgggcgttgtaggggggcggtgagcgcgccctaatctctcgccaagttccgctctcatatatataacaaaagcgcccaaaagttttttcttccaagggaaaactcctttatccccaccaacgctcttttacacaaaacaaggtgaaagacaacatgtcgtgttgcgacagcagaattcctaatttgtttgccaatctttcccagcgcaaataatgtttttgcctcaccagtcattttttgtccgacgccacaacatttaaaaagggctctgtggtccttccctcacacacattcttgcgaatacaacacccggtctttaatttttccctctcgccacagtgtggggggtttgtctcataaagagcagttacatatatatcacccggggatgccacttatctcccccccgagggttataattcccccggcggattaggagaccaacattcttttaagccccttccaattttttccccagctgtgttcccaccgcgtttgtgaggcgcactctcctctcgggggtaatatttgcgccccaaaaataagcggggagattctccgcaagtgggggagagggcccccccaagatactgaggggtcttacacaatattgggcgcacgcttgtgatagggagaagcagaagtgcagaccacgcccccattcatatccagcatagggatactcagcaactatgacaagaaaagagagcaccgaacattagaaagacaccaccggccaaaatatcatgcgagaggaaacgagaagcaagcgagagcgtcaccacaaaagaggtacgcccccgcatcgaagcaaatatcgtatctccaggagcgtagtaaatacatcacatagacgacagcgtcaaacga

SEQ ID NO: 593119 - DNA, 496 bp, Homo sapiens
ggggggcccccccggggggggggcgccttaaaaaaagggggccccccccgggggggggaattggggggggggggggggggcccccccccaaaaaaaaaaagggggcccccttttttttttttttaaaacccagggggggggttttagggttttccccccccccaaaaggggggggggggggggaaaaattttggaaaaaaacccccccctttggggggggggggggggggggtttttttaaaaaatttttttggccccccaattttcccccctttccccccctaaaaggggggggggtttttccccccagggggccttttttttaaaatacccccttttttttccccccgcccctttttttttttttccccggggccccccaaaatttttttttggggggcccccaaaaaaaaaatgggcccccttttggggggggggggggggttaaaaaaaggggggaaaaaaaaaaaaaacccggggggggtttccccccaga

SEQ ID NO: 593120 - DNA, 1032 bp, Homo sapiens
  misc_feature (8)..(8): n is a, c, g, or t
  misc_feature (771)..(771): n is a, c, g, or t
tttatttnttgcttgatctgcggctctcttagcattatactggcgcagtgacgctttgagccgctttttaatatttatcgctcgcatcgtgtcctatcgcgggcctccccagtttaagcagcatggagccgcggccgctgtatgtagcaagctctggtgcacccttgtggaattgtccctcccggccttaattagaacacaccttccggggcccctcaaacggacccaggggagtcacaagcactgcagaatctcccctcctcggtgtacgggggcaccaacactttgttccctgcggggcagtgaaccgtttcttccacgcgcgcctggtgtgctgtctgcccgtcccattacgtctccacctcccgattggtgtcgcataaagccgtctcctggatcttaaggtgtcgttgccacccatccgggtatatagattcccccgcggggtgcccacacatcttttgatgccgcacagtggcccccatcaacgagatgggggcgaccacacggtcccctattatccccggcggggcgacccccatctgatgatccttgcgggcgaggagatcacatcccccaagagttcccgcctgcccgtagtgttgctcccctgttctggtagatgcccccgggcgtggcttgttggacacgcctctctcctcccccccgggagagtgagctatgccccacacgacaattggtttgcttgtggcgactctccaccaaatggaggcagcagacatttctctgccccggactgatgttgtagcngggcagcccacgtggttccccgcagtgaggagagctccacaggcagattttttcctcaggggcggtattttgctgttaccccccagagtagccgggccgttgggtcttcactcacccaaggttatgaccaactaatcggggtgcatctggtgattagtgcaccccagcatgcctgtcccgccacaggctatggaagcccccggagtcctcctggaccctgttttaaacccaaaaaggaaccccgtttcccccaaaaaaaca

SEQ ID NO: 593121 - DNA, 678 bp, Homo sapiens
gtcacatgatcctaaggcttcaggaatcggaggaagtggctgacactgacttaccattttaaccaaacaatcactgcacttaagcttggataagggtcaaataaaactaacagggctcttatgcaagcccttccagtctggtaagttatgagtatttatgttttatttccccccaaaaacaataagaccctcagaggcaaggaactcatcttggtttttgtcccttacacacctatctcagtccagtggtatgatgggcactggaaacaaaccacctggttcaaatcctggcttggtcacttattggccaagtggcctgatatggtttggctgtgtccccacccaaatctcatcttgaattgttagctcccataattcccatgtgttgtgggagggacctggtgggagagaattgaatcatgggggcggttttccccatattgttctcatagtaatgaatatatctcactagatctgacggttttataaagtgtttctcctcttactagactctcattcttattttaccttccaccatataatatttaacttttcttcctcttacctttttcattatttttaagcctccccaaccttgccaaattacacattttaactttattaattaaacctttctatttaattaaaaaaaataataattccctcctttacaacacg

SEQ ID NO: 593122 - DNA, 257 bp, Homo sapiens
  misc_feature (64)..(64): n is a, c, g, or t
  misc_feature (67)..(67): n is a, c, g, or t
  misc_feature (69)..(71): n is a, c, g, or t
  misc_feature (118)..(118): n is a, c, g, or t
  misc_feature (132)..(132): n is a, c, g, or t
  misc_feature (171)..(171): n is a, c, g, or t
  misc_feature (235)..(235): n is a, c, g, or t
  misc_feature (252)..(252): n is a, c, g, or t
cccgacgattgcaacgagacggctgccacctcttcgccacgcagatgaatattgctgggaagancgncnnncagcagtacacgctgcggtcgttgtcgggacggttcagcgaccggancttccgccagtaantttacgcgtataaggatgctgcgggttttcgaagaccgngcgccgtggaccaatttcaacaatttgcccgagatacatcaccgccacacgatgactaatccgntctaccaccgccatatnggggg

SEQ ID NO: 593123 - DNA, 310 bp, Homo sapiens
agcaagacaagtgagacaaaagggcgacttcacagtcttcaagtacatagaatccctgatatcaatggaacttacatatgtaatttctgggggccataaaacacaccaacaaaaacctgtgacaacttagtcctactcctttaaaaatgagcttcgactctgtagtctcttaaggcacaaaacctgatagcacggcatctcactggtggcctgcacctctgatttggcatcctcaaaacacaactattgacatttcaataacaataaaccattttgttagagctggagatcctaggatacagcagggaga

SEQ ID NO: 593124 - DNA, 135 bp, Homo sapiens
  misc_feature (35)..(35): n is a, c, g, or t
  misc_feature (71)..(71): n is a, c, g, or t
gcgagacttctggcactttagagcaactactcctngctgttgtgaaatctattcgaagtatacctgcctancttgcagagacctctattatgctatgaagggagctgggacagatgatcataccggtagcgagct

SEQ ID NO: 593125 - DNA, 902 bp, Homo sapiens
gccatgcccggctaatttgtgtgtggtgtgtgtgtgtgtgtgtgtgtgtgtgtgtgtgtgtgtgtatactagagacggggtcatccactttgttggccagggctgctctcgactcctgaccttgtgatccacctgccttggcttcccaagtactgagatcacgggtgtgacccactgcgcctggccttttttttggggagagaaaggtcgtgttgtgacatctaggcgggagtgcagtggcacagacatagctcatggggcgcccccaacttggggtgtcaaggtatcctttacgcctcgctccctccctagtagctgagactacaggtgtatgtcgccactgcgcccagctaatatttcacattgtgtagagatggacgtcttgctgtctcgcccaggttgggtcacagactcctgggctcaaacagtcctcccacctcagacccccaaagtgctgcaagtacgggcatgagccactgagtccagctatcttcaactttcactattcaggtcacagtgtgtagctaccttaacgcgggggagtggagagaggggttcggtgggagtaacccccaaagattctgggagaacaagggtaagaacttggtccaggaactgaaaaacagtcggttctaaaccccatggttcacaaaagtaggactccgagccccaaaatgaaaacacgggagtaaacaccctcatgggggttataggacaacaacaacgccctactagaaggactgtagaacatgcgccaactaaaaaaacagggcggtgagccccacacaagacgtcgacacgggaaaactcacctagaccaaatcgttacacaaattgaagagtgagcgcggaactagaaagagaggcaatcaagaagaatcaccacgaggacaagaaagtac

SEQ ID NO: 593126 - DNA, 890 bp, Homo sapiens
tggagctgttctgctggtcacgggctgggggctgccgtcagtgaagcctgtgacccgactggcgtgtctgacctatgccagatttactgtgtgctccagtgaaggtacacaatgatcagcacatcccctgcgcagagcccttcaggaactcttgcctggccttcgcgaccagttcatggacgaggtcagtctcagattccacagcaaggagtcatcactccagacctttctgcaagaagagaaggtagcagagtgctgagttactgactcgtcgtgcaagcatccgcgccaaaggtggtcagagacagcgccatgggccgattcgatgtcgtcatcctttggatggcagaagggttgtcatcgcgcgggatgacgtggtaggctatacgttggtatctggagtaatgacagccgaaagaagcggtacgttgagaacggtgcatccacgcgatatggctggtagtgcacggatggctagtgctcacttggtccgccatcaagcttcgtatacgcgtgcgctggaaccgatatgtcgatgactggcgagtacgatggcatacggctacatgactggtctggactgcgggcagcagcgaggcactgagagagcaggaggagagagcgtggacgaagggacgactgtagccgaagaggctcgcggagtgtactgacgccatgactctcttcagcgcctggagctctcaacaagttctctccttctggagatgcccctgtctccttggacgccttcgtacttcagactactttgggccctgtctgctgcaggcaaaagctgcccaggtgggcaagcgtgcaggtccacctgcgtgggcctgcacacacctctgtgctatttgtgcccacagtgctcagtctctagttacccctgg

SEQ ID NO: 593127 - DNA, 837 bp, Homo sapiens
gctgattctaatgtcacctaggcaccacgtagtctctcagaagtacggataatagaatgggctgacgcgaagaaaatcatcccagatcgtggacccttgggagagcgtagtttaagattttgaatgtcgtagcgaagtgagcatgtcgaatcgcgcagagtggagtcaacaggccaggacgacacgcctgatggccgatagtcctccgcgatatcaagtcggagacggcatcgtcgtgccaagatgacgctcggaagcagaggtattgcagtacttgaaaggtcgagccagtggccgaggacgagtcacgtaacaagagagagcccgagagaggttggggggtgggcttatatttcgcgaagcccgaagttgggcctgggagctcccttggcgtctcctaggagggaacactgggccaattttttcggcccaacgcctttaccgtgggtattcgaaagagcccccaatggtaccgggaacatttcttcaccccaaatggggcgccccacgattccgattcccgctctatccgggtactacacagatctcggagagagcactgtggggatctgcgcgcgtttaaccaagttggggcgccaaaccgcccggggcccaaaggaggcgccccaaccgtcaacccaagtaggcttgttaccgcccaaaccccgttcgggagcgagtctaaaatcacccgttggttcaccctctaaattcgggcagaccacagaggaggcgccaacctctcggggttgaacatttccccccggcgaagcacgattggccttcgggtttcaatttgggggggccccggggcacctttgcgctccaccggggaga

SEQ ID NO: 593128 - DNA, 225 bp, Homo sapiens
tgtggtacaagcaatcctgccacctaagtcccccaaatatgctgggatacatggtgtgacgccatttgcctggctgcatatttcataattaaatgtgaccagaatgtctagaaaaaaaaagattagaagacagctagtgcccccatgttcgaaataagaaccacagttcacaatgggggactggtgtggtggacatgggccttggctctctggctctcccttgcc

SEQ ID NO: 593129 - DNA, 713 bp, Homo sapiens
ggtcactacttttcagtaacaagaatctgcatcctggtaaaccagaagaaaatagtatgagacggggaatcatcgtgtgatgtgtgtgctgcctttggcttgactgtgtggagtcctgctcagtgtgttgaggtacatgtgtgttatgatcgtggttggcttgatgggaacccgctgttcagagctgtgactgcggctgcactcagagaaagctgcccttggctgctcgtacgcgccggagccttctctcctcgtcatcatccaagagcatgccatgtgtcctgggaggcagaagatgccccactccatgcctgcatccattccatcccgtgtcccaggggtcacggggcccagaaggcatgccttggttctgtctgagtgcctgcctggtgaccctttgcgtggtgcttaggagagccaccacgtagctactactctccgtgtacctggtcctccacctagcctccctgcatctgggactgctgttaaacggggtctgcagcctggctgaggagctgcgccacatccactccagtgtaccggtggcagctactgtaggactgtgcgggcctgcctgggctgccccctccgccgtggggccctgttgctgctgtccatctatttctactactccctcccaaatgcggtcggccgcccttcacttggatgcttgccctcctgggcctctcgcaggcactgaactatcctcctgg

SEQ ID NO: 593130 - DNA, 484 bp, Homo sapiens
actggcttctccaaaaagtcatacaagagagtgcccaagatgcaatctgccatctttttgtaacctaaaatctgaaatgacatcccgtcagctctgtattttatttgataaaagtgagttaatatgtccagcctacatgcaaggatagataattacattcagacttaaataaaaggagtcaaggatcacttgggtctatgttagaggcagcctatcatagtcgatccaatactagttggatggatgaatgaatggatggatggatggatggatggatggatgtggagggatggtcagtcaggcagacagatgatgggcaaatagattaatgctataccacaatataatttaatttatgttgcatacccaacttaatcctgaaaaacttgagactatttaggaaagattgaccaggatggtgagaggtataactattttccttctatatataaaagttaaaatattctataaccctttgccttta

SEQ ID NO: 593131 - DNA, 849 bp, Homo sapiens
  misc_feature (10)..(10): n is a, c, g, or t
  misc_feature (96)..(96): n is a, c, g, or t
  misc_feature (175)..(175): n is a, c, g, or t
  misc_feature (201)..(201): n is a, c, g, or t
  misc_feature (204)..(204): n is a, c, g, or t
  misc_feature (226)..(226): n is a, c, g, or t
  misc_feature (249)..(249): n is a, c, g, or t
  misc_feature (410)..(410): n is a, c, g, or t
  misc_feature (412)..(412): n is a, c, g, or t
  misc_feature (475)..(475): n is a, c, g, or t
  misc_feature (478)..(478): n is a, c, g, or t
  misc_feature (488)..(488): n is a, c, g, or t
  misc_feature (490)..(491): n is a, c, g, or t
  misc_feature (494)..(495): n is a, c, g, or t
  misc_feature (529)..(529): n is a, c, g, or t
  misc_feature (533)..(533): n is a, c, g, or t
  misc_feature (538)..(538): n is a, c, g, or t
  misc_feature (593)..(593): n is a, c, g, or t
  misc_feature (596)..(596): n is a, c, g, or t
  misc_feature (598)..(598): n is a, c, g, or t
  misc_feature (611)..(612): n is a, c, g, or t
  misc_feature (639)..(639): n is a, c, g, or t
  misc_feature (685)..(685): n is a, c, g, or t
  misc_feature (695)..(695): n is a, c, g, or t
  misc_feature (698)..(698): n is a, c, g, or t
  misc_feature (729)..(729): n is a, c, g, or t
  misc_feature (747)..(747): n is a, c, g, or t
  misc_feature (764)..(764): n is a, c, g, or t
  misc_feature (808)..(808): n is a, c, g, or t
  misc_feature (810)..(810): n is a, c, g, or t
ggtcgggctncgggaatggtgggcggcggtcgccgggtggggcgcgacggtagcccagttctgggcggggtgggaacccagacgggggacccctangcgccgggcctccctctccccgtacttttcccccttcccagtcatttcttctgcggaactccacccctccagtgggtgngggaccctaggcagcaggccaggcancgncgctctgactgggggccccganagcagttaacgggccggacagcnaagtggacaacgttataccagctgggaccatgggtgaggtgggcacccggcatgcgggaggagcggccgggcttggtcatctggccccctaacttgctctcgatcctgccggtctcgtcaccgcatgaagccggtgccatctgtgggggctttgggccagngngtctccggacagcatgagcgtgggcttcatcggcgctggccagctggcttttgccctggccanggngcttcacagnanncanngcgtcttggctgcccacaagataatggctagctncccnagacnatggacctggccacagtttctgctctcaggaagatgggggtgaagttgacaaccncanancaaggagacggtnncagacacagtgatgtgctcttcctggnctgtgaagccacacatcatccccttcatcctggatgaaataggcgncgacattgangancagacacattgtggtgtcctgcgcggccggngtcaccagtcagctccanttgagaagaagctgtcnggcgtttcggccagggccccagggtcatccggtgcatgaccaanantccagatcgtgagtgcggaaggggggcaccgggaaatga

SEQ ID NO: 593132 - DNA, 267 bp, Homo sapiens
  misc_feature (78)..(78): n is a, c, g, or t
  misc_feature (214)..(214): n is a, c, g, or t
gattttttcctattttaagtagagatggggtttcaccgtgttagccaggatggtctcgaggctaatttttgtattttnagtagagaaggggtttcgccagggtgcccacgctgttctcgaactactgggctcaagggatctgcctgcctcagcctcccaaagtgctgggattacaggcatgagccaccagcaacacggccagattcttctacanccttaattgggaggtaaggcttctgctttcaggctgtgcgttcttccagccag

SEQ ID NO: 593133 - DNA, 200 bp, Homo sapiens
taccggaactgatgatgtctgacggagtaactacgtacgatggcatggcccgagcgtggtgtcgactgaactgcctagtcccccaaggcctggttctacctcagcgggccgggagtgggggtgactgtgcgcaacaaggttctcgtcgttcgctggaggagaggccacacatgtgtcggagatagtatagtcgtaaggac

SEQ ID NO: 593134 - DNA, 112 bp, Homo sapiens
ctctgacggatcccgagagctcgcggatagggcgcatgcagtgtggggaagtaatggggtgggtttgtcatgttcaaactgtcattttatttttacgttgttagatatgggg

SEQ ID NO: 593135 - DNA, 124 bp, Homo sapiens
gacgatttcatagcaggatccccgtgtaaacccctttatccaattctctccccactcctttctctcagtcttcttacaaccatatatctgctttctgtctccatggattatagcctgatatgaa

SEQ ID NO: 593136 - DNA, 729 bp, Homo sapiens
  misc_feature (10)..(10): n is a, c, g, or t
  misc_feature (96)..(96): n is a, c, g, or t
  misc_feature (175)..(175): n is a, c, g, or t
  misc_feature (201)..(201): n is a, c, g, or t
  misc_feature (204)..(204): n is a, c, g, or t
  misc_feature (226)..(226): n is a, c, g, or t
  misc_feature (249)..(249): n is a, c, g, or t
  misc_feature (290)..(290): n is a, c, g, or t
  misc_feature (292)..(292): n is a, c, g, or t
  misc_feature (355)..(355): n is a, c, g, or t
  misc_feature (358)..(358): n is a, c, g, or t
  misc_feature (368)..(368): n is a, c, g, or t
  misc_feature (370)..(371): n is a, c, g, or t
  misc_feature (374)..(375): n is a, c, g, or t
  misc_feature (409)..(409): n is a, c, g, or t
  misc_feature (413)..(413): n is a, c, g, or t
  misc_feature (418)..(418): n is a, c, g, or t
  misc_feature (473)..(473): n is a, c, g, or t
  misc_feature (476)..(476): n is a, c, g, or t
  misc_feature (478)..(478): n is a, c, g, or t
  misc_feature (491)..(492): n is a, c, g, or t
  misc_feature (519)..(519): n is a, c, g, or t
  misc_feature (565)..(565): n is a, c, g, or t
  misc_feature (575)..(575): n is a, c, g, or t
  misc_feature (578)..(578): n is a, c, g, or t
  misc_feature (609)..(609): n is a, c, g, or t
  misc_feature (627)..(627): n is a, c, g, or t
  misc_feature (644)..(644): n is a, c, g, or t
  misc_feature (688)..(688): n is a, c, g, or t
  misc_feature (690)..(690): n is a, c, g, or t
ggtcgggctncgggaatggtgggcggcggtcgccgggtggggcgcgacggtagcccagttctgggcggggtgggaacccagacgggggacccctangcgccgggcctccctctccccgtacttttcccccttcccagtcatttcttctgcggaactccacccctccagtgggtgngggaccctaggcagcaggccaggcancgncgctctgactgggggccccganagcagttaacgggccggacagcnaagtggaaagccggtgccatctgtgggggctttgggccagngngtctccggacagcatgagcgtgggcttcatcggcgctggccagctggcttttgccctggccanggngcttcacagnanncanngcgtcttggctgcccacaagataatggctagctncccnagacnatggacctggccacagtttctgctctcaggaagatgggggtgaagttgacaaccncanancaaggagacggtnncagacacagtgatgtgctcttcctggnctgtgaagccacacatcatccccttcatcctggatgaaataggcgncgacattgangancagacacattgtggtgtcctgcgcggccggngtcaccagtcagctccanttgagaagaagctgtcnggcgtttcggccagggccccagggtcatccggtgcatgaccaanantccagatcgtgagtgcggaaggggggcaccgggaaatga

SEQ ID NO: 593137 - DNA, 233 bp, Homo sapiens
tcccacgtgtttctagtaagagcggcatacaatgtgcttgaaagtacaattaaagacagtatttatgtattaaaacgaataaaaaacgctgactgtggattcataggccaccatcccatgctactaatctcatggatcttcctcactttgatagtaaatactgttatgtatcgatatcatatgtggactttacacctaagacatgaattttcctcacacacaacctagcagaa

SEQ ID NO: 593138 - DNA, 985 bp, Homo sapiens
  misc_feature (311)..(311): n is a, c, g, or t
ggccatgccaggaatctgccttaccgtggcgaggttcagtcttgtagaaggtgcctcttcagggtacacagatgtgtcgtcgtctgactgggctgcataaatcaaaagcctgatgttcgtgtccctctcatagggggagcttagggacacaggaccagttagagaaaagggtcgaggtaagggtttccagtctgcacattgtagagggaacactcctgtgaggtgcccgatgggtccctatactagagaggttgagtgaatttgcctgtcagttgagacattgggaccttgctgttgaagcttacctcttngcttcgccatagagatatgttaagcattttctgtcaacatgttataaactcagcctctggtaacagtggcgccagacgctgctttgtgctaaaagcgtgggaaatgtagaggcagtctttctctgggaaatggatgctattctattctgctggccctacctggttccgtgagggctcaatggttatgaaacgaaaatcccctcgagaaggctgtctggcacccagtgtagctagccaggccaagtgatatgagaaaggtaagtccatttagccgcttcaggtcctcagtggattagttaatcactgctgtcgctcggtccctttgtgcctaaacgggtatagtactgtcgttttctccttttttctatatgctggtaaatatttacattcagcaggaagaggaggcagatgtcgggccaggtgccatcttttaacgttgtagggccgccatggagggacctgctcttgggctcgtgagcttttgctatcatgtccattcgggcgtcccctaaaaagcaccttggagggggggggtggttcccccggatgggtatggttggaactggtcagaatctggtggaatggggtgcacactcaaggggcgcaggtgtttggacgtctcaaacaaagggggcggcgaaaacaaaaaaacctgggcggaaagcagcgcccat

SEQ ID NO: 593139 - DNA, 630 bp, Homo sapiens
  misc_feature (2)..(2): n is a, c, g, or t
  misc_feature (106)..(106): n is a, c, g, or t
  misc_feature (114)..(114): n is a, c, g, or t
  misc_feature (122)..(123): n is a, c, g, or t
  misc_feature (126)..(126): n is a, c, g, or t
  misc_feature (132)..(132): n is a, c, g, or t
  misc_feature (148)..(148): n is a, c, g, or t
  misc_feature (151)..(151): n is a, c, g, or t
  misc_feature (168)..(168): n is a, c, g, or t
  misc_feature (170)..(170): n is a, c, g, or t
  misc_feature (186)..(186): n is a, c, g, or t
  misc_feature (200)..(200): n is a, c, g, or t
  misc_feature (216)..(217): n is a, c, g, or t
  misc_feature (225)..(225): n is a, c, g, or t
  misc_feature (231)..(232): n is a, c, g, or t
  misc_feature (315)..(316): n is a, c, g, or t
  misc_feature (320)..(320): n is a, c, g, or t
  misc_feature (431)..(431): n is a, c, g, or t
  misc_feature (558)..(558): n is a, c, g, or t
  misc_feature (587)..(587): n is a, c, g, or t
tntgctgataagcagtcaaaacatttaaactcaaaattgacaaatcaactagcttgctttttgtcatttgggagactaccattattcaaatttattatgtaatacnctcctccngatactgnnacntctgcnccccccagtgtgggcntcncctcctctgtgcctaancnggctattatccatgantgccgacgtttgangttcgcccggcatatnnctcccatngcaaanngtcctaattacagagtttacaaatcagcagttttattttcaaaagtacatagtaagtcccgactgggctattgccaaagaacnnatcnttagtctacttccacatgttacatggtattcctgactctacagactatccgcctctgtggaggttagctcctaaaggtcccaaagaacaggaaacatgccggaatacaggnctcctcatgacgagcaggtgggagcgagtgggcaggcctgtatcttctcagcaaagtaaggattgagtatagagagctgtttgtcttaactgggcttccctgaagaatctgagccaaactggaaganaccagcctcatttccagtgttgagatgtnagctgtacagtggctgtacaactgcagagtttatttatagaat

SEQ ID NO: 593140 - DNA, 995 bp, Homo sapiens
  misc_feature (995)..(995): n is a, c, g, or t
gcgagatcgaggtggagatcatcccggtggataccatcgagaccacagtggtgggcgaggaggaggaggaggacgacgacgacgaggacgtgcgcgcggtggcgtacacacgtgtcggtcggtgggcgtgccatcgggcacgccggctcgacctaacaccacctccatcatcaccagcagctacccgcccatgatcgttcttgcagctcgtctgagtctaccgacggatccctgactcctagggtgcatgcaccagccagtgaggatgatcctggttgcagtacgcgcgagtgaggttggtgcggctggcgtaccgactctgtggactgggctgtcgcgcctgatgcgtaccgtgcttctgaggcatcttgattccttcctcccggtcgcctcgcgcttggcccggctggcgactcatcggagcatactactttgaacgagggactgcttggtcagccgtggctggcggtgcccgccatagacgccggcagtgctggctggacgtcgtcgctcttctgcgcgacgtgcaggaccgcggtcaaagaaaggggccggggagctcatcaagagtcggcccgaacgagttacctcagtcggccgtgggccgtgctgcggcgtgagcggtcgtgccggcgccgacccgcggcacacaagaggggtggtatcgagaatgcaggttgctcgatcaagacccctggagggctgaatgttctcgcgtcctgcagtgtgggtcctcagcatgatccaggatgttgttgacccatgtagactagtggttgaaagaaacccagactcattggggggcggaactcgagcctaccttgattcattcgcgaattgttttgctcgcggaatgaatccttttctgcctggagcgtgaatacctggggatttgccttgtccgtgttcctggagatctgggcagagtgtgctagccttgacgccgcctaatgttggcggacgatgatgctcccctatgcattggttgcctccan

SEQ ID NO: 593141 - DNA, 83 bp, Homo sapiens
  misc_feature (1)..(1): n is a, c, g, or t
ntctcagtccctctcgtggtctcctccgtgaataatgtgacatacgactgttgactaaacgcaataaaacctctgtttgtacg

SEQ ID NO: 593142 - DNA, 852 bp, Homo sapiens
  misc_feature (3)..(3): n is a, c, g, or t
  misc_feature (114)..(117): n is a, c, g, or t
  misc_feature (120)..(120): n is a, c, g, or t
  misc_feature (145)..(145): n is a, c, g, or t
  misc_feature (153)..(153): n is a, c, g, or t
  misc_feature (160)..(160): n is a, c, g, or t
  misc_feature (179)..(180): n is a, c, g, or t
  misc_feature (212)..(212): n is a, c, g, or t
  misc_feature (224)..(224): n is a, c, g, or t
  misc_feature (235)..(235): n is a, c, g, or t
  misc_feature (274)..(274): n is a, c, g, or t
  misc_feature (276)..(276): n is a, c, g, or t
  misc_feature (302)..(302): n is a, c, g, or t
  misc_feature (324)..(324): n is a, c, g, or t
  misc_feature (329)..(329): n is a, c, g, or t
  misc_feature (338)..(338): n is a, c, g, or t
  misc_feature (343)..(344): n is a, c, g, or t
  misc_feature (348)..(348): n is a, c, g, or t
  misc_feature (356)..(356): n is a, c, g, or t
  misc_feature (359)..(359): n is a, c, g, or t
  misc_feature (380)..(381): n is a, c, g, or t
  misc_feature (394)..(396): n is a, c, g, or t
  misc_feature (398)..(399): n is a, c, g, or t
  misc_feature (403)..(403): n is a, c, g, or t
  misc_feature (406)..(406): n is a, c, g, or t
  misc_feature (410)..(410): n is a, c, g, or t
  misc_feature (420)..(420): n is a, c, g, or t
  misc_feature (429)..(429): n is a, c, g, or t
  misc_feature (455)..(455): n is a, c, g, or t
  misc_feature (496)..(496): n is a, c, g, or t
  misc_feature (618)..(618): n is a, c, g, or t
ttntctgttaattagtaccggggtataggattgactgagaaatacgggcttctttctattggtcacattcacagccaacatttcctctgtgccaggtcagaaagacagtgggtnnnnttngtgaataatttccttgagcaaagcngctctcanccttgancaaagaagcctttccaggnnctggtctatacccatgatctctcttctctggnacacagaaagtnaatggtcagantcatctcttgaatgggaagcgacgtgtttattacatttntngttcaccagagccactttattaaaangggaaatgggaatcagaaaggntaagngacttagcnaaggnnacanaacttggnagnggcagatcaggaagagaaatnnaggtctgctaggnnngnnagtnttntgtncaagggtgtnctaggaccnggtcatctcagccatgtggggttgcnagatgtttctgcatgtggataaagatagataggccaagggntatgagggggcagaataagctagaaattcccagaactttggtcctagaagggcccttaagaatcatccaggctggttgtggtgcctcacgtctgtaatcccagcactttgggagcccgaggngggtggatcacctgaggtcaggagttcaagaccagcttggccaacatggcgaaaccccatctctactaaaaacacaaaaaaatatccaggagtagtggtgcacacctgtagtcccagctacttgggaggctgaggcatgagaatcacttgaacctaggtggcgggggttgcagtgagccaagatcgcgccactgcactccagcctgggtgacagtgcaagactccatctcaatt

SEQ ID NO: 593143 - DNA, 177 bp, Homo sapiens
gatctagaggatcctgatgatagctccaccgctaccggacaagatgggattctaaatatacaatcatgtcatctgcaaacagggacaatttgacttcctcttttcctaattgaataccctttatttctttctcctgcctgattgccctggccagaacttccaacactatgttgaata

SEQ ID NO: 593144 - DNA, 438 bp, Homo sapiens
acctacacagtcgctcagtagtagctttgcactacgcccgagcttggtagccactatacgggcttctcttcctccactactgactcggcaactgagacagaatcattatcgcttgatatctactccttcgacttacgcgtctggcgttatttccgcagtcttggacaactgtgccgccgtctccgctctcttggggccagtcttgcgtttgctgggctcttcatcttctacatcactgggctcagtctcttgagcaggtggtgttggcttcgggctcgcctttttgggcgcaacctttgactttttcgctggccgtgggtcatcctcctcctcctcgtcaatttcgacaggtaccattttgacggccgtcttagcagccatcttcttgacagctatgccctatcttctgattcggattcaccatctggtttgtgcgcg

SEQ ID NO: 593145 - DNA, 204 bp, Homo sapiens
cccccccaaaagggttaatattttctcccatggggttcccggtccgtttgaagtccatccaatttttggtttttcggggtctccctggttggttttggtagttattttgtaaattggacctttgccatattagggtttttttccttttgggccattttaaaatgatggttcccccttccttttattaactttttaaaatccgga

SEQ ID NO: 593146 - DNA, 201 bp, Homo sapiens
agcgagtcacgatggcagagcacagtccctcatcgtgtggacagtacgcaacacgacggaatcacttacggcgcgcagaagcccatacaagtagctccatccggaaaccggtactcaatccggttccggtgacacccaccggtaaaagaatatatcacatgtcatggaacttagattaaagaaatacttctctgtggaccc

SEQ ID NO: 593147 - DNA, 284 bp, Homo sapiens
ctagctgatttagagttccccccgcacggccttaccgtcaaatctgatcagaacacgcgcggttacacataaataacatagtatatattcacatagctcactatgtctctagtgctccataatcattatttattctcataataatagcttagagagcctactgaccttcagttggctttttgtgcatctatatgtatagctgtataaactctttatactatacctttgtctcactgatatatacatatatgggccaggcacaggggctcacgtatgtaatccct

SEQ ID NO: 593148 - DNA, 630 bp, Homo sapiens
  misc_feature (125)..(125): n is a, c, g, or t
aggcattcaaggaaccatgggaagctgacttttcagaaggaggacatggacttccaattcaactgagcacgttgtatcccagaaagagaaacatagacagagtgacccatgctgaagcataactntggttagcttctgaacacagtgacaaaggcagaatcctatcaaccaaaaagccaaaggaaaccaaagcacaaattcccccacagcattcagcacccgaggatggtggccacaatctacagtttgggggaaaggaaatgtggatcagcagaccctggcacgtataaagaccacacacagatggctttacacgtgtgggcactcagggcggacagttcctaaaagccgtttttgacagaacactgaggaatcaaactgtagatcttaggaacaaggaactgtgctgaaaacgaatgacagtgaacacagaatccattctattttggaattaagaccccagtaactagtgaaattgtgttataaaacagagagtaactcttataaacatggccggtgtaaatcatgatgtcatcaccaaatcggaaaaggaggtgagggaacgctggcacttccctcatctttcagagcaggaagtaaaacttgaaacatgcagtcaaaaaaaaaaaa

SEQ ID NO: 593149 - DNA, 316 bp, Homo sapiens
gctgggaaggtggagttgggggagggagggaagagattggttaatgggtacaaacgtagatagaaggaataagttcaagtgtttgatagcacagtagggtgactatagttaacaatatgttatatatttcaaaataactaggagattagaaatgttccaaacacaaaaatgataaatgtttgaggtgatagatatcctaaacaccctgatttgatcattacacattgtatgcatatatcaaactaccacaccccataaatatgtacaaatatgtatcaatacaaacataaataaaattgcaatttcctgcaaaaaa

SEQ ID NO: 593150 - DNA, 177 bp, Homo sapiens
aggatccctggaggcaggacactggtagctccactccactttctatgttgcaattctagcaccatatggaactggagtcagtcaatactcgtcttcatatctagcttccttgacttcggatttcaagggtcgtcatattgagtatggatcagaatttcattcctttttttttttggg

SEQ ID NO: 593151 - DNA, 440 bp, Homo sapiens
atttttggttttattcaccgttaacgggagccggttaaaccctgagaagggttttgaatctttccttttttccccccccccccaaatatataaatttgggctctcccatgtaatgtatttaatttttggaaaatttaatgctatatagtaaatcaagtgtgtgatttaaagtaatccgatccctttgattcttttaagttttcagaatttcttttttccccaggtaattttggagaaaataatttcccattaactgataataagccccctgtcctctgctgtaaaaagtttgaataaatactgtgtatgtttttatgtccctgaacctgagctactcgtgggcaattatgtgtatgggaatggagtagtgttcatgatttgtatttccctcctcatatggatgtatatttattaataaagtccttccttttaaaaaaaaa

SEQ ID NO: 593152 - DNA, 269 bp, Homo sapiens
gaagctaagttctatgatacagaaaacgcgtctctcggtccaaagcaggctcctgcatagccatgtgttcttgctctgtgtctgtgattcttctcagcacatgcaagttgcaccaaagaggaggccttgagaggttgagtgggcagattcatgagatgtggttgggtgtcaagggccgcattgccaacatgctctgtaaataatgccaaaagaccaggggacagggcaccccagggctcagaagtttggagcttttccccaaagtcctt

SEQ ID NO: 593153 - DNA, 458 bp, Homo sapiens
ggctggtccgatggtagtgggttatcagaacttattcactaaagtggtatacaaccccccactgctaaatttgactggctaaaaaaaaaaaaaaaaaaaaaaaaaaaaaaatgtgtgggggcgccgccttggggccgaggaaagaaggttttctaagaaccaatcgcgggttggggcgcgccgcgggccccgaggaggtttacaaggaagccacgtggcgcagaagccgtggtcgcacaaggagaaaattccgggcgacaaaggagataggggcgtgggagttctcccccacgaagttagaaaaacggccgggggggcaacgcacgaggcgtgtctttgggaaacacagtccacaggagggcgtccggaggagcggccatcaacgggggcttcttactaacacgggaggcccagagcagaggcccggaataataaaattaaggcccggcggggggatg

SEQ ID NO: 593154 - DNA, 187 bp, Homo sapiens
aacgactgcgtctgtcggcctcgctgatcttgcccttgaagcccctcatgcgctccacggcgctcttcatgttagaaggcgtacgtgactccagggcgtacttggctgacatccctactacgctgctgctacctcgtcctccggctttgtacttctccgcctcttgcgcgcagtgctcgtcccgtgc

SEQ ID NO: 593155 - DNA, 498 bp, Homo sapiens
gcaaggccccgcgcctgcccggagggagctgtaagcagaggaaggtgaagtggcctgaagaaatgtctgtactggagacagtcggggctgtgtgcctctgcctgacgcaacatcatttcagacgtggaggaaggatctgttggcagatcttgggactcaaatgggctggacttctaagaaaaaatatacccaggcctctctattccaccaattttcattctttcatacatacatatttatttatttaaacagactttatattttaggcagttttagttcacagcaaatttgagcagaaaatgcagaggtcccatagacttccttacccaacatacccacggcctcccgctctgtcaacaccctgcagctgattcatctgacagtcgatgaaacgattcacacatcattatcacccaaagtccatcatctacattacagactcttggtgtcgtacattctgtgcgatttgacaaatgtacaatgacgtgtacctgcaaa

SEQ ID NO: 593156 - DNA, 409 bp, Homo sapiens
gtcgacaaagaatccaaaacatcaaaccaggtcggagatgttcacatgcgaacattatgaacaaacaaaaatatccctgcaaaacaacacctttttgttaccaaggtgctctgctttgtgtgagtaccctggaaagctgagagagagagagacatagagagtaggagagagagacagagacagacagagagagagacagagagagacaaagagagacagagacagagagagagagagagagagacagagacagagagagagagactgagggagagtgagagagagagacagagacagagacagacacagagagagacaaagatagacagagagagagagagagagagagagacagagagagagagagagagagacagagagagacagagagggagacagagaggtcgac

SEQ ID NO: 593157 - DNA, 172 bp, Homo sapiens
ggagagtttccattgggcagatttcccttcctgaaggccaaaacggagaacttgcttcttcttttagatttaacaaacctgtttcgattcccataataaaccctggaggacacagggataccgccagatggcgaataacttggctcttggcttttctatacccccactccca

SEQ ID NO: 593158 - DNA, 250 bp, Homo sapiens
cattcacgctcgacggggaattatacgacatccttgagtattaacgccttagcggtcatacagggctcgtagcctgcaggcccttcctcagtcatgaatgagagagacgatatcaccactctcttccgccataatggctacatctaacacttgggacagcttctgaagatgctgaattcccgcccccagaggctctaggtcactgtcagactcgctgggagagcagaggggctctgttggactaaagtgg

SEQ ID NO: 593159 - DNA, 364 bp, Homo sapiens
ttttttttccccttttgaaaaggaaaaacccttttggaaaagcctttgaattccggcccctttttacccccttttccccccccccaaaagaaaaaccttttttcccagtaaggtaacggccttttttggaggatttttttttgcccggccccctttgggccccccccgcaaaaacagttcccccccttccaggagaatttgcaaggggggatttttttttccccccggtgaaattttttaaatgaaattttaaaaacaaaaaaaccccatttggccgattccggaaaacccccaattttgttccccgtttttttaaaaagccaattttgtccaatccaaaaaaaacccatgggtgttggggtta

SEQ ID NO: 593160 - DNA, 183 bp, Homo sapiens
tcggtctggctgagcagctggcaggtccagaagttaaaagtgatgctgtgagcatggagccccgttccaggtgatgtgcgtgagtgcatggtaggggctgagaggggtcccatggtcgtctgctgtctgtgtgttctccgcctgtggagatgagcctaggatccagagacttcctgagcaggg

SEQ ID NO: 593161 - DNA, 180 bp, Homo sapiens
  misc_feature (4)..(4): n is a, c, g, or t
taanggggggcaaaaaaaacttccccccccccggccttccctttttttttgtggggaaaggttttccccttttttttttgggggggggggggggggggggccccccgtttttttttttttggtgaaaatgggccccctgggaataaaaaaaaaaaaaatgttttatttaaggggccccta

SEQ ID NO: 593162 - DNA, 504 bp, Homo sapiens
ccaagaattcggcacgagggtaagagataagtagggaaacagaaacatgagtttggggggtatgttgtctaattttagaaatacagtattattgagggcctcataaggtctacaaggttaaatggttgctacggatgcaaatgtaaaagaaataaaaaagacacctaaaattgcaagttagtgtttttacctggtttattgtcttctaagaaatttgtgtgggccaaagtctcaaaattctataaaagcaaggaataatatgtgtctttgtggagtacaaaatcaaataatttgatctaaggaccatttgaaaagtaaaggtaaactacattgtaacaagagcccaagaaaatagatagtatgtgtgataaatatttctgatagtttaaaaagaataatggtgaaaagcttgaaattttcttttcctcaaaataataactccccagcatccacttgccttgaccagaaaagctgtcattccacaattgtgctaatttgtcccag

SEQ ID NO: 593163 - DNA, 252 bp, Homo sapiens
aggtaaaaaaaagggttgggatagaagaatcttgggaaggagttttttctaagaggaatccgcccgcaagagaaacaggaggaaaaaagaggggttggttggaaggagccattccacgtccagccagaagccacgtgggacacatgtgaagcaccgtggaggagacaggcttgtcttacagccagagcccaccaagaccacggtgactggtctgcagaaggcacgaagccacccacctgttgagacccatgg

SEQ ID NO: 593164 - DNA, 207 bp, Homo sapiens
ccaccatgtggctgggctaactgggcagcaccacgtcatccctacggttgttgaatcgtagtctaatgatgtgactgcccaccaggagattgtggatctggtgatcacggagctggggatgatcccttgcagttctgtacctgttgttctacgagtcaagagcagtgaccagtgacgggggaaacacagggttaataaatgccatac

SEQ ID NO: 593165 - DNA, 388 bp, Homo sapiens
ttacatgacacacgaacactgagactaagtgtcagcaagatgtacccgcgggcctttgaggtcctcgcgcttccaggactgcaggcgttcctgtgaggcggattagggcttcctcttggcagaagatcagccggtgtttggagtggtagaaatctgtcatgctggtctgccgccgttttcgaccctaagagtctccaggtccacctgggaacccttcagtctgctcccctgagcgaggcacatgggtacaagacagtgacaggtccacatggtcttcctctgctgtaccctgcagtagagcaggtgaggtgccaggccgtctgtctcctcccaagtcatcccgggctcgccggggccccgtgggaaggtagagcttgggcaggccaag

SEQ ID NO: 593166 - DNA, 152 bp, Homo sapiens
agttttggattagaatcaccattcttgtaccccctcgtttgttcactaatgtatccagtctctgtatgctcagtaatatatgaaaaattgttcgctaagcctttgtttccagcaaggtccacatacattactttattccagacttgacggga

SEQ ID NO: 593167 - DNA, 818 bp, Homo sapiens
agcgggggcggcggcggcttgcgcgcggaggcggtggtacggaggtgctgggagcagccgggcagccgcttcccgccccagagcaggagccggtgcgagcggagcagagccgaggtcgggcctgcgagcggagtccgtgctgagcgggctgccgtagctcccgctggcccgtgaacacgctgtcctcgcgcttccgccgggtggacatctgacgtaatttgacgagaacaatatttgtggatcgagcaggaggaggcggctggctggcggcggcggtagcccagtgccctggtacccagagtcggaagtgtggatcggggctccatgacggcattggggatccgactgcttgcggggcattccagtagcgaaggccattgcagttgaactctcccgtcaacaatccgaagaatctcacgctgtgaatggatgcgaggacccaggggcgtggttgctgaaaggtgctcatcagaacttcataggagtcagtgaagaatttgagcagggctgtgcacgtcgcgtgggcacacgacaacgggtcagttggatcttggttatagtgaaggtacatttagtaaaatggcttttgagaaggcccacatgaagaagtaggcgaggtgcagttgttaactccaggtgggctctgagatgtggccttagcccgtaggatggactagggctccattataaggagtttctaacagcaaggaaagactgtttcacggcccaattgggagactcttgttaccttgagaagaattctggatgcccaggcctgtgaagaacgggttggcatggaccacttccttagacttcca

SEQ ID NO: 593168 - DNA, 671 bp, Homo sapiens
  misc_feature (412)..(412): n is a, c, g, or t
  misc_feature (440)..(440): n is a, c, g, or t
gccattatggccgggagcagtgtctcacacctctaattccagcactttgggaggccgaggtggacagataacctgaggtcaggagttcaagaccagcatggccaacatggtgaaaccccgtctctactaaaaatataaaaattagctacgcatgggccgggtgcggtggctcatgcctgtaatcccagcactttgggaggctgaggcgggcagatcatgaggtcaggagatcgagaccatcctggttaacatggtgaaaccccatctctactaaaaatataaaaaattagccaggcatggtggtgggcgcctgtagtcccagctactcgggaggctgaggtaggagaatggcatgaacccggtaggtagagcttgcagtgagctgagatagcaccactgcactccagcctgngtgacagagcgaaactccgtctcaaaangaggcaggagactcactagaagcttgcaggcagaggctgcagcgagctgagattgtgccagtgccctcctgggcaacaagagtgaaactctggctcaaaaaaacacgcccagtcaattttcccataaacatgtaattaagacaatcgtggccatatataaattaagtttcctttgttgctgaggataacattgtcaggcaccttattcaggatttagcatgggcttacatc

SEQ ID NO: 593169 - DNA, 215 bp, Homo sapiens
tcgaaccagaaatggccttcatgcatcaagaagagagtcttgaattgcaagaacgctatatttcattcttgatttcaaaagtcttggaacgcaatgaacaagagcttgatattcttggtcgagacaaggcattgttggcgtcttacacggagctaccttacccacgtatcagttatgattattcagaggggttgttgcaagacactggctttgat

SEQ ID NO: 593170 - DNA, 621 bp, Homo sapiens
  misc_feature (145)..(145): n is a, c, g, or t
  misc_feature (158)..(158): n is a, c, g, or t
  misc_feature (219)..(219): n is a, c, g, or t
tttttttttttaaacagaggacccaattgggagcccaaaagtagggctagttggtgcggtgtcttttagtttttccgctcatgtgggcacaggggtagggaaatcctgtttgggggccccgttcttggtggtttgttggaagganggccagtccaggntcccgtggggcccccgcctctttcaaacatttgggcctgtgtccatgggctcagggcccancttaggcctgggccccttccccgttggaaaagcccgtgttaaaagttaaatctggggctccgccttcaaacaaaaaggactgtaggggggggggcagggggctggagatccccctgcaaaccccgcccgtcccgcctggggggccgtttcccggggggggttccccctgggaatttacgaggggggttttgggcaaaacgggctttgggggcccccctcccaggccaggttttccgttaggtcctgtggcccccccccggggccctgggggggaatccggaaaattttcccaaaggggatagttttttggttttgggcaaccttttttttatcccagggggttttccccggcccggagattttccccatggaataaacttttaaataaaggggtccggggga

SEQ ID NO: 593171 - DNA, 232 bp, Homo sapiens
atcgcagggaaatacccgctgttgacatctccagttgacaggggcaccggctgtccacagggaacatattcctttggtggggtgcaccgcctctcctgaggctggaagtgccaaaggatggtgcaaatctctttttcagccacactgaagccaattacacacagcgggagaacgcaataaacagctttcccccaaattaaaaaataaaaaacaacagctcctcttgcggccg

SEQ ID NO: 593172 - DNA, 302 bp, Homo sapiens
ttggggctcatgcaggcggacaacacaagagggggggggatcatgagcggaaggattctttccttcccatgagcggcagggcgggtggccgtccttgcaatggtgtcttatgggccggtgccgttatatctgggtgacccctccaggtgtacagtactgacaaaggggtggagggcgggggagaagtcacggtgccgcccacctagtaaaccttcggtcggtgcgcagggcatctccaggagggggcacggcggtgtgcagaatccagggtcctctttctggtggcaattcctttccgggag

SEQ ID NO: 593173 - DNA, 103 bp, Homo sapiens
ctatcgtgtgctcctaggactcgtgctttgcaagaaaatatagcaggaaagtaaaatgaaacacataagccctttctactgacaatgcacccaaccttttcac

SEQ ID NO: 593174 - DNA, 524 bp, Homo sapiens
  misc_feature (457)..(457): n is a, c, g, or t
agggtctagatggaaacttttaaataagggatgtctaaattttggactttaaaaaagggtaatgacaatgggatttcctggattaatagatcacaggggcttaataaatgaccaagatacatgtacaaacaaaatttcagatgctctgggaaacacatcttaagatacaaagcacaggtgatacatattggagttaactcatccatttatcttacacggaaaaggtagccttggataacgggggctggactagatcacaaaatagaattttccaagtttcctaaagctttcagtccaaataactcaaaagatatgtgtcctagtgggatacattttttcctcattatataattagtatcagggggctttggtatgggcagttggtctgggtcatgacttatcctggcaaaaccatctttacggcaaacaattatgaaagatattttccccaaggcanggaaattattcgggatcattaccaaagtcaaagccataggtgtgtaaggacgtccttgataatggat

SEQ ID NO: 593175 - DNA, 153 bp, Homo sapiens
tcctcaccacagtgacacacacacctcaccacacacaccaccttgcattgcacagtgcaacatctcatcatgcactgcaccacccacacattgcacattgcgcacacaccactcatcccccacatgacatcccattgtgccattgtgtgatca

SEQ ID NO: 593176 - DNA, 1106 bp, Homo sapiens
agtgctcacagtctgttgccgacctttgccgcacaccactgccggccccggtttcatccccgagttcgtgaccctcacgagggggccggtttcgaacaatctgtgttctggaaaccgtgatcctttcgaacctcccgccttaatggccgtctacgagccaggctaatgcccggcccctggtatcagctcccggcttccgccgatttccgaggctgcttcggctgctgccaggcgttccttgctgatcagcctggggtctctccatcaggcagctagctagaccttacctcaggaacgaaggcctcggatgaccctcagatgaaggacccggtggaccttcggggttggtgaatcctagacatgagagcatttcgaggttgcctgaaagctggttgtccttgctccttttcctggagccaatatagcccagtttttactcagtttgattctatattctggtgcaaacggaagctttgcctactttattggcacaatccgttgttctgtcgttatagtgcatatctgctggcgttcagcctctggcagctgagaaattgtcttctatatgtagaagggaaaacctgagcactttgcaggcatactggttaaaagcagggtctgtagtgtacaatgtttaaaaccgggtaatactgtcactgcttcttagttcattcttcacatacacaaagctactgagtaagtcggtattacgcctgcacttaacagactgaggaatgcaagatctaccacgaaagtacacagaacggtcatgtcttgatgacaacacggagacttggttccatgcacgagtatgacgagaaaatgggacgctctgtgctagcttgtccttcaagtctgcactcgacttgcacgtcggctcataaaccgtgagccaatgtatttgtatcggttcataactgattgtgtttgtgaactatgtcttacagtgtctagaggtctgctggatctagggaaaggaggagatatcgaagtactaacgggatcaaaaaaccagcagggactgttgggcactgcctcctgtgggaagttagtggccacagaagagagatgaaacctgtaagaagtctggagtctttcggaactta

SEQ ID NO: 593177 - DNA, 155 bp, Homo sapiens
gattttgatttttatcaaaaaatgaaaaagagtcagcccattagttgcctgaaatcaaatggaatatttaacagagattaaaaaaatttttttttagaaaaatttgaatttataatattggcagactttaaaatggcttggattttagcccaata

SEQ ID NO: 593178 - DNA, 1130 bp, Homo sapiens
  misc_feature (221)..(221): n is a, c, g, or t
  misc_feature (525)..(525): n is a, c, g, or t
cctctaaaagcaacaagcgtaggacttttaaagttttgctgttcgaatggacagcagtttacggtgagagatacatgtataatgagagacaaaatctgcatatagacaatttataatgaccaacattcttgaaatggtggtgtgatcatactgctgtggatagatctgattttcattcttgtcttttagaggtgtaagggctaggtattattcagagtagntaatgtatgagggtgtttgagttttggggagtatgtggagtgttgtgggatgtagtatttatctagctacttaggggagaagcgtttgttgtgatggtgtgcaaaaaaaatcgggtgcggggctgtctattctctggttaacatgttatcgaatgaagaaatggatgagaaatgtgtccttgtgcattaatcagtggtctaccggctctcttgtgcgcaaatctgtaaaatgccctggttgtatacacatttctcgagggaaagagattgcgttgtggcgcaacagtcgattacattacccacnactgatcttcgagctatatttaccctgcccagagggtgggttggtgctgtggtttcccatatgtaggggtcaaccatagagtcatacttttcacttctattcgctttttagcgcatattcctccttccattattttacccttggatccaatggggtattttccccatgtatagacatgccctaatgggtgggtcagtgttaagtacacaatggcgtccaacagtgcgggggccccacttagcgagcgtggtgcccccagtgggaataactcaggcctaccggaaaagagccttctagcaaagaagagtttacccccctcttttgggggcaacactcacagggggggggaacagagacgtgtaaacggcggttctacacatctgtgtaacatttaattccaccgaatgtggtttcccgggagagacgtttctccgaggttgtggcccattaaacactgggacatgggggtaaatttcgccaaaggagtgttttaggcgaagagtcataaatttcgtgtgggtgtcccccgggttttttaaaaaagaaccttctctgtgtgtggagcgctctcaaagggagggaaaacagtgtgaaacttggagaac

SEQ ID NO: 593179 - DNA, 101 bp, Homo sapiens
gtctcgatctgaaccccttccccagttttttttttcatactttaaaccccggctcctctagggcctgtggccgtttctggaagctggcttcctcgttcatc

SEQ ID NO: 593180 - DNA, 482 bp, Homo sapiens
  misc_feature (276)..(276): n is a, c, g, or t
  misc_feature (281)..(281): n is a, c, g, or t
  misc_feature (286)..(286): n is a, c, g, or t
  misc_feature (321)..(321): n is a, c, g, or t
  misc_feature (334)..(335): n is a, c, g, or t
  misc_feature (346)..(346): n is a, c, g, or t
  misc_feature (372)..(372): n is a, c, g, or t
  misc_feature (395)..(395): n is a, c, g, or t
  misc_feature (402)..(402): n is a, c, g, or t
  misc_feature (416)..(416): n is a, c, g, or t
  misc_feature (429)..(429): n is a, c, g, or t
  misc_feature (472)..(472): n is a, c, g, or t
agatgtcctctggacttgggaacctggcatgagcatgaaactggaaattaacaaggaatgatgcagatgaacacctgcagcaagaaccactctacacctgtccacaggtcctaaactctgagtccgcagactgagatgacgccccggattttgtgggcagcgctgcaacttaccctctccgaaagcccgggagtaggggagcggctcctccggcccccagccctcggcgctcccagtcacctctccgaaatgactggaggtccagttgagccggtnactgncggtngctttctgagttgggaacccttggtgacttccttntttaccggccgtnntgtttcttttntttggttagcctttaaaaaaatattnaaaattgtgaggaacttgattanttgattngagaaaacaaattnttttaatgccatnttaaaaacctgaaaattatggaaataaaaacccagaattgccnggccgccacc

SEQ ID NO: 593181 - DNA, 418 bp, Homo sapiens
ccacagtgagctaaattttcttaaaaagcattttttgcctaataacttgtcgggcagagtaacacataccaacaacaagaagagcaaggagaaacaacactgaacaatgtttaattactgtctctccaaaataatgcctcatttattcttctcaatgttctccatatgctcagcacattattggtaagccaaacttccttttattaagataaaataatgaaactatacacagcctttaacaatattctggaatttacttccctatgatcaaattgtcacagaaaggagaagttgactaatttgttcattccttttctctgaggtaaaatatccctcatgccagctttccctaaatgcgttcagatctaggaacaaattccagctcttttttattgaacccatgaacagttgaaacatt

SEQ ID NO: 593182 - DNA, 805 bp, Homo sapiens
cgcggtggctcacgcctgtaatcccagcactttgggaggctgaggtgggtggatcacctgaggtcaggagttcgagaccagcctcaacatggagaaaccccgtctctactaaaaatacaaaattagccgggcgtggtggtgcatgcctgtaatcccagctactcgggaggctgaggcaggagaagtgtttgaacctgggaggcagaggttgcggtgagccgagatcacgccatggcactccagcctaggcaacgagagcaaaactccgtctcaaaaaaagaaaataataaagatatcagctggcatgagttaaactatatataataggaaaagaaacaacaaaaccaaaaaggtgggtctttggaaaaagtttaagaagatgtaatttggtacccgaataaatatatcacaagtttataaaatggtcgagccaggctcggaggcatccactcacgcccgtaatcccagaacttcgggaggccgaagcaggtagatcacttgaggtcaggaggtcagagaccagcctgagcaacatggtgaaacctcgtatctactaaaaatacaaaaataagcgggcatggtggggcatgcctgtaatccaagtacctgggaggttgaagcaggagaatcgttgaaatgggaggcaagaagttggcagtgacgacgaagattcagggcagagggacttccagaccgggaacggaaaggagaggaaaagcacaagctgaggaagaaaccacacagaagaaccgtactaaggtagatgccaacaatgggacaggaagacatataaagacgaacgcaa

SEQ ID NO: 593183 - DNA, 240 bp, Homo sapiens
ttgtctctgcagaacaacaaaaccaactacaggtgggtatgctagacgctgcagatcctgaacatcatgtgcggcagcagaacgacgggccggaggctgctggactcctgcatcaactggcccaacagcagcctcatgatgagctcgtcgaggaccctcattaactcctcccagcccctttgcgagctgaccaagccttgcatggggactcacgagtccaatggcttggacatcatcacg

SEQ ID NO: 593184 - DNA, 780 bp, Homo sapiens
gtcattctgatcccgactgaaacctctgttctcctaaaggaggaaaatcatttttagagcttttagccaatggaaactgatgtctgccctgctttgtggatttgtctttgttttactatacatgactcatgtaatctcttgaatcttaccagccttgatcccgttccacccaagaggtagaattttaaatgcagactttgttatttgccccagaagattcctggaaaatttacggcccaatattttgccaatagttaaatttcaatttggctttttacccagttccctcccttctttttcccgcttccttaaatgtaatttttaaaccctggccaaccattctttagaaacccaacgaggaaagaaagagaccaatatccaaaaagacatagaatttatattgataccatttcaccctctaaaatggatttgagagaaaatgccactttataatccaaaaatgtcatctgagtttcctcttgtttctctttttaaattatgtaatcacgatgattttatgtgttttttttccggggagcggatattggtttcttttaacttgttgttttcacgttttctctgccacttcatgtttcttttttgtgttcacgtgtttccaaaaaccatttgtatttaaggattttaaatacccaactgtaactgagtaccgtggatcgttttctcttaggatgttatattataccatgaatctataaagtgttgtccatttgattattgacacatataacatgtttaccaataaactgtggtattgatcca

SEQ ID NO: 593185 - DNA, 198 bp, Homo sapiens
gggggggttttttttttgggggaaagtttttttttggggggggcccccccttttattgggggggggtttttgggggcccccccccccccccccctttttgggggccgggttttttttttttttttcaaaaagggggggggttggcccccccccggggggttttttgcccccccccggggcccccttttttttttttta

SEQ ID NO: 593186 - DNA, 411 bp, Homo sapiens
cgctaggatcagctcagaaagaataggctcagtagagaggagcatatttctttgtatctagcaacagagtctatcgaaattgtcgaatgatgaccatgctcaccagcgtatctggcacagagttcagaaaggaattactcttggtcccttatatcagaccgggctacatacagcaatgattatactaactaatcccatggacggtatgtgctccattgagctagttctgctccatttctggcttggaaaagtaacagtgtgtataaaatgttctttaaactatgtaataagtaacagtgttaaaaaagagtttaagctggacccggtggtgggagcctgcagtctagctagctactgtaactactcaggaggctgaaataggagcatcccttgagcccaggagtttgaggc

SEQ ID NO: 593187 - DNA, 985 bp, Homo sapiens
gaaatcctgaacggcgccttgcgggctagcgaagaaagatgcagaggatgtaaaaagcacgcatatgtccggctaattgatgggacgagctctgatggactaaaaacacgtaaagccagcattgatatcctaccataagaggacgagaagatgttcatgataatttctgatgatgacatgtaccttcagaagcaccgtagttctgacgtccacctcgcagaaccaaggagtacttatcggaagagcgagcagcgcagatgtccagagattctgactacattgctgattggtgtacaagtggctagacactgcgtaaaccaagtctgactcactaagaagacctcgttaataatagtaacccttcatttgctctctgtgccacgctaatagcttctgagtgtaatgagtatgtagtggtttccattgaaacacgtgaacgattttgtttagaagtcaccattctaatacttcttcaaaagtggctcctcattgtacttcagcgtagaatatgagcgagctggagaacagttgtcatggagtttaggttgagtgaacgatcggccatgaaaatccatcacgaatacttttggatcaatagtctatttttacaaaggaaagaacaaaagcacgtttttcatagtccctaagcttgtgccatatgcccgccttaagctggaatggaaacgttaatcacttaactatgtttaatcaaaaagatacaaacgggcttgggacatgctattaactgttcacacaaaagtatgaattctggtttgaacttaagggcaaaatggctctctattgtttgagaaaacacaccgaccgttggcctgggacagttttctcaacaaacccgtggggacgacctgtggatacccacccgcgggggacttggcattaatttcaacagcacaaccggactgacattgagatgccgacacattctcataccaagaattcagatcattatattcggcgcacaaac

SEQ ID NO: 593188 - DNA, 1010 bp, Homo sapiens
ggggctgcagtgagctgtgattgtaccactgcactaacatgatggagcaagaatactgtctcaaaataaaaatacaaaaaaaaaaaaaaattcggggggcaaacccattctactttaaggtttattataaaccccttatggtgtggagtagatgcggctccgtacaacaactttggattcctggttccacgcttggcctggagggggtcggattccatcctggtttggtcttggggttttggacgacaagatgtcttcacttccggtcaccccagggctggggctgtcgcaggggtctggcacactaatagggttcggtgggaaaacctcagaggcctcgtgtggctaaaagaggatcttccaacttaagaaatggccgggtctcaaaaaggccaattttttggatcacttcggcggccagtggtctggaataagggggtataaatcccaaggtatcttgggggcggaccctaatttccaagcctggaactctcagcgcgttgccaattggcagcgactaccgtttggccagcgaagtggtggcgccagggcaaaggacgcttttttatgggtggggaaacaaaggccgcttcacttggtccatctcagtccagatccaggaacactaaggggtggtaggttacagtggcaggtcctcgggaggggaggaacaggtggttccattctaaattgggcgcgtctctggggcgtggttcaaaataaagcttgtgcgcttggataatgggggaaataggttgaaagtcgttggtccctctaggcgttgggtgataatagaggctcggtggccaggcatgccgggcgttttacacattggccggttaatctaaacaatcgctgagaggctggtccactctaggtgggatgagatatgatcggccacgacacgttggttggtgggggattataccgtttttgtgaccttttattgttgtgagacattggtttggaaaactataagggagtatggaggtctctggtgttggaaagaa

SEQ ID NO: 593189 - DNA, 241 bp, Homo sapiens
gggaggaagcgagcgggagggggatgtggtgctgccggggctccgcactgcagctgctgctgactgctggttgccgcgtcttcccggaggcgactgctggaacctgcagggaacaactgcggcgctctgccatatagtgtcttccccggccggtccctcgcctcccggccgagctgacgaactgtaagagtaaatgggtccagtaattggaatgactccagataagagagctgaaacccca

SEQ ID NO: 593190 - DNA, 186 bp, Homo sapiens
  misc_feature (88)..(88): n is a, c, g, or t
  misc_feature (119)..(119): n is a, c, g, or t
  misc_feature (155)..(155): n is a, c, g, or t
  misc_feature (168)..(168): n is a, c, g, or t
acctttacccgaagcgatgtgaaacctagcgcactagccacctgttgaggagtggcaaaattctgatgtataacaaacttgaatttcncaatgctcaggatgccgaaatccacaaggcngtgtcctaaacctgtttcctgtgttagtcagaaaanaaagtaattcccngactgttgaaaaaaaaaa

SEQ ID NO: 593191 - DNA, 1559 bp, Homo sapiens
ttatatattctttgcgcactttatttttaaaaatcttattcataaatgtatttaaattaagtaggtttcagatatattgtaaaaaaagttacgtgcaaataaaagcgggttcaggggatatttcccattgtggtgctctccctttcccatatttaggaaaatgtacacgtggtcgcgcccaagaagaaacaggatgtggagcggcctttcttctccgagcctctctctacatatataaggccgcagagcaccagctgtggctctcacccgcgggtctccgtggctttaagcatatattattatgagggcatatgtgttttctcatatcagatagccgtgtgaggtgtgacacactcgtgtgtgtaacgtgtcacaccacacgtggtgtctcacatatctcacacactttattctatacacactatatatgtagagatacacacttctctcttatatgtgcaatatatacacacacagcacacgcagcacacatataccacatgtagcagatctctcacaatatagcgtctactaatctaccctttatttcacaggtgtgtgcccacacactacacacacacacacacacacacacacacaacagaaaaaacccacaccgtgtgtgtgcgcgggacgacaacacacaccagcgcgcagtaacctcgtgtattcccacacaccaacaaatcatcattctcttcactcctactatcagtcgtccttctcatactccaacaaccatccaccacccttcttcttacaactctcatacgaccgcggtcgttattaataaacatcctctattactaacaccaatcttcgttggccaaaatatccaccacccccctataacgccgtcttcatcccaccgcctcactctatatcttttctatacccaccgacgttgctaacccataccaccactggccacacccccctcctccttcatcactcaacacccaaccttctctccacctactccccaccacccactcctcctcctcacccccgctcggtccttcactcccaaccaccactcatcactctaaacaccacccacgccaagaccccctctccacacccccgcaacactactcccgctgggcaccactaatactcaaccccctcctcttcacacaccccccccttcctctggccccccccctccgttagcggcctccttgtgcgtcccacccaccgtcctgcctgtgggtcccgcgcgccgcaccaccccctcgccccgtgctcgccccttcatacccaccactctactacctacctctgcggccccctcaccccctactactcacactccgcggccccacctccccgccgttcttcgccccaccccctcgctgctcctcctcctcgcaccgcgcccacctcttcttctctacacccccccagcgcgcgtctctctccggtggccccctccccgctctcaccaccacccctttcctcaccactaccctttccctcgcaccactcttcctcccacacccgcgccccaccagctcctcctcacctccttctccggcctcacctccccttcctgtgcg

SEQ ID NO: 593192 - DNA, 533 bp, Homo sapiens
  misc_feature (170)..(170): n is a, c, g, or t
aaggccagctcaaccttggcaatgggctccttgtgggcccatgccttagggtgccattgttttctccctggaggaaaaacctggaaaccgtggccaactgggccgggcctccggggattatgcccccgtttttttcccccacccttgggcccaaaaggcccgttttaagntgccccccgggtcccaaaaggttttttcccccccccaccaaactgtggttggtgtggtgggtggggggggcccaatttcccaacccctttttaagggtggccggggggtcccccaattttaggccaaaagggacttctggcccccggttcggggggtggcccttaatcctttggggcctcctttttgggggggcccccccccgccccttggggagccctccccccttcccaaagatgccccttttggccccaaagtgggttttttttttgccccccgggctgggggtttccgggggacccagcctttgccggggaaaaagaacttgtgtttggggcccccattaagtttttgttttttcccca

SEQ ID NO: 593193 - DNA, 428 bp, Homo sapiens
agtggtgggagtgcatggtgggggtgtgtgtgccaggggtgtgtgtgaatgtctgtgtacaggcatgtggaaggcaaggtgggcatcaaagcatgtggggaatgtgcaggtgaggcccccatgactgtgagtgtgcaatgcgtgtctgagtgtactctcgtcctggcagtggtgggtgaggaggtgtgtgtgcaattcagagcactgccacaccccagactccttcagtcagccagccccaggacctgcccccactgctgggccagcactgtgctcaggcagctgcaactatgagtctggggcttcttgtctgggcaagatgtccgcaggaagacattccattccaagtcggccccgtttgatatcctggtcgccctgccccacccagcctttctgccctctggtggctccggcaccttcggccttgc

SEQ ID NO: 593194 - DNA, 198 bp, Homo sapiens
tgcgtgattgattgcagttgtggtcactgttaaaagaagttagggccacaaaccatcagagaatacctaggtatcaaggtgctagcctcataaaaacatccatactacctcaaagtataccttcttcctttgaatttcagaatcaattctgcaaaatttcagtgcacgaagacacactggctatatagccattcagag

SEQ ID NO: 593195 - DNA, 131 bp, Homo sapiens
gccccccttcccccgggggggggggaacccccccccttttttggggttttggggggggggccttttttcccccccctttttttgcccaaaaggaaaacctaaaaattttttttttttggggccccccccca

SEQ ID NO: 593196 - DNA, 178 bp, Homo sapiens
gagactggtcttcactctcaatgcagctgccacatagatctcgtgcagtgtctgccacatgagactggcatccccatcacactctgccagtgttcagtggcactcagtgccaggttggtggcagtgaggtgccctgctgtgtgcttccccatggtgttcagctggttgagcttatggt

SEQ ID NO: 593197 - DNA, 96 bp, Homo sapiens
cccgcctcactctcccaaagtgctgggattacaggcatgagccaccacgcctggctgcaaaaccttatttaaagtgaagcaatgatctgttcgtca

SEQ ID NO: 593198 - DNA, 586 bp, Homo sapiens
gatcacaccatggcgtatgagtgttcctctgtgtagactacaagcctgcattactgaatcggcacacactagttatacaggctatgcccaccctaatagaattaatgaaagacccagtgtattgttcgagatacagtgatggactgtaggcgaattgtgagctgttcctgaagctgccatcaatgatgtctacttggtccccatgggtacagtgtctgattgagggtctcagtgctgaacccagagtgggcttcaaatgtgtgctgggctttctccagtctggctgaagctgcttatgaagctgcagacgtatgctgagtgatcaggaagaaccagctacttactgttatcttcttgcatttgaactcactaggttcagaagactcctagagactacagacagacctgatggacaccagaacaacctgaggagttctgcgatatgaatctctgatggaacttgtgaaacacacagtgcccaggattgttaccctgatgtccagaaaacgacttggtcatcaatggacgcgactgcaacaggttctcagatggagtcacatatccagagcaagatccgaatcgaatc

SEQ ID NO: 593199 - DNA, 156 bp, Homo sapiens
agcaatctggctaagcttgcgcacagtcacctatgactctttagcatagcctcctggatctcagctttatctctaagaaaatgatatagattagtcacatggtccattctaattgcctgaaatcccactataaaatttctagcaccggttcacgca

SEQ ID NO: 593200 - DNA, 937 bp, Homo sapiens
gtgaggggacgacaggttgtacacacatttggtagttatgtggcaccagctagtgcctttctcacatgggggtaattggaccctctaagatcttcgttgtcataatagcacagtttgtccaccaccaagtagtatgtcgggctcatttctcccttaaaacacccttctccgtacctttcgcgcatgtactcaggttagctctcaaagaaggggtgaatcataaagccagtgaacaattctcactcctgctgatgcgggagtatccccgaatctgagaggtggaagagggtgacctcaagcggcttattactcgccaataaatcggctgaaggctggttgtggatacctgtgtgtcctctcctgagcacctcatctgtgctgtctggcccgtgctcccacccctgttcccggtgctcgctggggccctgcagctccgtgcttatttcccgtggggccggcagacatcagatgtgggtgctcctcacttggctgcgatgtgtcatagcaataaaatgtgattcttgggtgtcccgcccagggtggtctgcccatggctttaattgtatgaacctggtttgcgggagtcagagggaggacgatgactttgcttctgtgcatcagccccgacttccaggagccagaactcagaagaagagggtgctcagacttttcgtgtatacacccttgtgctttacgtcgtgaataaactgtttaccaaatttgactattgaaacgatggggataagggcgctaggagcttccaaactgtatattgttacttttataggattttaacatatgatcctgatatgtgtgtaggggggggctatgatagttttatgggccaccggtaggaacctgtacggtattggctccaaagttcctaaaggcttaaatcccattttttatggccaaatcctggataacaaaaaatttt

SEQ ID NO: 593201 - DNA, 176 bp, Homo sapiens
tgggagctgactcatcatgcagaaggggacagcaggcacatcttacatggtggcaggagagagaagtgccgagtgaagtgagataaaccccttattaaaccataagatctcctgagaactcattcactatcatgagaacagcatagtggaaaccgcccccatgcgtggattgccag

SEQ ID NO: 593202 - DNA, 406 bp, Homo sapiens
  misc_feature (31)..(31): n is a, c, g, or t
ttactcccattttggtttcattagtatattntaggtcctcaccaatgtaatatggtgcatggctgttagttttagtgaggtctgtaggattaattcgaaaataggcagaattccattccttccaaggtggccaaaattagctatactgatgtaattgtccttttcctggggatgaattccctgacacacattcctgtccacatatgtagccaattttgtggaaacataaccatttgaaggttctggaattttgagccctgctctaaccaccagcataatataaaattaggttggttttgccagtctcacaatgaggtcttgccacaggactcccagcccttttacttttttcccccaaccttagccaaggaggatcttgagcccttaatttttggggttttttaaa

SEQ ID NO: 593203 - DNA, 378 bp, Homo sapiens
  misc_feature (10)..(10): n is a, c, g, or t
  misc_feature (51)..(51): n is a, c, g, or t
  misc_feature (55)..(55): n is a, c, g, or t
  misc_feature (118)..(118): n is a, c, g, or t
atgttgttcnccatcatgtgtccatgtgttctcatcatttagctcacagantatnttcaacatagacaagagtagagagaaaagtataatgaaactccatatattatctcttcattcnacactttcaacttcacagaactaattatacactatctctaaagatgatatgattctattcatacacactagttattattattatttaacatagggaatattcatatatataacaggtacaaagtctacaatatatagagctcttatatgttcccatattaaatgtaaatatttgtttacacgcatggctttccttggttcatcatatcaggtaatatattaaacagacaggttcacattctatcagatagtatctcgtgc

SEQ ID NO: 593204 - DNA, 148 bp, Homo sapiens
acagggcccatattccaaacagtgccatagctcgctatgctgcccggctggctgcagaagcaggaaacgtgactcggggctcctttgacttgagccttaactttgatgccaacaaacaacaaaaacagcttattgttaaactgtaaaa

SEQ ID NO: 593205 - DNA, 340 bp, Homo sapiens
  misc_feature (95)..(95): n is a, c, g, or t
  misc_feature (177)..(179): n is a, c, g, or t
taatccggggagtaggccacccacgcggaaggggtcagcactgttctggaactcaaagaagtacaaggtggcggggcctactagagtcagagagnggtggccagagatgaggctgaggccaactaaaggagatcagacaatagaactctgttgagaattagtgggctttgtccaaannnaactaataggagcccacttggaggcaaggattttaagtagtggtgtgcactcatcatatttcatttaaacaaatcactgccgtctgtgaatctagatggaaaggaggaaaacaaaataacgtggacaggctcctattagggaggccagtaaacttgttcac

SEQ ID NO: 593206 - DNA, 1241 bp, Homo sapiens
gagtacctgggggctgcgcccctgccgcggccggagcgggtgcccccgtgccagcagctcccagagccaaggtcttcaggactggcctagtgctgtgtggcctgcgcctggagctggtgcctgtgcctgaccaaaccacactggtgggctgcttggcccgggcagggtgcatgcctgtgtggcgttgccctgctgcagcggcaaccaagaaggaagccggtccatcaagggccgtgctgcgctgccaatacaagatcttcaggctggtgcgggacttctacttttcagggggttgcataccgcttcaaagttttcggctgcttggtgacctggcaaggatcgtggacccatgtgaaccgggtacctttcaggtggtgtattctccggcacacagacttcagtccaggccttggggcaaaaccttcagggtgtcagccattcggtgcccgggcacttccaaaggcagttgtcgagagttacgggccgggacgttctggctttgcgccctgtgtgccctttgttccccccccaaacccttcttagccagggtccttaacctgccgtctggccctcttgtcgaccgcgtcggagggatcggcgatttcaccatttgtgtcgccgtggagagtggccccacacccagtccttttgcggccggcaacttttgggcccaagtgcccaatggctcaaggtcccggtcggtcctcgctgtgtgtggtaccccctgtgtgcgtgtgccccccttttggcgggcgtcggctgctggcccatttcgcccgccatttccggctgagccggtgttgtctctggactcacccttttggggtggccccggcgggtgcggtgcccccggtgccgctctgggcgcgtgagtgggtcccggcccgactttggaggggacggcaaggcgttcgtcccccccttttgtggcggatcgggtgccactcccgcgatcacaagcgtgacaacggtttatccgcagcctgtgctcccgggcaccccttacttctcgacgacgaaccttgttggggctccccaaaccgtgcttttgggagcgcaacaccggccttacgcttgtgggcaagtgcaacaaatgtgtcaaacccaaatagagactccccgcaggcacgtgtcccatggccgtgggctcacaacagtgatccagaagaccccgtgtgaaaccccccggtcattgcgacccccgttgtggatctacaaccgggaaaccgcacgcaacattc

SEQ ID NO: 593207 - DNA, 1000 bp, Homo sapiens
cgagattgatatccactaattaaagttgaagcaagataccttatggagaaagaataatctctacgctccatgatccatctatctgaaagatcaaacttttgagacaagagcgtgccggccaacgctgatcgttgatgataagagaaggagatcgggatccttattttgatcgtcgaagtaagtgtgcaatcagcatgatcatgcgagatttgaatgagggagtcgtgagacacattagagatcgagaccgggatcggtggtgttattgagtatgagcgggatcgaatttgacatgagttaatgacgaatgccgagatgatagagatcagtcatatctgaagaaaaataaagaacaattgcctcatccagaagaggggggttttgataggacatcacctatgagcacggaagtctgaccgagcagtctatgagaggacgccattcatggtggggaggagaaccgagggacttatcctgaggagcgagtgcctctgccagctccttcactgaggcacccaggcctcctcgcagcaccgcacgagtcgagaagaagcctgaatcatagaatgtggacgatatgttgagacagcgtgcgggagaggagaactgagagaatgttgtcataatgagaggattactggctgaggaagacgtgttgcaaaagtgtcggataggagggcattggaggactgcaccataaaattaaagcggataattggtatcaatggacgagggcagagaagagatccgaatttggaggaagtgtagaggaatggaataaatgagcggaagagaacattgggccaatgttatagtcacaaaaaggaatgggatagcgtatacaggaggacagaggaggtttgtagcggggccacaacacaaatgatgttgcggagcacgaacagcgagagactggacgaaacaatatgaggagacggagagttatgaaacagagtgcatcaaaacagagagtcactagggatatatgaatttatatggg

SEQ ID NO: 593208 - DNA, 1349 bp, Homo sapiens
agcgtgggtggcggcggcggcagcgggttcggttgcgcgtggcgcacggggtgggagcggagcccaggccgggagcaggcgccgccgccacaggcgaccatggggaacgtgttggctgccagctcgccgcccgcagggccgccaccgccgcctgcgccggccctcgtggggctgcctgccacctccgccctcgccgccgggcttcactgctgcctgcctgctgggagtgcagcctgggcgcctggcaccagtacgagtcgaagttcggaactggacccccggggctgcaacctgccagcgcctcagtggtgcctgcctgaggatggggcctgcgggctgcctgcccaaccctgggcacattcgaggagtgccacctggaagtgcaaggagctgtttcccattcagatggagggtgtcaatgctcacagtcaacaaagggttgagtaaccattttcaggtcaaccacacagtagccctcagcacaatcggggagtccaactaccacttcggggtcacatatgtggggacaaagcagctgagtcccacagaggcgttccctgtactggtgggtgacatggacaacagtggcagtctcaacgctcaggtcattcaccagctgggccccggtctcaggtccaagatggccatccagacccagcagtcgaagtttgtgaactggcaggtggacggggagtatcggggctctgacttcacagcagccgtcacctggggaaccagacgtctcgtgggtcaggaatcctcgtagccaataactccagagcatcacgccttgcttggccctgggtggacgagctggtctaccaccggcggccttggatgaacggacgggcacgtgtgcatgtcatctaagctgcgtgaccaactacagcgaattgaactaaacatggcttgggcacacggttaaccgtagggccatggcgtggcctgcaccgcaactatactaccaacaaatgccagtgactcaagcttgcaggtgggctgtggcagtttgaggccagcaacaacgggatgccaggacctacgcagctgtctcctttcgggttacccaaggctggtaacgctgtcaccaatgggccaatcctcctcttcaaaggctctgtggatagcaactggatcagtgggtgccatcgctggagagagaagctcgccaacccttgccccgttgaacactggcccatatgggggtcctttccttgagatcaaccgacaaggaaacaaagttttcaagtggtgggctacatgggacttcatccatcgggcttgagtcccttccttggccgaaccgggcttctaacgtcaccttctggaattccatgatccatagtgga

SEQ ID NO: 593209 - DNA, 1352 bp, Homo sapiens
ggagaacctggggccggagccgggtgcggatttgctggggctgagtcggggtgcgcgcgggccctgacctctgccctctgacctctcccctagcaggcgaccatggggaacgtgttggctgccagctcgccgcccgcagggccgccaccgccgcctgcgccggccctcgtggggctgcctgccacctccgccctcgccgccgggcttcactgctgcctgcctgctgggagtgcagcctgggcgcctggcaccagtacgagtcgaagttcggaactggacccccggggctgcaacctgccagcgcctcagtggtgcctgcctgaggatggggcctgcgggctgcctgcccaaccctgggcacattcgaggagtgccacctggaagtgcaaggagctgtttcccattcagatggagggtgtcaatgctcacagtcaacaaagggttgagtaaccattttcaggtcaaccacacagtagccctcagcacaatcggggagtccaactaccacttcggggtcacatatgtggggacaaagcagctgagtcccacagaggcgttccctgtactggtgggtgacatggacaacagtggcagtctcaacgctcaggtcattcaccagctgggccccggtctcaggtccaagatggccatccagacccagcagtcgaagtttgtgaactggcaggtggacggggagtatcggggctctgacttcacagcagccgtcacctggggaaccagacgtctcgtgggtcaggaatcctcgtagccaataactccagagcatcacgccttgcttggccctgggtggacgagctggtctaccaccggcggccttggatgaacggacgggcacgtgtgcatgtcatctaagctgcgtgaccaactacagcgaattgaactaaacatggcttgggcacacggttaaccgtagggccatggcgtggcctgcaccgcaactatactaccaacaaatgccagtgactcaagcttgcaggtgggctgtggcagtttgaggccagcaacaacgggatgccaggacctacgcagctgtctcctttcgggttacccaaggctggtaacgctgtcaccaatgggccaatcctcctcttcaaaggctctgtggatagcaactggatcagtgggtgccatcgctggagagagaagctcgccaacccttgccccgttgaacactggcccatatgggggtcctttccttgagatcaaccgacaaggaaacaaagttttcaagtggtgggctacatgggacttcatccatcgggcttgagtcccttccttggccgaaccgggcttctaacgtcaccttctggaattccatgatccatagtgga

SEQ ID NO: 593210 - DNA, 1201 bp, Homo sapiens
  misc_feature (1201)..(1201): n is a, c, g, or t
tgggattcaatcatctttattaaccctatcatcagggttacatttttatacattaattatcttggttattctcaaagggcctctacttatagttacattcagtgtttaatagttaaacaagccaagtaagaagtggctaaacctcaccctagcatttataatatcctcgcggacagagggaagctagaaagagttcaagttcaactcacttttattacatgtgttaagaagttaggtgtctccaagagttaactaagaaagccgtgcatacatttttataagccgaggggaggcacaaaaacttctcattgtgggctctggtggtgttccccagcaacatttattacctttctcaattataacaccagacaagtgatttctcattacaaaagagtgcctcgtggcttttataaatgttctcgtgaacctctcttctcacattacagacatttacacagattagtctacgtggaggctcttgtggggagaggccaattagcttagcaagcttacaatttaagtggggtgttagaaggaagccctcctttactcgaataaccgaggctccaggttgtgggtctattagcccgtgaaccaagaggggaggacgggtaacgcgccttagggtattaggcccactgtggacggaggggtcagtggtacttccaggacagtgaacgtaaaaccgtggtctgtggttgataggcccccaggtgtggtcttggagccattccaggttgagaggcaggagccacagttataatcagaaggcggaaagttgggccaggtaagttgtggcccggaacatggctgcgctggtactgcgggggcaggtgaacaagacatttgttgaggctgaccacgaaaagggcgggagccggtgcctggaacatcggtggcgggcaatctcgggaatcgcgaagttggggggcacatccaggacaaaacgggcgaaaatgggaaacacacgggtgaaggcgcaggagagggacacacaaaggtgtgtgtgacaaacacggcagagcacgaaagaagagaacaaagccagaataaaaaccgtatagatgaggggaataaacaacagaacactcgaatgaaaaacacggtgagctaaaaacaatagaaatgaaacacaacaaacaacaacataatgtgtagaactgataaaaagctcaacacaatctgctctaaatatactgcn

SEQ ID NO: 593211 - DNA, 193 bp, Homo sapiens
atcaggcgtagtcctactccagtgtacttcaggcagattccaggtgcagctcgccggtgcccgtgatgatgtgctctcccgactcctcgatgatgcacttgcaccatggggtcggacttggccagcctgcttcagcccctccaccagcttgggcaggtcagcctgggttcttggcctccacggccactctgac

SEQ ID NO: 593212 - DNA, 410 bp, Homo sapiens
acgtctgtccacccttctgtctgtccgtccatccgtccatccatccgtccatctcactctgtggcccaggctgtcacacagtggcacgatcacagctcactgcagccttgacatcctgagctcaggcgatcctcctcagcctcccgaatggctgggaccacagctgtgtgccaccatgcccagctaattttttgtagaaatgaggtctcatcatattgctgaggctggtctcgaattcctgagctcaagcgatcctcccaccttggcctcccaaagtgctaggattacatacgtgagccactgcgcctagcccggatatagcattttaaattaactgtcattttctggaagggcagtatgttaaaaaaaaaatttcaaataaaatgaaaggggtgtgtgtgtgtgtgtgt

SEQ ID NO: 593213 - DNA, 904 bp, Homo sapiens
  misc_feature (1)..(1): n is a, c, g, or t
nttagcagagctctgacttattctggagaggagtaggaagggatatgagcaggaaactcttgggaggccagagacaaccaacctgctgtatggattggaaaaagaaacataaagacgcataaaggaaaatgaaaccaaaatagtaaatgacaggtggttttgatgctgaatgagaacaaggctcacctaaggaaactgaaccagaaaacaatgttagctgaaaaagaagaaattttaaaatgaaggatttgtagaaatctggctgacggaatatcattctggttgctatctttatctgcggaactcctctgcatttgttcctaagtaattacttcagaaatataaattcaactacatatcaaggaagaacaacatcactccttgaaatactttatgtatataatctcttgccctctatcctgagaactaatggacatcttctcatgcaaggcatacatgaagccttttttaattaatgagccaaagcctttcgtatttcgcaaactaagctgtgcgcgaattataagctctttggaaatcttattcctgattatgccacaccaacccttcattatgatcattcatgctacactgacacatcacacgcacgcatccgcaaaaatataaacaccttgcgcactccgccctacacgtggggatctcagcccaccgcctaactagacagtaggtccatactagagaaattcatccagatatctcatccccacccgcacacgtccgacaagacatgactacttcaactcaatcgagctcatcgtcacatgcatatctagtcatcgctccccccgcacgcggactcatcaccccatgctcgactactctacgccagcacgctctttctaccacctccggatactcacgtctcaccctatcttcttacata

SEQ ID NO: 593214 - DNA, 210 bp, Homo sapiens
ctgaccaagagactctttcagtagctcaaaacatgcttagcttacattggggatcaagaaatgcttattaggctggaagtggtgagccacacctcatcatcccagcactttgggaggccgagatggatcacttaagtccttgagtttgagactagcctaggaaacacagtgagacccaatatctttaaaaaaaaacaaaggaataactgg

SEQ ID NO: 593215 - DNA, 309 bp, Homo sapiens
ggcagaccttgaagttgctgtccagacctgagatgtggagagccagtgggcccagtgcccgttgcatgcctcgttgtccctgagttactcattaaacatgctcaggcactccacagagctcaatatccattgcctgtatcaccgctggattgtcgccacaacattctgaacttactgtctctgcctttgattgtcctgcgtttcgtttccccctttcgtggcttcctctctcccgtttctttgtccctctcttccgtttcttcgagctttagtcccgtgctccctgacgggtgcctgagctctgatttc

SEQ ID NO: 593216 - DNA, 935 bp, Homo sapiens
  misc_feature (8)..(8): n is a, c, g, or t
  misc_feature (74)..(74): n is a, c, g, or t
  misc_feature (98)..(98): n is a, c, g, or t
  misc_feature (124)..(124): n is a, c, g, or t
  misc_feature (127)..(127): n is a, c, g, or t
  misc_feature (148)..(149): n is a, c, g, or t
  misc_feature (153)..(153): n is a, c, g, or t
  misc_feature (160)..(160): n is a, c, g, or t
  misc_feature (191)..(191): n is a, c, g, or t
  misc_feature (197)..(197): n is a, c, g, or t
  misc_feature (216)..(216): n is a, c, g, or t
  misc_feature (268)..(268): n is a, c, g, or t
  misc_feature (271)..(271): n is a, c, g, or t
  misc_feature (278)..(278): n is a, c, g, or t
  misc_feature (280)..(281): n is a, c, g, or t
  misc_feature (289)..(291): n is a, c, g, or t
  misc_feature (294)..(295): n is a, c, g, or t
  misc_feature (302)..(302): n is a, c, g, or t
  misc_feature (321)..(321): n is a, c, g, or t
  misc_feature (323)..(325): n is a, c, g, or t
  misc_feature (327)..(327): n is a, c, g, or t
  misc_feature (332)..(332): n is a, c, g, or t
  misc_feature (337)..(337): n is a, c, g, or t
  misc_feature (339)..(342): n is a, c, g, or t
  misc_feature (347)..(347): n is a, c, g, or t
  misc_feature (358)..(358): n is a, c, g, or t
  misc_feature (377)..(377): n is a, c, g, or t
  misc_feature (380)..(380): n is a, c, g, or t
  misc_feature (386)..(386): n is a, c, g, or t
  misc_feature (395)..(395): n is a, c, g, or t
  misc_feature (433)..(434): n is a, c, g, or t
  misc_feature (527)..(527): n is a, c, g, or t
  misc_feature (529)..(529): n is a, c, g, or t
  misc_feature (540)..(540): n is a, c, g, or t
  misc_feature (709)..(709): n is a, c, g, or t
  misc_feature (934)..(934): n is a, c, g, or t
aacagcanacagagaagaacagaacaaaacattgtttggatcaaataaaaaacagcaggcaacaactcaattcntaaaaataccacgaattcccccgnaatgtggctccatttgatagaaaatnttncattttctggataatgtctgnngttncattaancaaaatggaaaacggcctttagataaacacnctatanagcagcttacacagatgtnttgccctcttcgccttggatgtagggaaaataaagttgtgaggttgcctgcnctngcctaangnntgggttgnnnttnnaattganagtgaccgcttatgagagngnnngnattangtaancnnnngtgtnttgagattgcncaagtgagagcatccaaanggngcgagngtcaatttnttcctatggggaaaagcatatagatatactatgttaanncttccattcctcattcgattatttgccctattcaaaacataaaaatacaaataaatatttccttacaaagttcacagtatgttgttttaaaananagagataaagnaacttaatttgctttgtcattaaataaaaatgctaatatatagacatgttcaatatttatacaaattgtaggggccagtgtatcctttcttggtcataattgaagtttaatagtgctagtccatacacgacaaggctcagatcccaaatgtaagctcaattctactaanagttgctcaagataattttttctctttttctgtttaattaaaaaagacatttttggaattttagaattacatttgagttgtctgaaaaaatacaatttcaatgaaaaatcatatcacgcattcaagagtatattgctggtgctataatctttttgcatgtctttgttttcatagaaaaaaatcagtaaaataacatgtctaagacctttaaatggttaaatgtanc

SEQ ID NO: 593217 - DNA, 477 bp, Homo sapiens
  misc_feature (33)..(33): n is a, c, g, or t
  misc_feature (266)..(266): n is a, c, g, or t
gcaacctcaaggggtgggtctcctaaaaaaggncccatctggggaatgtctgtccttatgcaagttgtaagaacaggggatgaaaatatgcccctggcctccctgcaagcacccccccaggcttgctaggattagggaaaattcccagccctggcgaaattcctagtcaagactggttgtcctggatcacgaacccctgtttccctgttaaagatgtttatcaatgacaatgtggccccagcacgacatggaccttcatcagtaantcctagtttcacccctggccttgtgatctcactctgccctctttgctgttgtgatattttactgcctttgaagcatgtgacccactccctattcgtacacccctccccttttgaaacccctaataaaaacttgctggttttgtggctcaaggggcatcaaggaacctgccaacatgtgatgtcacccccagagacccagctgtaaaatttc

SEQ ID NO: 593218 - DNA, 239 bp, Homo sapiens
tcaacggaacttctgctccgtgaaaggacagtctgatgttttactttctaccaccagcatagaaatgatttcatctgaagatgttagctacttcgcatggatggcactggaaagaccaggaaatttaaataaagtagtggagcagagaccggatgttggaacaatagagagtttctctccaggagattttagaactaatatgaatgttgttcatcaaaacaagcagttagagagctgca

SEQ ID NO: 593219 - DNA, 470 bp, Homo sapiens
ttttttctgagacagagtctggctctgtcgcccaggctggagtacagtggcggatctcggctcactgcaaactctgcctcccgggttcaagtgattctcttgcctcggcctcctaagtagctgggattacaggcatgcgccaccacgcccagctaatttttgtatttttagtagagacggggtttcactgtgttggacaggctggtctcgaactcctgaccttgtgatctgcccgcctcggcctcccaaagtgctgggattacaagcatgagccaccgcacctggcctaaaactctactttcaagtcacataggtatctaggattttggttcttgcaaccttttcgatgacatatgaaaaaaattcctaagagtaaagttaatgatataaaatgtattttattttattttttgagacagagtttcaactctgtcacccaggctggagtgcagtggtgcgatctccgctca

SEQ ID NO: 593220 - DNA, 811 bp, Homo sapiens
agcggaggccccgaacacgggggcgagcgctatcgggtatgtagtcgtgctgcctgagagtctgcacaggatcttgcttgtggcatactcctgtcaattgttggaagatagtagtgccagcttatgtaatgaaccgtctgccaggccccgggacaacagtctaagagaaatggaacgtgagcagcggaagaaccggagcacgtctttatgtgcgcagcgtcatgtagcgtagcatcaagcacgattgcatggagatggaagtcatgctcgcaatgtaatcagtctgacagaggacatattcggatagtggacagcaggagtggagatatggtgatggcctggacactgctgtactccactcccttaatgcatcacaaacgcaacaagaggatgaacatggtagcaagatgcgtgtttggagaatgtgtcagaccaatgacctcattgcaccgagataattcctggagagccaagtactctatctgtagtacaggacctttcgcctgaagaaagatggagactggtagtcaatatttagtatgatggcaacttgcaccatccaagatgggtggaccgatagctcctctagtttgtggaatcacatcatgttgcaagaaacgagcaacagagagcgtgtcctagagacgatgcagagaggaaactagtggcgtgccatgggggttcatcacgagcgagagtccgagtatgcacccactgaaagagcaattctgaccgcaaagtgtaggtgacggcttcggcatgacttctacaacgttgctcgtgatcttcaaagccatgttcgaacatgggg

SEQ ID NO: 593221 - DNA, 252 bp, Homo sapiens
caataccctaatttagtcctctccatctccaacaagagaattgtacgctgcactctgatgaagcaggatcaagtaccatcttcgtctggttttggctgcactaaggctaggcccagcgatgccccccttttttaatttttttccccaaaatgccccagcagctggcacactgagcacctgcactaaattactcaaaatgtgctgtaaagtttcttctttccagtaaagactagccattgcattggcccttat

SEQ ID NO: 593222 - DNA, 329 bp, Homo sapiens
gagcgttgggcttcttcaggccggtcgttgatcacgctccgtgttgccctgacacctcctccagctcctcctccagtctgggcgatgcgggcctccagacaccgcttctcctctaacgccagggctcctttgccgctactgttggggatctcgtcaggcagctcatcccgctcctgcggggcctggcgcttggcaacgctccgcgggtgccagtgcctcctgcaactggatcatcaatatgtaaaaagtctaattaattaagatcattgatagcgatcagcctaagcctggaatagcccagttggctccgacaggggaaaaaggtggaa

SEQ ID NO: 593223 - DNA, 886 bp, Homo sapiens
ccgggaccaaacttacggctaggtacgaggctgggtttgaatcggccgaggcttctgccgtggtccctaacgcttcggggcaggggtgcggtcttgcattatggaagccgagcgtcttgcgtgcttcccgtcgggcaccatctactccggccccgcaccctacctggtgcatcccctagacacctccggggtccctacctggagatccccggagcccccctttcctgcgccagtccatgcctttaaaacctgcactttgtccatgtcctcactgccagtgactggcatgactgagagacgtgaatgaattcgacctggagcaacgcgatgtgctcttcagaagctggcgcctgggagtgtggcgtaactaatgcctggcgatggacatctagcaccggtagctgctaggacgtagagtgctgaagcgtgacagcggcgacgagatgaggtgccgactaagtacttcctggctggtgctccgtcaccactgtagcaagggcagtagagcgacccaggtggcacctgctgcgagtgcccccaccccggccctgaacaggtacgagcttggaattcccattgacacagccaaggggcgtgcacattgatgtattaccggagccgctcgatgactcgaggtggtgagccctctgtggtgctgctcgctggaccgtgggtggcctgcagtttggtgccctggagcggctggaatcgggacagcccttgggagtaccttgcagaattcggagtgccggagtaccagcgcgagggcaacgccagctttccctctttggggcttctggacacctggtccctgggggcgtccctggcccctgtggggaatcccctgggtggccgctctcaaaggttgccacatggaatccgcgaa

SEQ ID NO: 593224 - DNA, 332 bp, Homo sapiens
cgtgtatctaaggagtagacctggcaggaaagtactcctccagatgctgtaactcttcagcgagcaggaccgcagggaggacgccgagctggacccgagtccaagctctgtactccagccttggaaataaatccccctacattgtctgtgccacacaaattcccgttccagcagggctctcctgtggggttattctggtaacaaactgcttgagatcagccatacttttctaatcttaaccgctctcagagaggaagccactgggctcttccttaagctccactttctgtgtctgacatgtggttgaaaactaatatttcagatgtttactc

SEQ ID NO: 593225 - DNA, 1507 bp, Homo sapiens
  misc_feature (200)..(200): n is a, c, g, or t
atgcttctgtgctcctggctctcttacgccgtctacggccaagtatgatgactatgaccgccactgttcactagcggggattttggggccaagatgcaattggttcctcaaacaagggtcacactaattcctgtttcggatgaacatccaggcagaatgctggtgaggtagcagtaacttacatgctttgcgtgaccggnaccagcgatccgcaggcctgagccgagggtattgaatcgtggatacatgggatatatctgaaagcatagtctcagtgtagccgtggcatgaattgttgacgcgagttgaagctacttttggcagaatcctggatactaagaaaggcgggcacgagcagactgtcgtgcgtctggagggtgtgatgctcctgtgtggactttccagcatttaatgaatcgcccctgaaggatacgatgaacttggaggctcgtcacagcactactctctttgcccgttggaagattgcacaaatccgaaaaacggtgctcggttgcaggaagtagcaaagggagattgtactaagttagaagccatctgtggattgacgagacaatagtttggaggcgttccattccagaagttataaccttcccttcaaatacgcgtgtcgggggtttaaattaaaggtctagaatttccgtcccaagacttaattgttaatgccgggggaaaatcgcccatggcactccgtaatgttgatgcacggcatgaaaccgggagagatgccctgaataacgctctttggggtaaaggttctgcaacgccaagtcactttgaaaaccgccttcacatggggcccgaggcgggaaagggaacgaacaccgggccttaacgatgacagctcttagaattcgggaagccggcgcataagttcgcccgtttcgcttgctgcatgtaggacaggccaagattgcaccggggaagggggatgcggcgttgaccacggtgcggcccgcaaggggcgcaattgcacgtgtcgttggacagaacgaggaatggggcttgcatgtacaccaattgacacatggacacgcaaggggccaaccaaccctggggggccacaacaggaaaagaccaaggtgtacttgcacgcggccattggtaagggaaaggcacacagacgggtgcaccccatgggtattgtgtgtacctgtcgcgaacatgtgggccgcagaaatcaaccgggcaggggtaggtggacggcatagacacctttttatgggcccccgaaaataggagcctttcaacacgattggatgtagacgccacgcgaaaaacatgtcgcatggagacactccactaaaggtgcccccacaggagacacacaatctactaactagacatacgtcattcagctacacaaacgacccagcactatcatttgggtgcgacaactccaacgaagtgcatttgtgtatactaaacgagcacgaattctatttcgtcacgatgagataacaatacccttctgatctagttagtgcac

SEQ ID NO: 593226 - DNA, 163 bp, Homo sapiens
ttgtttgtgtgtgtgtgtgtgtgtgtgtgtcgcgaatttgctcttattgctcaggctggagtgcattggcgcgagaggtatgtgacacacgcctggataattttgtatttttaatagagagggggtttcaacatgtgggtcaggctggtctcaaactcgcgag

SEQ ID NO: 593227 - DNA, 859 bp, Homo sapiens
  misc_feature (100)..(100): n is a, c, g, or t
  misc_feature (472)..(472): n is a, c, g, or t
  misc_feature (710)..(710): n is a, c, g, or t
  misc_feature (712)..(712): n is a, c, g, or t
  misc_feature (715)..(715): n is a, c, g, or t
  misc_feature (717)..(717): n is a, c, g, or t
  misc_feature (719)..(719): n is a, c, g, or t
  misc_feature (722)..(722): n is a, c, g, or t
  misc_feature (741)..(741): n is a, c, g, or t
  misc_feature (745)..(745): n is a, c, g, or t
  misc_feature (753)..(753): n is a, c, g, or t
  misc_feature (771)..(771): n is a, c, g, or t
  misc_feature (775)..(776): n is a, c, g, or t
  misc_feature (778)..(778): n is a, c, g, or t
  misc_feature (782)..(782): n is a, c, g, or t
  misc_feature (787)..(787): n is a, c, g, or t
  misc_feature (793)..(793): n is a, c, g, or t
  misc_feature (800)..(800): n is a, c, g, or t
  misc_feature (802)..(802): n is a, c, g, or t
  misc_feature (804)..(804): n is a, c, g, or t
  misc_feature (808)..(808): n is a, c, g, or t
  misc_feature (811)..(811): n is a, c, g, or t
  misc_feature (823)..(823): n is a, c, g, or t
  misc_feature (827)..(827): n is a, c, g, or t
  misc_feature (830)..(830): n is a, c, g, or t
  misc_feature (836)..(836): n is a, c, g, or t
  misc_feature (838)..(838): n is a, c, g, or t
  misc_feature (859)..(859): n is a, c, g, or t
aggcgttcctgcaacggatgcgatggacgtccgccgaccatatagcgcacgtgtagcttcgccatttcgtcgtcggagagatcaaccacgctgtagccgncgtcgttgagcatctgcaaaatttctttgcgctcttcgaggccgcggtcaggcgcacaccgacaaagatgcaggcgtttttggcatcggcaaacggtagttgaactcggtgaccgaacgcccgccaagcagttggcagaatttgaggaagctgcctttttcttccggaatggtcaccgacaacaacgcttcacgctgttcgccagttcgcagcgttctgagacgtagcgcaggccgtggaagttcacgttggcaccggaaagaatatgcgccagccgttcgccgcgaatgttgtgcagggcgatatattttttcattcccgccagcgccaggcgccagagggttccgccaccggcgcacatcttcgaataantccttcatcgccgcacagatcgcatcgtatcgacggtgatgatgtcgtcgagatactcctggcataaacggaaggtttcgtcaccgaatgcgtattaccgtaacgccttcagaaatagccctacgcgcggagatcacccggatgaaaacgcatacagcgctgactttcaggcaggcggagtcttccgattctaaggagatcactttgatttgacggcatcaagatagttgatcagacngncangncnagnagccagaccgcgcggcgantggnacaatacncggccagatggcgtctgntggnnantcanggccnggtgcntgccggnancncatncgntgtcgaaggggncccngtnaccctntngttgacatcaacgcaatggtn

SEQ ID NO: 593228 - DNA, 843 bp, Homo sapiens
  misc_feature (26)..(26): n is a, c, g, or t
  misc_feature (28)..(28): n is a, c, g, or t
  misc_feature (94)..(94): n is a, c, g, or t
  misc_feature (101)..(101): n is a, c, g, or t
  misc_feature (115)..(115): n is a, c, g, or t
  misc_feature (182)..(182): n is a, c, g, or t
  misc_feature (190)..(190): n is a, c, g, or t
  misc_feature (208)..(208): n is a, c, g, or t
  misc_feature (221)..(221): n is a, c, g, or t
  misc_feature (238)..(238): n is a, c, g, or t
  misc_feature (247)..(247): n is a, c, g, or t
  misc_feature (267)..(267): n is a, c, g, or t
  misc_feature (269)..(269): n is a, c, g, or t
  misc_feature (281)..(281): n is a, c, g, or t
  misc_feature (301)..(301): n is a, c, g, or t
  misc_feature (322)..(322): n is a, c, g, or t
  misc_feature (334)..(334): n is a, c, g, or t
  misc_feature (344)..(344): n is a, c, g, or t
  misc_feature (346)..(346): n is a, c, g, or t
  misc_feature (367)..(368): n is a, c, g, or t
  misc_feature (467)..(467): n is a, c, g, or t
  misc_feature (505)..(505): n is a, c, g, or t
  misc_feature (508)..(508): n is a, c, g, or t
  misc_feature (515)..(515): n is a, c, g, or t
  misc_feature (519)..(519): n is a, c, g, or t
  misc_feature (523)..(523): n is a, c, g, or t
  misc_feature (535)..(535): n is a, c, g, or t
  misc_feature (543)..(543): n is a, c, g, or t
  misc_feature (559)..(559): n is a, c, g, or t
  misc_feature (561)..(562): n is a, c, g, or t
  misc_feature (565)..(565): n is a, c, g, or t
  misc_feature (611)..(612): n is a, c, g, or t
  misc_feature (616)..(616): n is a, c, g, or t
  misc_feature (627)..(627): n is a, c, g, or t
  misc_feature (633)..(633): n is a, c, g, or t
  misc_feature (635)..(635): n is a, c, g, or t
  misc_feature (648)..(649): n is a, c, g, or t
  misc_feature (656)..(656): n is a, c, g, or t
  misc_feature (658)..(658): n is a, c, g, or t
  misc_feature (662)..(664): n is a, c, g, or t
  misc_feature (668)..(669): n is a, c, g, or t
  misc_feature (707)..(708): n is a, c, g, or t
  misc_feature (843)..(843): n is a, c, g, or t
aaatggcgccagaactagtggcgggntnaggacgccgtacccttctggataggtagcccttgctggttctccttttgccgcccgttcccttccngacattnaggtcgtggaggtncgcttcgtccttctttcttgtagcccatccgcgaccttttccaagaatttgggagggggatgtggtngcccagcngggctagttaactggatnagcgggatcaganctgcatttcttttgacnaaggcaagnttcatcaatgaacttcattnangcagcgttgttnttccagtggttctgcctgcntctacagtaagaatgggggantacctctactcnttcgtttacnangcccttgatttcatctctggnnattggggggctaagcagctctcttcggtgtaggaggatagggttaatggggttgttagctctggggtcccttaggaggcttagaatgagttccttgtcntggattattcctctgactcccggataaagtggatcttnagnatgattngacncctngtgaggtcttcntcatcccnctcctgtccatggctntnntgnctcctgttgaaatggagtagaacaacaatcccctgtacagccgtcnnggtnaggtcctgtcnattcgntntgttttcaggatnnacacgtntntttnnntttnntttttgtttttcatgttggagccagagggcatgtcccnnatggaaccagcgggcgtttcccccatgccagggacccagaaggacaccgggaggactgaggagcagccaatggaagtttccgtgtgcaggagccctgtcccagcactcggcttctcccaggagccaggccctctn

SEQ ID NO: 593229 - DNA, 121 bp, Homo sapiens
cgacccacgcgttcgactagttctagatcgcgagcggccgccctttttttttttggtccaaatgatttaattatgggaatgcacaatttttttaatatgcaattaaaaagtttaaaaagtt

SEQ ID NO: 593230 - DNA, 313 bp, Homo sapiens
ctgccgagctctggaatgctatggcgtcgtctcagctcactgcaactgtcacctcctgggttcaagcaattctcctcccgcagccttccaaatagctgggattcccgcagtacaccaccaagcccagctaatttgtgtatttttagtagagtccaggtttcaccatgttggccaggctggtttcaaactcctgacctcaagtgatctgcccacctgggcctcccaaagcgctgggattacaggcgtgagccaccgcatcagctttttttttttttttttttttttaagaaaggctaaaaggggggaatttttt

SEQ ID NO: 593231 - DNA, 204 bp, Homo sapiens
gcctgcgcttacgctcccgggtcgagcactctcgtgtaagcctcctgagtagctgggattacagtgcgcctgcagcaatgcctagctgatattttgtattttatgtagagactgggtttcacctgtgttagccagtgatggtctcgatctccgtgacacttgtgatcctgcccgcctctggcctcccaaaagtgctgtggatta

SEQ ID NO: 593232 - DNA, 346 bp, Homo sapiens
tcatttcagttccactggatgagttactttgttccccattccaaaagctgactgttcctattcccatttaaacggcactttataaaattctcatgtgtctttacattttatgcttgccacaaagaaggaaattcattgcttgattaaacttaaaataggattttttaaactaagggaacctaaaagccactcttgactccaacatatcaatttaagccactgcagctgcggtttctgtcccgtcctctgctgttttacacagaactggcttctagtggagctccttacattccaatctatattttttttgtttgtttaaatttcgttatctatgttatttaaaagg

SEQ ID NO: 593233 - DNA, 283 bp, Homo sapiens
  misc_feature (90)..(90): n is a, c, g, or t
cttatgctgctccctcttcaagtgattctcctgtctcagcctcccatgtagctgggacacaggcccccccaccacgcccaggtaattttngtatgtttagtagagatggagttcaccatgtggccagggtggtttcaaactcctgatctcagttgattcgcccacctttgcctcccaaagtgctgagattacaggtgtgagccacacgcccggcactaactaacaatttaactcctagtgctcttgtgttggtctggacccttctagtaacagaacggccata

SEQ ID NO: 593234 - DNA, 616 bp, Homo sapiens
attatactagcatgtaccatctcacttctaggaatactagtatatcgctcagacctcatatcctccctactatgcctagaaggaataatagtatcgctgttcattatagctactctcgataaccctcaacacccactccctcttagccgaatatgtgcctatgccatactagtcttgccgcctgcgaagcagcggtgggcctagccctactagtctcaatcgtccaacacatatgggctagactacgtacataacctaaaccatactccaatgctaaaactaatcgtcccgacaattatattactagcgacggacatgactttccaaagaagacacataattgggaatcaacgagaagcacccgggaggcctaattattagcgtcatccctctactatttttgtaaccaaatcaacaacaagctattgaggtggttccccagactttgtcctccgtagccgctgaacagacgcgctcctaatactaggctacgtgagtcgtagccctcgacgagtcatggcaatgccagacgccacttgatgccagtgaaccactatcgagaaaaaaagtctacctctctatactgaatctccctagaaatctccttattgataac

SEQ ID NO: 593235 - DNA, 953 bp, Homo sapiens
ctgaaacccaccttgattcgtcccctctcccccctccccaccttccctcgcgctaatcccccaacgaggaaggaaggagcagaggtgcaatctctggtaatctatgccagcaattatgacaatgtcagcagaccatgcagcttcgtcagctgcttgattcagccaagacaactggactactcaactttattacgataatgtggtgaaaatcgcttataccatggagaaggagcccagcaaagaatggctcaagacgtactgacacatctaaaggagcatcctgtatgcttggacaagagtcgacacaaattttggacattttctcagcaatatgaatacgcacctactatggactacaactttggaaacctgtgactcaaatacaacggcggcaagattcttccacaggaaccagtgcgaacggcactacgcaccactacgtgctggcctcattatcaacgacgtcatcatgacccaacttgtgtagacgaacgaccacggcgtatatcggcaacattcaaatatgatcccttgctcagatagtgataagcacgaagtggcccacaacacttgtcccacctctgctcagctgcatcactcgttggccgtcccgtagcgatccgccgacacgccttcctgtccgccctctacagttctgcgttgcctcgcgttccaccccctttggacggcgacgactgctcctcgggctcacccccacacgtgtgaccgcctaccccccgttgcgattccggccgctctcgcggccccgctcgtgccattggactcccgccagcgtgtcttttcctctggtcggcagtctcgcctcctgttccattctgccttgctcgcctagccactgctctcttcgtccgcccgcctcccccttgcccggctgccccggtggcctcggcccgttcgcggtattctttccgctctgcttccgtttcaccgcc

SEQ ID NO: 593236 - DNA, 632 bp, Homo sapiens
  misc_feature (281)..(281): n is a, c, g, or t
  misc_feature (478)..(478): n is a, c, g, or t
cagtagacctggagctgtgaggagattcggtccggaacactgactccactgcgggccgacaccgtgcggttgtgaactcggacccattccaacaatcatgctacacatggagcattactatgaggatctaggcgtgcatggacatgccttaaccgaggatattaggcatatacagaacgtgaactgaagtgatgtccagatacatatgaagtgctgtcggatgctaagaaacgggacatgtatgacacatatggcgaacgagggatcacatggtggaggangaggcttgagctactaaagcagtgcaattgtaggcgtgtgccaattgagtaagccataaggtgaactatgggaacagtgtgaactgagggacccattggcatttgagtacactgatgactctacagaggcactttttgagactcagatgcgtacgcgcgtcatcgagaatctacgcactgtgtctgagctctgtgcngacagctgagtgcctgctttaggacaccggtgccagtgcatcgcgtccgcgtatgcttcataggctacactacggtgacgtaggcctaggttcaaacaccttcaagacttgagttagtagtggcatgtgccattagtatagtaggccagacttc

SEQ ID NO: 593237 - DNA, 752 bp, Homo sapiens
ggcccaccagcgctgccgcggcccttttccgttagcgcagctgctgttgttcctgctaggtcccacattggtgctaggcatcttcttccatctgcccattaactctagcaagcgcctgcgtgaggagattcacaaggacctgctactagactgacgcgtacgagatctccaaccagcctgggggctgctggcggtcggcgcagacacctcaagatcacagattctgatcgccatattctctactccacagaggatgcatacactgggagatctgcctctacaactgatgactatgacatatgcgaagtgtgtgtcgagagcaccggaacagggcggagaccctaccaacgctagatgctagacatgaagcatgtcgtgtaggcgagtaatcacgtataagaccagtgacaatatatacgcgacgatgtcgcctacatgatgaacagagaagaggagatgcactggaccaacgagtcacagacactcggctgctatactgaggatctattaatagtgctgtctcattggaatagcatcctgggaggagtgctacctgcgatgcttctgaacgccacaaacatgttgggcactgaatgaaagctaatgttctgcgagcttgtacgcgagacagagtacataggtggcacttgactagaacaaagaagactctcacaagacatctttgtacgccggcgttttattggtcctatctcttttgtgtgggaggacagggggggggcctcactcaccag

SEQ ID NO: 593238 - DNA, 560 bp, Homo sapiens
  misc_feature (2)..(2): n is a, c, g, or t
  misc_feature (5)..(5): n is a, c, g, or t
  misc_feature (15)..(15): n is a, c, g, or t
  misc_feature (22)..(22): n is a, c, g, or t
  misc_feature (31)..(31): n is a, c, g, or t
  misc_feature (35)..(35): n is a, c, g, or t
  misc_feature (63)..(63): n is a, c, g, or t
  misc_feature (65)..(65): n is a, c, g, or t
  misc_feature (70)..(70): n is a, c, g, or t
  misc_feature (75)..(75): n is a, c, g, or t
  misc_feature (77)..(77): n is a, c, g, or t
  misc_feature (81)..(81): n is a, c, g, or t
  misc_feature (84)..(84): n is a, c, g, or t
  misc_feature (88)..(88): n is a, c, g, or t
  misc_feature (105)..(105): n is a, c, g, or t
  misc_feature (117)..(117): n is a, c, g, or t
  misc_feature (120)..(120): n is a, c, g, or t
  misc_feature (137)..(137): n is a, c, g, or t
  misc_feature (140)..(140): n is a, c, g, or t
  misc_feature (148)..(148): n is a, c, g, or t
  misc_feature (169)..(169): n is a, c, g, or t
  misc_feature (182)..(182): n is a, c, g, or t
  misc_feature (186)..(186): n is a, c, g, or t
  misc_feature (190)..(190): n is a, c, g, or t
  misc_feature (195)..(195): n is a, c, g, or t
  misc_feature (207)..(208): n is a, c, g, or t
  misc_feature (212)..(212): n is a, c, g, or t
  misc_feature (237)..(237): n is a, c, g, or t
  misc_feature (241)..(241): n is a, c, g, or t
  misc_feature (258)..(258): n is a, c, g, or t
  misc_feature (262)..(262): n is a, c, g, or t
  misc_feature (266)..(266): n is a, c, g, or t
  misc_feature (292)..(292): n is a, c, g, or t
  misc_feature (296)..(296): n is a, c, g, or t
  misc_feature (301)..(301): n is a, c, g, or t
  misc_feature (311)..(311): n is a, c, g, or t
  misc_feature (316)..(316): n is a, c, g, or t
  misc_feature (319)..(319): n is a, c, g, or t
  misc_feature (325)..(325): n is a, c, g, or t
  misc_feature (327)..(327): n is a, c, g, or t
  misc_feature (330)..(331): n is a, c, g, or t
  misc_feature (336)..(336): n is a, c, g, or t
  misc_feature (340)..(340): n is a, c, g, or t
  misc_feature (359)..(359): n is a, c, g, or t
  misc_feature (368)..(368): n is a, c, g, or t
  misc_feature (370)..(370): n is a, c, g, or t
  misc_feature (380)..(380): n is a, c, g, or t
  misc_feature (397)..(397): n is a, c, g, or t
  misc_feature (402)..(402): n is a, c, g, or t
  misc_feature (414)..(414): n is a, c, g, or t
  misc_feature (422)..(422): n is a, c, g, or t
  misc_feature (424)..(425): n is a, c, g, or t
  misc_feature (428)..(428): n is a, c, g, or t
  misc_feature (433)..(433): n is a, c, g, or t
  misc_feature (442)..(442): n is a, c, g, or t
  misc_feature (460)..(460): n is a, c, g, or t
  misc_feature (462)..(462): n is a, c, g, or t
  misc_feature (470)..(470): n is a, c, g, or t
  misc_feature (477)..(477): n is a, c, g, or t
  misc_feature (484)..(485): n is a, c, g, or t
  misc_feature (495)..(496): n is a, c, g, or t
  misc_feature (500)..(500): n is a, c, g, or t
  misc_feature (553)..(553): n is a, c, g, or t
tnggnccatttgggnattttgntttcaattngggngaaagttggaattaggattaggattgtngngaagnatagnangggngcnactnggccaaggatgggaaanggggagcttacnggnggccccccgattcaggntanaaagaggnggtctgcggctaggagtcaanaaagtgattggcntagngggngaaanattatgctttgnngttngggaaaagggggggggggggggagngcgngggggggggggggtagnaatngggnaagggcgccccccagtttgttagggncggntcggngaattggggnggggnagngggaanancanncgggngggngggggggggggggggttangggggaggngnggggaaaatnggcgggggcccccaggnggtcnggggagaatagngttaaggncnntanggggngaatgaagngaagtaagccgggggcgncnttgattgngtagganggggggnnggggattttnncggnagggggggggatccccaggggggtgtttgaccccggcccgggcaaaaaaaggngggggag

SEQ ID NO: 593239 - DNA, 773 bp, Homo sapiens
gagacaggaccattgtgcgttcaacaggcctttcgtgatgatcattgtccgtacagacacctagaacatcttcttcatgagcagagtcaccaatcccaagcaagcctagagcttgccatcaagcagtggggctctcagtaaggaacttggcatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagaggtcctggtgcctcctgacagcacataaataatttccgttggaaaaaagaaaaaaacaaaaaggatttgccggcctgctgcgcattgcagttcgcggcgtgcggaggaaagagacgacgcgctccaggcaagcaggaacccgcccatgagtgctgcgacggagtgacacaacacgcgcccgtggcagcgtgtgcattgcgagagagcctggatctgtcgagcgcacagtctgagcaactgcacagagcgacagcggtatgctcgcgggcgttctcgcgagtgacgacgaactgaagactggcaccgtgagacaccgagaggcgcaatgccgaagtctgagaacgcccaggaagtgagagccgagactgcgaaagctcggtagcgcggtgccagcgcgcggcctccccctaaaacgcctgcgcccttacatcaccacgcgcgaacaccgtccggctccggcgcga

SEQ ID NO: 593240 - DNA, 124 bp, Homo sapiens
ggcaccacgcacattctgtaagggggccactgctaggcattgaagatacagtggtgaacaatatatgcagggaaaataatcaagacaatacaaggtcattcgctgattgccgtgttttgatagt

SEQ ID NO: 593241 - DNA, 403 bp, Homo sapiens
  misc_feature (314)..(314): n is a, c, g, or t
cacgagggcgcccggtcacgtcatgccggcccgcagtcccagcgtcgcaattagcgatgattgaccaggttatgacctagctttgttttgtctacctaatcactatgccgtggatttgggaaatgagtttattcctcatggactgattatggacaggactgaaagacttgcgcgagatgtcatgaaggacatgggaggacaccacattgtggccctcagtgtgctcaaggggggatatgaggtctttgctgacctgctgaattacattgatgcactgaatagaaatagtgatagatccattcctatgactgtanattttatcagactgaagagctactgctcatgatcagtcaacgggggacataaaagttattggtggtgatgatctctcacctttaactgg

SEQ ID NO: 593242 - DNA, 156 bp, Homo sapiens
aatcgcggtcattatgagggctgagagcggccccgtaggggtcatggtgttgggttttactatatgataggcatgatgattgagtgggtcattatgtgttgtcgtgcaggtatgaggcttactagaatgtgtgaaaacgtaggcttggattaaggc

SEQ ID NO: 593243 - DNA, 162 bp, Homo sapiens
agtaatgtatgagctgctggggctagcctcgagactgttcaacttctgttccgcaaatgcagcctcaagacggtgctgctcttggccgagcagatgatcagccgcatcgagtatatccactccaagaacttcatccacctgggacgtcaagccctgacaact

SEQ ID NO: 593244 - DNA, 1778 bp, Homo sapiens
ggcccgggcggcggcagcaacagcggcgtgcgtgcatctggcccgagccgccggcctgccctcccagacctcaccagacccgacagtgcatgacacatatgactcccatcacacatatggatcccactgtgtcccagaatcagacatctgagacagagagatgactagcatcatagatgcatataacatcgatcgtagaataactacacaagacagaacgatgagacacacagagacgaccaggtgacacaatgagacaacacgaacaacccatgcgaggcaccaggagtatgtactgagacggatgcaatcaaggataatagacgacactgacgagactgaacaacacacaaacaagagaagaacaaacaacacagagacaaaaaaagagagcagcaaacaagcagaaccagcggaaccaaatggacaaagcaaacacagaaacacaaccaagcacagaacaaccaaacaacgaagaaatagagaccgaatacacacaattacgaccacacaagcacacgacaaccaacacacaagcgacaaccaaataactacagaacaccaaagcagcagaaagaaaaggacaccaagaggaagaacatagacaacggaagacagaagacaaaccaggaaaagacaacagcaaattgaaagaaacatcacacatagaagcacaggcacagaacaggacagtaggagaccacaaccagcagccaaggccaaccatacagaagaaacccaacacaccaaacacaccgagcgaaaacacaacaccatagagcacaaaacatcgtggacgcctacacgaacagcgcaacaaacgaaggaagccagagcaacgcacaaacagcaccaccacaaaccacacgcaagagaagcagcgcgacagaccgaccacaaacagacaaacgagacaaagacacaacaatgagaagcagacagacatacaccacgacggcgacagaccagcaaaaagaagaaccacacaacacaagcgaagcgaacacctacgaaggagacaacaccacacgcagcacaggaaacacaacaagaacgaagcagaaaacaaacacaccaagaacaacacagcaaacgacgaacaaacagcaacagcgaccaaagcaaagacaaacgagacaagaagacaaaatccaacgcacacacaacacacgaccgggaagagaaaggacaagaggacagaggagacaagaaagaaccagaacgaacagacagaaccacagcacgacaaccgagaccaaaacaaacaacaccacgagcgagagggagacaccatgaacagagcaccagtaagcaacgcaacagaacaacatgaaagaagccgcaaccaccagaacgcagaacgaccagagacacagacatcactacaagctgaaggcaacaacagaaccagacgacgagaaccaacacgcactagacacgcgacaagagaccgactagcgcgctcaagaagaacacagagaacacgacagagaggcgagcgaaacacacacagaagaaacgcgagcggaggagagcaaaacaagccaaagcgaacgacaaaacagagaacaagacgacgagagaaggacgacgaagagcggacagacgagcaaagagaggagtgacaacgacaccggaaggcagacacacagcagacgacgaggcgagaaaacgaccagcagcaccggacgagccaacgaagagaggcgacgaaggagacgcaccgcgaagcacccgatcgacacacccgtacaacgacacagcgacagcgaaagaca

SEQ ID NO: 593245 - DNA, 175 bp, Homo sapiens
acagacccatgagcacatgtggggagtatactcaccctactcctacaggcctgcattccgtagctgctcagtacattaacccattcaatgtctttaagatttaatacaagttagttaatcctgtaagttacatacatcataaactctattaatatcgtgagataaagatcacaga

SEQ ID NO: 593246 - DNA, 1152 bp, Homo sapiens
  misc_feature (565)..(565): n is a, c, g, or t
gtcggggtaggaccacacagaggaaaccagtcggggaagaatgtgatggtggagccgcatctggctatgaggtgtcgtcttcatattgtccgcaggaacacggcagagatgcaacgtgggtcaccgaagtaaccttggtcccatggggaatcaggtatggatggagacgaagagagtctcgcattctcgtgatagggagatgacacaacatttggagtaaccggacgcctgagtaaccgccgtatcctgctccgaaggctgatgcgaagcatgcgaaatgcctggtgttggtggttgagacgcaggatccaacatcaagaacctgggggggctgaagggttcgtcgtgtcgcgtcgtggggcgttgcgcctcggggctacacacggtgtcttccgccatttgtcgtcctgatcaatcgctttggtcccccggattgggtcctaagttcgtagttgcccggtctgaagcttcgtcacgcctcacgctcgtggaccgcgtgaccctccattgaacttttgtggcccaagaacgagggaccaaacatgcattccctgtgcattcgagngatgctgcgaacacccaacaacaaattagccgcatggctcattcgcaatggtgggcatgtgatctattgctgcatgtggcccgagccagaccgagagcccggatttgtggccctgaatgccctacaacgttcctgcgtaaatggcaggacactttcgtggatttccatttaagggcaacgtggcgattgactccacaggcctcaggcgaaggccggtggtaggctccgaaagtgcaccaagatgcaactaggagcaacatgaaagccgcaggaagccaggttggaccctttgaagcccatattgcaaaagagaaccatggccaggggtcgctagggcagtggtacaaagggggccaaaccccccccaaatgggcggtagcaagaaaccgtgggcaacgatcacacagaggcatggaccacacggagattcgcggaaagagcaacgcctggcgcgttggaggaaccttggcattgcaccgcgcggagcgtagtgccgacaatttataacgaagaaggcctaccaccccggggcaggagagacacacacaacacaacacggcagacggcggccacaataaaaatctccc

SEQ ID NO: 593247 - DNA, 132 bp, Homo sapiens
tttgtatgggaactgttggattttgtgtttttaccaaaattgctgatgctactgaaaaaagagaataacttggacaatgaaatgatgtcaaatgtggtaataaaacctttactgagctttttgaaaaactca

SEQ ID NO: 593248 - DNA, 109 bp, Homo sapiens
cgtactcccttacacgcaagcctagactgccagcagtcacaccacacagtacacaccctcaccccatcatctcaagtttctccaccgaaccaaaatctacccgtgggcg

SEQ ID NO: 593249 - DNA, 227 bp, Homo sapiens
aaaaatattcttaccctttcccttttagctctgctctatcgctcaccttctttttacagctagatttctaaagcaacaacaaaaatctgcatgtacgatctccacttcctgattttctggttgcttctagtcaactgcggattgacttcttcatattcactgaatttgttcttgccaaatcatcaatacccttctcactgtttcacccagtgggcatatcattgccc

SEQ ID NO: 593250 - DNA, 181 bp, Homo sapiens
  misc_feature (22)..(22): n is a, c, g, or t
  misc_feature (167)..(167): n is a, c, g, or t
agccgtaacccgggtagactancaggtgactaactgtgcattggtgtaccctggcatgcacaggtgtgcactgatgtgccctggcatccattggtgtaccctggtgtgcctgccataggaccctgggcgggagctcccatctcatctacatcaatccctgacgttangtctacctgggggt

SEQ ID NO: 593251 - DNA, 1186 bp, Homo sapiens
gatgggttacagggtaactcaaccctggctgccatccttgggcactgtgtgtgtccaggcaccttggaggaccgtgcagcccccagaagcttccagctcccgcaccactcagtgaagcccagcctggcgcctgccctgcccccgtcacgggatgggcccccattggggttcaacattccatcgcagccaaaggcagtcggcacttgggacatctgcttccacggacaggtcacctccgctttgcacggaagaatctggatgcttacattaaactggtgttctgagagttcctacggacaggtcacctccgctttgcacggaagaatctggatgcttacattaaactggtgttctgagagttcctacggacaggtcacctccgctttgcacggaagaatctggatgcttacattaaactggtgttctgagagttcctacggacaggtcacctccgctttgcatggaagaatctggatgcttacattaaactggtgttctgagagttcctacggacaggtcacctctgctttccatagaagaatctggacgcttacattaaactgatgttctgagaattcctacaggcaggactgaaagcctggtgtgtgccagtatgatgttccacccacagaaacctggtcacaatcgtcccttccagcaccccatccagcagtgactgcacacactgagccccctaccagcccctttcaccctgctgactgtcactgggccctgggatgtgcaagactccacagcagcagaggtggggggacatatcacagcctctgcccccggctgtgatgccaccgaggggctcgcctgctgatggcttcaacagggtctcacctcatcttttcctgctctttggccctggatcgagaaaatttccatcagtgccccattaatatgctgccctgtggcatctgcccaggaggccctgccaggcgtgcacaggtgtgcattggtgtaccctggcatgcacaggtgtgcactgatgtgccctggcatccattggtgtaccctggtgtgcctgccataggaccctgggcgggagctcccatctcatctacatctcctgattcatgcgttgtttcataggtttcaatgtctctgtaaatgtggtagaaatgcaggctttatgggcataaagtgtacatttctaaataaatcccttctatttagtatg

SEQ ID NO: 593252 - DNA, 312 bp, Homo sapiens
  misc_feature (45)..(46): n is a, c, g, or t
ccccccccccccccttggggaaatggggggggggggtggcggttnnagggtcttatttaatcaaggctggttttgtgtacccggcggttcgccccggcgccccctttccccctttttttcctcccctaggaggccccgggcccgttccaccctcccggctttagcttgggccgggggccggtttcccattttcccccgggacccccttttcccctttggcctctttttgtggccctttttttccagtttgttcgcaggagccggctgggtccggtccgggatttccgggccttcgtggccccccgcgtccga

SEQ ID NO: 593253 - DNA, 211 bp, Homo sapiens
aagtgatagctggcatccaagtgattcagacaaaagtgaaagtcaggaagtcaatagtacattcaattctccaaatgcatgcagcagagtgtggcaggaagggtacacaagtcagcagagtctgggttgtgctggttctcctattgactcgtgtgtgtgatgctaggtgggtgaatcttgggtttgaatctccatatgtaaaagtaactct

SEQ ID NO: 593254 - DNA, 1394 bp, Homo sapiens
  misc_feature (1238)..(1238): n is a, c, g, or t
  misc_feature (1370)..(1370): n is a, c, g, or t
gatgggttacagggtaactcaaccctggctgccatccttgggcactgtgtgtgtccaggcaccttggaggaccgtgcagcccccagaagcttccagctcccgcaccactcagtgaagcccagcctggcgcctgccctgcccccgtcacgggatgggcccccattggggttcaacattccatcgcagccaaaggcagtcggcacttgggacatctgcttccacggacaggtcacctccgctttgcacggaagaatctggatgcttacattaaactggtgttctgagagttcctacggacaggtcacctccgctttgcacggaagaatctggatgcttacattaaactggtgttctgagagttcctacggacaggtcacctccgctttgcacggaagaatctggatgcttacattaaactggtgttctgagagttcctacggacaggtcacctccgctttgcatggaagaatctggatgcttacattaaactggtgttctgagagttcctacggacaggtcacctctgctttccatagaagaatctggacgcttacattaaactgatgttctgagaattcctacaggcaggactgaaagcctggtgtgtgccagtatgatgttccacccacagaaacctggtcacaatcgtcccttccagcaccccatccagcagtgactgcacacactgagccccctaccagcccctttcaccctgctgactgtcactgggccctgggatgtgcaagactccacagcagcagaggtggggggacatatcacagcctctgcccccggctgtgatgccaccgaggggctcgcctgctgatggcttcaacagggtctcacctcatcttttcctgctctttggccctggatcgagaaaatttccatcagtgccccattaatatgctgccctgtggcatctgcccaggaggccctgccaggcgtgcacaggtgtgcattggtgtaccctggcatgcacaggtgtgcactgatgtgccctggcatccattggtgtaccctggtgtgcctgccataggaccctgggcgggagctcccatctcatctacatctcctgattcatgcgttgtttcataggtttcaatgtctctgtaaatgtggtagaaatgcaggctttatgggcataaagtgtacatttctaaataaatcccttctatttagtatgctcaccctagaagttactgttgtccagacgtagagggatgagtgagccagtnacctcagacgggatggtggggacggcaggtccagctcctgcctcctcctggggggtctggctttgggggcttgctccgaagaggccatggcccaggcctgtggctcacaatggggaccaaccagctcttctnatcttcttccctcacacttcctct

SEQ ID NO: 593255 - DNA, 702 bp, Homo sapiens
tagagactatagaaaacaaccaaatagaaattctagaattgggccaggcacagtggctcacacctgtaatcccggcactttcagaggctgaggcgggtggatcacatgaggtcaggagtttgtgaccggcctgatcgacatgatgaaaccccgtctctactaaaaatacaaaactagctgggtgtggtggcacatgcctgtaatctcagctacttgggaggccaaggcaggagaatcgcttgaactcaggaggcagtcgttgcagtgagctgagatcatgccactgcactccagcctgggcaacaagagcgagactccacctcggaaaaaaaaaaaaaaagaaaagaaagaatttctaaaatttgaaaaaacccaattttctaaattttaaaatttccctggattaaggttaataccccaaaggaggtgacgaggagtcaataaaagaacctatcttatctacctgtgagagagggaccaaacggatgggaaaaggccctatgagacaacttccagaaggagacgagagagagaggatgggccgaccaatttttgacagaaataactgaacatgccccaatttggtgaagacttcagttaccgactcacgggttaacacctgtaagctggccaattgtgaagaaaaccagtgcttaggccattattgtcaaattgctgaaggcaaaatttacacaaaacaaa

SEQ ID NO: 593256 - DNA, 144 bp, Homo sapiens
  misc_feature (28)..(28): n is a, c, g, or t
  misc_feature (67)..(67): n is a, c, g, or t
cagccacctttccctcccccctcaaagncccgacctccgcaggccaccttttccctcccccctcaanccccagtgttgtgggtggcagcacttgtttactggctgctttctggctcgaaataaaggaatcgtgcttgtgtaaaa

SEQ ID NO: 593257 - DNA, 325 bp, Homo sapiens
ggtcgacactgcattccagcctgggcaatagagtgagactccatctcaaaaagaaaaacaagaaaacccaaaaaaaccactaacaacaaaacccagcctttttgctgatatggagaaagctttagtgatctggagagaagatcaaagaagccgcagcacttccttaagccaaagcctaatccagagcaaggcccctcttcagttctctgaagcccaagagaggtgaggaagctgaagaagaaaagtttgaagctagcagaggttgacttacaaggtttgaggaaagaagccatctctctaacatcaaagtgcaaggggagtcgac

SEQ ID NO: 593258 - DNA, 349 bp, Homo sapiens
gattatgtttaatctttcattggaagccaaagtaattccacctagaaatgatgctatcagtcctggcatggtggctcaccctaataatcccagcactttgggaggctaaggcaggagaattgcttgagcccagcagtttgagaccagcctgggcaacatagagagctcctgtctttaaaaaaaatttttttaattagttggtcttgatagtgcatgcctgtagtcccaactacttgaaaggctgaggtggagagatcatttgagctcaggaggttgaggctgcagtgagctatgattgcgccactgcactcctgcctgagcgactgagcaagatcttgtctctgaagaa

SEQ ID NO: 593259 - DNA, 932 bp, Homo sapiens
  misc_feature (300)..(300): n is a, c, g, or t
ctgggactacaagcgtgcgccacacccccggctaatttttttgtattttcaatagagacaggttttcaccatgttgaccaggttggtcttgaactctcgacctcaggtgatctgcccacttcagcctcccaaagtgctgggattacaggcatgagccaccatgcctggcctgaagacatttgttttatttatttaccgtggttttagtggtcaagcgttaaccaccatgttcttcagaagagaattctgctgtaacatgtttttataagttactctgtactattcttcatgcaatggctntcttgatattggtcactattaaatcaccggtatattggacttgtgactgggtaacttttaaattcagctgtgtgactataataataccgtaaagatgaagaagtgcttgaggggaggtctgagtgaggcagttacaaaatatttaacgaacgttgggacatttggaggaaagttcccacgcagttcagtattatcattcaagaaaaaggttacctggtgcaaaaattagcctaatacattggtggactaagtgttcccggggatgctttcttaacgtggtgtgccccatttattacgggttcgtgcccactttaacatttatcccttaaggaatttaattctttaaacgtatcggtgtttaaccgcggaccagcaacttgcgggacaaattattggcccatttaactgtggccaaggcggtttgttgtccaaaaggaacccggcacccacaacatgctgcgcttgcaccagcaagaaaggaccaagaaaccccctcaagggggtggggacaattcttttgacaagttccttactcccgaaaaacccctttttttcacacatttctttgggcccctttagagtataccccggttggggcacacttatcttgaaatctgggggggtattatacc

SEQ ID NO: 593260 - DNA, 127 bp, Homo sapiens
gagggctccccctagaaagaaagaaagaagcagaggctgggtattaaatttaaattccacatgggatccaagaccatttcctttcagcaccagcacgaattcccttagcaccagcacgaattccctt

SEQ ID NO: 593261 - DNA, 649 bp, Homo sapiens
  misc_feature (395)..(395): n is a, c, g, or t
  misc_feature (445)..(446): n is a, c, g, or t
  misc_feature (464)..(464): n is a, c, g, or t
  misc_feature (575)..(576): n is a, c, g, or t
gcggggcaggaactcctgttcagatttctaaagactccgggagagatggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaaggctgggaggcctcccatccaggacactgggggcaggagtgtcatcttttgggcagggcaatcctggggctaaatgagggtacaggggaaatggactcttcccctaactgcaccncctgggaagaggaaagccaggcaccgataaagagcgacccagccccaccnncctggtaaaatggaattntaccaagatgaaagggaatgaagggtcccctcactagaagcctcaagattttccttcacactgttgaaatagggctagagagcaggaaatgtgagaaaaagtgtatagtgnncttctcagagcgagcactcgacagccctcaggtaacacataaaatcaataggatatgctgaaataaaaaaaaa

SEQ ID NO: 593262 - DNA, 168 bp, Homo sapiens
aggggagggtgaggccgaaaagggaagcccaaagcagattttaatgtttcaaaggagtgcagcccttcccagccatcaaatatgagggcactgttttgtttggtgttgtagccatttcaagaacaaatcaacagcaacaaaaaagaaagaataaatttttaaatttta

SEQ ID NO: 593263 - DNA, 157 bp, Homo sapiens
taatttatgatggtggtggttaatttcttactggtgcctaatttataaattaaaattcatcgtaggtatgtatgtacagggtggaacatctctaatccaaaaatccaaaattggaaccgttccaaaatccaaaacttatcgaagccgcggtgcctgg

SEQ ID NO: 593264 - DNA, 468 bp, Homo sapiens
agtgacagcaccagggatgccacacagccaggagcctgctgggctggggtcagccaggccacctgccatgcttgtggccactccagcctgtatccccacagacgctgaccgctgctctgtgcaggaccggcacagtgagagcacagcccggcctgcgcggggcaggcaccctccagagcctgggtgaaagtccggcacctccccatcagatcctcacttaggagacggccactgagagcccgtgattgcacaagccttgtaaaaaagagggaacgcattctaaagccacacgatccaggtgatccttccccacttagggtttttgttccagaggtatgaccagaaatgtgtgtgcatgtgtggccaactctcattcatgtcattttctagttctggaaaaaaattcactgtttaggaaaatatagaatattcaaaaacacattgaaaataaaatcaaatgccataaga

SEQ ID NO: 593265 - DNA, 1957 bp, Homo sapiens
  misc_feature (951)..(954): n is a, c, g, or t
  misc_feature (1534)..(1534): n is a, c, g, or t
cccgtatgcgatgttttgtggatggcaaagacttattcctgagggaatcgatataggggaacctcttactgattgtttaaaggatgttgatttgatcccgccttttaatcggatgctgctggaagtcacctttggcaagctgtacgcttgggctgttcagaacattcgaatgtttggtggatgccagtgccaaatttaaagagcttggtatccaagccggttccctgcaaaccatcaccaatgagaaccatcggaccgagcttgggaccatccgcaagcccacttcctcctggtgatgctcagcatgctcaccctgcagcacagcgcaaacaaccttgacctcctgctcaattccggcacgctggccctcgctcagacggcactgcgcctgattggccccagttgtgacagcgttgaggaagatatgaatgcttctgctcaaggtgcttctgccacagttttggaagaaacaaggaaggaaacggctcctgtgcagctccctgtttcagggccagaactggctgccatgatgaagattggaacaagggtcatgagaggtgtggactggaaatggggcgatcaggataggcctcctccaggcctaggccgagtgattggtgagctgggagaggacgggtggataagagtccagtgggacacaggcagcaccaactcctacaggatggggaaagaaggaaattacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctcacatcatgcagagtgaagccaccaagactttatgcggactgctgcaaatgctggtgtacagggagcaacaccnnnnctggtgcacgctggggtttgtgcagagactcgctctcacgctctaggtgtgcggcaccctcagctccctgcagtggatcacgctgctcatggaggtcgtggatgggcacgcacccttcactgccacctcgctgcagaggcagatcttagctgtgcatttgttgcaagcagtccttccgtcatgggacaagaccgaaagggcgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccatcactcagaggtgggtggccatctcccttccctgtgtcctggtgaagagccgtgtagtgccatcactcagaggtgggtggccgtctcccttctctgtaccctggtgaagagcggtgcagtgccgtcactcagaggtgggtggtcgcctcccttccctgtgtactggcgaagagccgcagagtgccccactcagaggtgggtggtcttttcccttccctgtgtcctggtgaagagcggngcagtgtcgtcactcagagatgagtgaccatctcccttccctgtgaccctggtgaagagtggtgcagcagcttctcccctggtttcctcctcagagtcaaaaaatgaggcggcgtagggtgtgcccgcaggcctcgctgactgccacccacagcagcacactggcggaggaggtggtggcactgctgcacacgctgcactaccctgactcagtggaatgggctcatcaacaagtacatcaactccccatgccgctccatcacccacagctttgcggaaggccttccaaagggcccagttagagactacttccctgattccgagaaccctgaagtggggggcctcatggcggtcctggctgtggttggaggcatcgatggtcgcctgtgcctgggcggccaagttgtgcacgatgaccccgccc

SEQ ID NO: 593266 - DNA, 577 bp, Homo sapiens
catgcagctagtgatggacacttagagttgattccatgccttagctatcgtgaatagtgtagcaataaacattcaagagcatgtgtcttggtttgtctaatgatttcttctaagtagatcaacagtagtgggattgctgaattaaataattccatttttagttctttgagacatctccacactgttttgcacagaggtagtactaatttacattcccaccaacagtgtttgtgttcccttttctctgcatacttgccaacacctgttttttttattttttaatagtagccattctaaatggtgtgagatgatgtcttatggtggttttagtttgtatttctttgatgattactaatgttgagcattttttcatgtttcttggctgcttgtatgtcctttatccactttgcaatggggttgtttttcttgttgagttccttgtagattctggatgttagtcctttgttggtggcataattggctaataatttctcacattctgtaaattgtcttttacctctgttggttatctcgttagtcgtgcagaagcattttcagttggatgacatctatttgt

SEQ ID NO: 593267 - DNA, 603 bp, Homo sapiens
cgatctagaggatcccgtctgagcaagttgggagtcagtggacgttgttctgaaatacgccccgggcaattttctgcaagtgaaccggagcagaggtcattttcttataaggctcagcctcagagatagaacacgggaggcaagaaattaataatttagtaacagtgaagctccaggggtgattacatcatgatgtaaaatcagaggttgatctgatggtgagcacggggtgctcagactggtatagagacgacgagacgacagaagtgcgggcactacagctttcctccccagctctaccggggaccagcaggggagacgggacggccaggacgaggaccaggcaacctgaggagagggctctgcagccagagaggggcctgaaggaccggtgggaccgaaagctagcagacgcactttagttgcttatagctcttccggctggaggaggcggtggtggttgtacttgattgtgtggaccctggcgcctccaccagagctgaggccacccccaatgggctctgccactgctggaactgaagccacctccaacgccacagaccattgccattaggagtaggtgctacctccaacccggcctaa

SEQ ID NO: 593268 - DNA, 544 bp, Homo sapiens
  misc_feature (50)..(50): n is a, c, g, or t
  misc_feature (150)..(150): n is a, c, g, or t
  misc_feature (164)..(164): n is a, c, g, or t
  misc_feature (218)..(218): n is a, c, g, or t
  misc_feature (285)..(285): n is a, c, g, or t
  misc_feature (351)..(351): n is a, c, g, or t
  misc_feature (363)..(363): n is a, c, g, or t
  misc_feature (384)..(384): n is a, c, g, or t
  misc_feature (441)..(441): n is a, c, g, or t
  misc_feature (459)..(459): n is a, c, g, or t
  misc_feature (473)..(473): n is a, c, g, or t
  misc_feature (478)..(478): n is a, c, g, or t
  misc_feature (484)..(484): n is a, c, g, or t
  misc_feature (491)..(491): n is a, c, g, or t
  misc_feature (510)..(510): n is a, c, g, or t
  misc_feature (513)..(513): n is a, c, g, or t
tcgtcattaaggcttactatcagtaagcggtatgactgttccaggtaggncagtggaacgggggtggggtggagtggggtagggtggggtcagggggaacgccatagagccgaaatcgcaaggtgggttgcgcgttggggcagccggatnttatccagttatancatacggtaaaatgggattaaagcagaaagtgtttcatatttgttgtttaatantaaatggtatcgggggccccggtattaaacggcgtcagggatgggcgagcgggccattcaaagcacngtttgaggcggggcagacaacccaggggcaaagtaaccggataaatgcggagcagggatttagggnagtcactttggncacggttaggtggattaatancgctgaagttttgggtatgaaaataaaagtccgtagtgccgaaacccatgaaaaagntggtaaaagtggaaattncatcagtgcgaagntttgnggttgngatcggnttggcccaaggtcggtttnggncggaccaaagtattttcaagtccaggaagag

SEQ ID NO: 593269 - DNA, 321 bp, Homo sapiens
ttccttgagtatcccccccttccaccagctggttaaaccagaatcacctcagaaatctacttctccttcatattattcataactgccagtgttacaattctaattgctggccatgcacggtggctcatgccagtaatcctagaactttgggaggctgcggcaggtggatcacgaggtcaggagatcgagaccatcctggctaacacggtgaaaccctgtctctactaaaaatacaaaaaaaattagccaggcgtggtggtgggtgcctgtagtcccagctactagggaggctggtggaagggagtggaagggaggctggtg

SEQ ID NO: 593270 - DNA, 1324 bp, Homo sapiens
cagagtttccagaattaggaaaataatcactgggggcagtttgaggttggtaccagatatgtgggaggaggcaaggtaagggaaagagtacttgaacgttggaactggtccttgcagggaaatgcacatttatgaaaccccgaaaactgatgtcaaagcacctcctgccttgggcagagtcctctcaaagtctacaggtgctgcctccagaaccctcttcctggagcgcatccctatgtatctagaaattctgctgggaaatatgatggtcagacccttggccacctgaaaggttcagggtggtagaagaacaaaggaaagccacaagggcagacaggggcaggtgccagcaatggaacggcaggcactgccaggtcaagacacccatggtgacgaagtgcaagatggaccgaggcgcaaggatatgctctaattcaccatggtttgctccctgctagggagccaagcagggactcattgtgcccaagggcccaaacggagccccactgcacacacgacatcttcctacattgggtgcattaatacttgcgagcataccaagcaaaccaagcgaacgaggacccagcggaagaccaaacacaatgggcaaactcaacaaggacacacaggagacatagggaccagggcacacacacacaagccgcacacataggagacaccataccaagccactacttgaataaccactatccatccccacataacgagaaacaaccatataatacacagaaaccacatgagctccacacaccctcttgaggacgcacagacacgcggaactcagtagcagcagagccaaccgaaaagagacactaaggcgcacaccacattgcaacagaacatacacgaacattagggcggaacagacaagacgacaacagaacaaaacacgaaaacggatctcactattgaacaactggctcaaaaaatggctcacacagcgccacagtcaactcaccccaccgcgacacgacacaactcaagcaacggtcacacactgtaaactggccacactcgcatgacgtaccagtcaggcgcttcctaacatttgcactcactaactactaaaaacacgcagacacaaaagaagacacctaagcacactcctatcaaataacgatacaccatgagaatcacctgcaacacacagattacaattacaatcattcatctttgctaaccataacccaacatactaccacatacaacacacatatggtcatacacaaaactcaccaacaaaactaaagcacaaaccgccatgtcatctatagtttttgtctctttagaaaacaaccaaaga

SEQ ID NO: 593271 - DNA, 296 bp, Homo sapiens
  misc_feature (72)..(72): n is a, c, g, or t
tgctgctccctcttcagactgggctagcagtatctacagagactaggtaaaattaactggtactactcaganctccccttctccctcccctcagacaacaaaaggctttgttctcttccaggtgagctttccatggaggagctattgcagcagtatgcaggagcctatgccccaggctctgggagcagtgaagatgaggatgaagatgaggttgatgctaatagctctggctgtgaaccagaggggcccgtggaagcggaagagcctcctcaggaggatagtagcagtcagtcagg

SEQ ID NO: 593272 - DNA, 507 bp, Homo sapiens
aggtccgctgaggcagtctgtccttgggactaacaaagtcatctgctgtttggggaaatctctggtgttgggaacaggcccccaaatctggccataaactggccccaaaactggccataaacaaaatctctgcagcactgtgacatgtttgtgatggccatgacccccaccctgaaggttgtgggtttactggaacgagggcgaggaacacctggcccacccagggcggaaaaccgcttaaaggggttcctgaaccacaaaccatagcataagtgatctgtgccttaacgacatgttcctgctgcagataactagccagacccatccctttatttcagcccatccctttatttcctgtaagaaatgtttttagttaatctataatctatagaaataatgcttatcactggcttgctgtcaataaatatgtgggtaaatctctgttcaaggctctcagctctgaaggccgtgagacccctgatttcccactccacaccctaaaaaaaa

SEQ ID NO: 593273 - DNA, 422 bp, Homo sapiens
tttgggtttgaattccagttctacttgggagctgtggggccctgagcaagtcattactctgttggtgcctctatttactcatttgcatagtgggaactaaaaacatctactttataggttattaggattaaattaagtatgttatcctaagaaatttttagcccagagcaagtactcaacaaataaaaggtattactattgttatgtgagttttgtttgtttttgagatagggtctcaccctgtcacctaagctggagtgcagtggcacgatcatggctcactgcagccttgatctcccaggctgaggtgatccccctacctcagcctccttagcagctaggactacaggcgtgcaccaccacacccggctaatttttgtattttttgtagacacaggtttcactgtaattcccaggctggt

SEQ ID NO: 593274 - DNA, 350 bp, Homo sapiens
gaataactctgtctgggagtctctgtcctgggtcatccctctctgaaggttaatccatagacagatgaatcaggtattgatccctgtatcttggaataatctagaggatctttgcgatatcattaggattcatagaaccaaagatccccttccaggatggtccttctcctgaaggttaatccataggcagatgaatcggatatagattacctgttcatggaataaatctagaggatctttagaatccatatgggattcataatacacagctatgccgatgccatcatcaccggactagccctttctgaaaacacagtcatacatctacacccattagaaatacgcgatgc

SEQ ID NO: 593275 - DNA, 780 bp, Homo sapiens
ggcctacagaggacgcggtccgctgcctaagcttcggggccgtccgtgggtgagcggggtcctggagtgctgcagcggggctgaagtgcgggctcagatgtggcgaactgcctgaacgatgccggcctaagcctggagtccaggcatggacttcccctacaactttcccgatccccttcggggcctccaggccatggacttgtgagcgggcccagggacacttcctctgatgcccttcggagagaccgtcagccccatgacagccagatgggacccgtagtgccaggaggccccggcagcctcagtcggatggaacttgatgagtcaagccttcaggagctggtgcagcagtttgaagctctgccaggcgatctggtgggcccatccccaggtggagccccctgtaccctacacattgccacaggccatggcctggcctcccaggagattgctgatgcccacgggctcctgtctgcccgaagctggccgggcatgacctggtgggccctctggccatggagagcacatgtgccgggtttcccaacagtggcccgtgaagagcctctacgagcctgccccgcgactgcggccgccccctgaggacccagactgaggatactgactccccagactgggctggacggcggccgccgcccgaggcacgacgagccagcaggacgcgccagcagacccacggacccccggggctggagaccgcccctctagccagcccgcgccaagccacccgcgccgcccccacccaccaacccggcaaccacg

SEQ ID NO: 593276 - DNA, 447 bp, Homo sapiens
  misc_feature (16)..(16): n is a, c, g, or t
ccaacccgatgcgtantaattttgtatttcagtagagatggggttcaccatgttggccatgctagtctctaactcctaacctcaagtgatctgccacatcggctccaaaagttctgggattatagtgtgagccactgcgcccgggcatgggatccttaaatctggatccaaaattattgttacatccagaattgtgatgaatcaaaatctcgagatggggggtcagcaatctgaaatttcagtatgccaggcctttttctgtatgtcacagtggggttgacatagttaatttttcttctagtctgaaatgtatcgggacaatttggaaatcctgacggctggaaattgaaataagttttactaggatttgggtctcttgctattaggaaaactggtggtgaccaattcatgtttacccattaagatccctcatgggttaccgagctc

SEQ ID NO: 593277 - DNA, 237 bp, Homo sapiens
  misc_feature (7)..(7): n is a, c, g, or t
gcgtggncagtacagttgcatgagctgagatcatgccactgtattccagcccgggagacagagcgacagactttctcctcccgggccaccgggaggggctgccatgaaggtctctgatgtggcctggagacattttccccatggtcttggagattaacattaggctccttgctacttatgcaaatttctacagccggtttgattttctccccagaaaatgggtttttcttttctttt

SEQ ID NO: 593278 - DNA, 824 bp, Homo sapiens
tctggccttggcccctggtctaaggttgcacaatggaaaagggttcgccaatcgcaaaattgttcgcccggacgaacattagggcctctgggtggatatctctagggagaattttttacgcatcctgttcctggataatcgctctgtcttccatcctcctaaggggtttcgacgcagtacattagctctcgggtaggcgcctcctttgtgtgcccccagccccctgtgtgtgtgccccggtcgacatagtttctttattgattcccccccggggtactagctccccgtgatgagtcttcctccacgctacgacctctggattggctgtgtcgttcgcctccacatgtactgtgttataatccgcgcttctcgtcaagggcaattctggaataggttaatactcccccggaatggtgcgtgttgtaggtgagtagtctctctgcgagccacgcttttaagccttcagtcgtactactcccctcctccgggtcttttactcctcctctgcgaggagaccgactacctagtagtgctaccccccgttctctggagtcgcaaatcgtctttcctgctactatgcgcagatccagcacaatatttgctcaacccgcttaatccctcttagcactatttatccccacaccaccctactgagtggtccaccctcactccctcccccctgcagcttctaccgacaataacctccgcggatgcaaaccgaggtatcaccccgtcacttgcttagtacctcctatgcccccgattattgcttccactgttcccccaaccccaattaaccccgggtctttccctccaacaaaaca

SEQ ID NO: 593279 - DNA, 219 bp, Homo sapiens
tcacttaacatgatgtattgagagatccatatgcagcatgtatcactccattcgttttgtgatctaataatattccattatatggatttactgcatttagtttatccattcaccagccgagaggcttttccattgtttccacttttgggctgtgataaataaagctgctatgaacatctgtgtacaagccttggactggacatatatttctctttctct

SEQ ID NO: 593280 - DNA, 1269 bp, Homo sapiens
  misc_feature (752)..(752): n is a, c, g, or t
  misc_feature (1032)..(1032): n is a, c, g, or t
cccacgctgtcgcgcgacgcgtgggtctgatccagcgcgtccgtttctatactccatgaaccacgcagagcagattatcttgaagcagcaatcttcaagagacagttatccagattcatatgtgttgaagaggaagagaggacgatcttcttctttctctcttaactggtcaagacggccaatactattgatgcaagcctgtaagagaactagagcgtgacacgtcgatgattcgggcccctgcagagttggtgacattcacacaatctttccattgtattctacacgttccactctcacgcagtcatgtaactgacttcttgtgacgcctccaagccttctccgatagagaaaagcaggagatggaggcaactttgggacaggaacaggtcatgatcgcgttgctccaatctaaccagtaagccatgaagtaccgctctctctgtaagcaatatgactgggtgatgcgtagatccagtcgttctgactccatggcacttattgcaggagtactacgtacacgtgcttcttacatatatcccgtcgaaaattcaaggaggtctagacgatcccctatatttgggtcgaactaagtcataatatacgtcactaggcctattcaaggcctcaagtcacacagggagcttcgcgcttcatcacgtcctgggcatcggattacccgagaccctctggtcaacaaaggtggctttccccagtaacgttttcatcccaccaagtcatgtcatacacgnccatgttaattcgtaagaaccagcacattgagtggccgatcgccgttacatacacgctcgttatattcgccgtggaagaaagtttcaagcccgtctatacgctaacccctatccacgtgtacactcccggaatcgccctgcgttccaccggaacaggggaagaggaagaaaacacgcctggagtttcacttgatgtagttcaacagtgtgggcgataactacaccctttgcacacgactttttcaagtggggcgacttcccaatggccaaaagcgtgttnaccttgtataaactcttacttcgcatttacacgaaagggctctggggagaaacttatattcgtacctctaagcccttggggcaagcctcttagactaattgcactggactcggggacgaaatccaagaccgtgagaagtcgattgagaaataccaagtggaatggggacacgaaggtttaccagacgttaacaattcacagcagattcctgcacacaagaaatagggctaatttcgg

SEQ ID NO: 593281 - DNA, 1079 bp, Homo sapiens
ctacttaaaaaaaaaaaaaataaataaaaaagggccgggtgtggcggtgggcacctgttgtcccaagatactcaggaaggctagaggaaggagaatgggttgagaatcatggggaggctagatgatttgctagtggaagccgagattgggcgccagtggaatttccgtggctgggtgcgacatgagtgagactggtggtctgcactagaaaaaacaaaagagaagaagaaataagcggggttacttaatcctcacaatagtgaaggaggcattattaattgtgggttgagccaataacagataaatatgaggcgtgagacacaaacatactacaatttgcctacaggtcctaattttatgacgagggaatatatattcataattagggggggatattggggggggtgaagaattatcacaaatattataaagggtttttttagaactattaacaccatatacagaaccgtgttgggggcatgatgatttaatagaggtttttcaagtaaacactctaacgtagatttaaagtaaaggccatatatataaattccacagaggggggcaacttaaagacaattgttaacaccataaaggggggtgtttatacatgtgagataatattgcgtgtgtacaccacacacaacaaagagggcaccatcctttatcatacatatatgtgggcagacatataaaccggtggggtctatatctcattatgggggagaaagaattatcaattatcacaaagggttgggagggaatatatgtagagaaggtacacagactatctaatctcttgttcgggggggcagaccataatagaaaggttgagattatcgctgacgatctataaattaaacaacaaaaggcgctcctataatgtgtgttaaacaagctggtgtcgacagacggggagggatttcaacttaccaagcgagcgtggtggcaccacacggttggtgtgtgcggccacaaatttataagacggacgcgtggtttcatattaaatacaccaccgggggggggacgtacataaagtcccgtaggtgcgaaaacgaaacacacaacaactatgg

SEQ ID NO: 593282 - DNA, 434 bp, Homo sapiens
ggaaatgtcaaggaaaaacaaaacaaaacaaaacaagttcctcagctcaacaattagaaagcaaacaatctaattcgaaaatgaacaaaagacatgacgagacatttcacttcagaggatatacagatgacaaattcatgaaaagatgttaaactagccatcaaggaagtgcgaattaagacctcaatgagatgttttcactacacatctattaaaacagctaaacagtaaaacatagtgacaactccaaattttggtgagaatgtggagaaacgagatctctcatacattgatgttgagattgtaaagtgatatcactactctggaagataatttggcagtttcttttaaaactaaacatacacttaaaccatatgactcagcagttttatgcctgaccacttatcccagagagatgacgacttacttccaca

SEQ ID NO: 593283 - DNA, 656 bp, Homo sapiens
tcctgtctgtgcatttggaagcagatttgagcctgacctctgtgtgcgtgtgtgtctgtgtgtgtgtgagtgcatgcctgtgtgtgtgtctgtgtgtatatatatatatatatatatatatacacacacacacacacacacacacaaatatactatggacaagaagagaagcatcatagagcagttacagtacgcccgtcgctatagaaccacctaacccacggcgcggatgatgtaatgaccccaatatgtccactgcttgtagtataatgtggaaataataatcacggtggtatactggtactactcatattatactgaatatatgacacagacataaaccaacaaaagaaaatgaagacacatgtctgaagaagaataacccgtagaaaaacatgctaaggagagcaacaagacagacgctgaacgggaaacaataggagtatgaccacataaaaataatgcgagtcacctagagtatacccaacaacggggaacaaaaagaacagagagcacgaggggcaccaaaggcggtgagcgtgagagcgcatgtgcagcgaaaactaccagcacctgagaacagagcccgcggaagagtcgacaaatcgagcgagacgagagagacgagaccgagtcacaacacaaggaaaccaata

SEQ ID NO: 593284 - DNA, 903 bp, Homo sapiens
ggtgctgcgctggtgtgtggctcccgtcgtctggccaagtctcagcgcagctgcacctggccggtgtctcgttggcctggagcccacacccaccgggtccctgacccctgtgccccccgccgccctggttccctggcatgcctcgctgccctgtaatgggcaacacgctccgtgaagggtgtgtcatgctgccgtgtgaggaaggtgcccggagcagtgcccaagctgactctgggttccagtgacgatgaggcagcagtgaggccccgagcaccgcaagtgaatgccccagcttctcagcaccactgcagagtgacagcttgggggggatgtcgtggatgagcagtggccaagcaggaagaccttgaggaaaagctgaagtgagtattgtgcgacttgtctcacagacaagagtgccaagacccggcagggtgctcttgagagcctgcgcctggccctagctgtcccgctactccccgattcttgctggagctgccgctcacgctagccgatgccctggaaaagtgcctcatgaaacgggaatggcgaggaacaagccctggtgatgctgtgctaggcctgctctgcgtgcagctgggccctggacctaagcggtgaggacgcttgttatcaccagccttgcagcctctgcttggtcttctgtgctcagttgacaagcacatgtagccctgaatgcccggttcacttgtgcttctggcctttggccctgtggtgtacgtggctgccgttgacatcaggaacctggtctcttgcttgctgcttagaagtgttcacgccgggctatgtagttgcggggccgccccagtcctggggtcttcgacgctcgccggctgtctccagccctgacgccggcttttgtccctgcccaccaatagccactta

SEQ ID NO: 593285 - DNA, 298 bp, Homo sapiens
aagggtcccaggtcgggagagcccaagttgagaacaataatgaacaattatgtatgaacaatgttagagacagctaatcacaaagaagcctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 593286 - DNA, 359 bp, Homo sapiens
ctagagcatccccccccttcccggttactgacacccactaatcaactttttttgactatggatttgcctgtttgggacattccatggaaaagggagccatgcattatgttgcctttaatgactggcttctttcagccagcaaaaggttttcaaagttcatccgggatacagtattggttaatactgtattccttagacaaataatattccataatatggtaataccatagtttattggtttactgagggacattggaggggtttctgcttttaagcttttggaacagttatctacaagttttttggaagacatacattttcattcctttgggatttatacctaggagttggaatggtgg

SEQ ID NO: 593287 - DNA, 190 bp, Homo sapiens
ctctacaggatcccctgccatttactccatggcgaggctgaagcagaaggacagctctggctggaggtccgtagctggtccttgcaggtgccaactcgaggtcgtgcgaactgggtataaggggcgaagatgattaatcgaaccatctatgtagctggttccctccggaagtttctctcgaggatagctg

SEQ ID NO: 593288 - DNA, 278 bp, Homo sapiens
atgagcccaaagctgcccacgagtaccatcctggcagcaaacctcccctacccacttcagggccctgcccaggtcccacccctacagcagctcccaaccaagctccagcctcagccccagccactagcctaaattacagtcccagtccctgtcccagggatcagaacctacacaacagatcctggagtagtcaggtcttaatgagtccaatcatactggccgcatcagtctgaattccatctgcttccatcctatagaattgatcttctgacgacacc

SEQ ID NO: 593289 - DNA, 278 bp, Homo sapiens
  misc_feature (135)..(135): n is a, c, g, or t
aacagcaagcatgggctgttacccaaaagctccagatccatgaccctctgacttaaatggtggtagcactggctgctccctaggtctccagttccatgaccctcaaactacacagcaccggctcttccccaggtntactgcttcaccaccctcacactagacaccaacactacctcctccccgctctccagctacacgaccctcagacttgaacagcagcagtggctcctccctagatttccagctccatgaccctctacctgcacgacaacacataa

SEQ ID NO: 593290 - DNA, 321 bp, Homo sapiens
  misc_feature (302)..(302): n is a, c, g, or t
acgaccactatcagatgaaccactatcacggaaaaagactcataccctcgtctagtactaatctccctacaaatctccttaattataacgttcacggacacagaactaactcatattttatatcttcttcgaaaccacacttatccccaccttgggatatcatcgacccgatgaggcaaacagacgatgaacgcctgtaacgcacgctcattcttcctagttctactccctaataggctcccttcccctatgtcatcgtactaatttacagtcacaacaccctatgctcactaaacattctngtacgtcactcccactgcc

SEQ ID NO: 593291 - DNA, 1106 bp, Homo sapiens
ggagagaactagtttcgagttttctttttttatctttggtgagtaaaatcttcataacctaaatgctgggagggacccaaaaaagccaaattgtgagcccttggtttgcgtcaattgtgaaagttggctcagggttctctagcacagaatacccatagcaaaggtttgagaacagactctgtagccgttcgcacttagtatatgtgttcttaaactgattctaaaagtcgtattctttgcctcctgacgatggtctacagaacccgtggtctgggcctccgggacataaatctcgtaggcttgtctgcgctctcggtgggctgagtactagccgccaccagaatgctgcccgtttggccgccaggagtctcttgcgggccctcctggtcgcggcttgtcgctgggggtcttagaggccttgtcgcgggctccactgccgcggttgagtatttggcgctaaggctacacttaggggacctcggagcgcggtgtgtgtttcttactacttgccttacctctatctccgggggtctaccaccagtttgccaggctgtggaggccttgaggtgggaaagagttccatgcgaacttcatgctagatatccgtcagataggaccagcttgttagcgaggtccccagtaacccttgccagggtccttggagcatgtagaggggcagtggagttgggcaatccagggttatcaaagttagtgctcaacaagaagcgccccgggaaaagtgcgtggaatatcttgtggacaaatcgaggtaagcagtgtgggcaactgggagcccagacagacagttggagggaacttttgcgcctaaaaacctcttgattcaaagaaaagaagggattaggattaccatccataggtgggtcctcccgatatggtacccaattctgtgggcagacacccacaaggctatccaccagccgcgcgataccgggagacagcatggccactgacaaagaaaggcattgtaagggacaaccaaaataaacgcgcgaactcgaggagggagagaggcccatgatagtaatgtaaccccgcgactcttgcagagggaggaaccttataaggaagaggtaatacgcagcccg

SEQ ID NO: 593292 - DNA, 439 bp, Homo sapiens
tagtgacctagagttaccggggagcttggtactataccgttgcttagcgacacgcgagctatatctgcgcgtggagctgagtgacgtacagaaccctgcatcagcatacactgaaaacgtgctgcatttcaaagctcaaggacatggtgccaaagaagacaatgtctattaatttcacctggagttcttagaccttgtgacaccagagcctgtttacaccctgacccagaggccaggtacaacattacagtacagacgaacgtgagtcagtggtgggagagcactcacaaagcaggaaaagcgaccactgttttaggctcctgcactttgatcgttggctggatgaatctgatgcggcaatggagctcagagctaaggacgacgagcgcctaaatcaaatccgacaggaaagcgaaggctctcctgaaactcttacaaa

SEQ ID NO: 593293 - DNA, 662 bp, Homo sapiens
tgaggtggctcacgcctgtaatcctagcactttaggaggccgaggcgggtggatcacaaggtcaggagtccgagacaagcctggtaatacggtgaaaccttctctactaaaaatacagaaattagccgggcgtggtggcgggcgcctatagttccagctactcgggaggctaaggcaggagaatcgcctgaacccaggaggtggaggctgcagtcagttgagatggagccaccgactccagcctgggcgacagagcgagactcgatctcaaaaacaaaaaaaaaaaaaaaaggattaacggtggaacccggtcccccttattttagagacagggtctggctacgtggcccaggctggcctgtgaactcgaggcctcaagtgatcctccgtgtctcagcctcggaaatgctgggatcacagtgtgtgaggccgagggggggtgatcacctgaggtcaagagttggagacaggctgggcaatatggtgaaacccggtctctattaaaaatacatacattagccaggcatggagcggggacctggtaatcccagtactgtgagaggctgaggcaggagaatcgttgaaccggggagggtggaggttgaagtgaagcgagatcgagccatgattctcaggctggttgaaagagcagattgttccag

SEQ ID NO: 593294 - DNA, 793 bp, Homo sapiens
gcagggagcagagacagagccgctgctctgtgtcgtgtatgctgtggctgcagggagaggagcagtgacactgcacctttccagagtgcctctgtgtcccgcactgtgtgtgagtggacctgcagcgcgcagccacatgccctggctgccatgggccagaccgcctccacctcccccgcccgcctggcctgtcctgagtgcatttccctgcactgtgtctgtcacttgcacagccagtcaccgccgtgtctcagtcatctggctgctggatggctatgcttgggtgtcccagggtggccgcagcagtcagggtcactgtggggagccctggggtggatggtgacaaaccgcattgtcctgtgccccgccatggcagaagctgcagcctttgtatggaggcccaacctgcgctcccgtctggagaagccggcttcccggggtgtggctgccgggtcggctctggtccacagcacggtgcctggggctgcaggtttgttgagggctgtgactccgtgggggctcagtcaggctccagcagggtcagacgtgctgttaagagcaaaggccacaggacgatgacttgtccattctcacgtggatgctccagtgctgtgcctacacagcagtgctggttgacattgtccaagtgttcccagggcccggtggactgggagctgctatctccccacatggatggggctgatctggcccttgggtgaggcttgctatgaggggcttgtgacctcttcccccaggacctcccagcgaacaaaagcacgagaggaatcggaca

SEQ ID NO: 593295 - DNA, 924 bp, Homo sapiens
agcggggtggcgcggaggggagggggcgggggcctacggggacccaagcgactgaggggaaatggcctggccgagatcgggccggagcccaggcctggcgcggtggagcccggcatgaacgagtccgagtcatggatataaacaatgaagctggttcatgaaggcgaaactggccgagcaggcaatgatgcgatatgatgacatgtgcatgccattgcgatgaaggtctgtaagcatgaacaaggagctagacattgatccgatggaggaggaggaagtcttctctcagtgttgacttactacaaatactgtgttgataaggatgtcaccggtaggatcaatcatgtggatgggtacgtctcaatgtaattgaacagagagacgaccggaagtgtggcttgatgataagacacacagcgaagagtgggctcgaagaagtagccgaggacgaagaatttgacgacggagtcgtaaatgatgactagtctgacaagtgactgatagcgtgtcatcatgttctggaacaagcttctttgatggccaaattgcgttcacaatgcagagaagcaataggtcttctattttgaccatggtgaacagggaggattatctaccgtatacttaggggtgaaggttgcacaggtgggtggatgacaggagaaaggagactggtgcggactcgagtcacaaggaagcaatgaccatatgaaaggcgttgggaaaagtcgacgcaagagaagggaaattgcagcacaaggaggattcctatctagactgtggtctggcgcccttaagccttgctctgtgttctattcatgacgaattctgaactgcccaggacaaaggccttgctctctttgcacaagagcacgttttgagtgcaagccatttggctgcaccttgcaatacattaacgttgaatga

SEQ ID NO: 593296 - DNA, 752 bp, Homo sapiens
ggcacatacagtataaaacctcatcacctaccataatcataccaaattcctctaatcaactgcatactaagtgctcccaatacaattttcaccgtataaaaatactgggaaaaaattgataaataacaggtaagagaaagatatatctaggcaattactaggatcatttggaacaagtgagtactgtggatatttaaaatatcacagtaacaagatcatgcttgtacctacagtatatgcgggccagacacttaagtgaaagcagaagtgtcagggtgactttcctacttaaaatcacaggtcatatcatttcaaaacatttgcatcttggttggctgcatatagctttcctatggatcccaaaccaaatcttagaatcacttcatttaaaatactgagcggtattgaatacttcgaagcagaacaggcaatgtgcagccctcatttatgggaaaaccctcaggaaactcccagggtgatgcttggagaagctgtgagttgagctgaagctggagaacttcctccagagccaagggcttaagacagaacgacgaactctaagctgggtctgctaacatcactccagtcaagatggatcttggcagagagactgcttgtccttaacaatggaccgggggtctctaaagcgaccgcagcctgcagctggactggcgtcgttaacacatcgtgctgaacctccgcaccacacacacaccaaccccccacgccccgcacaccccccacaacccaca

SEQ ID NO: 593297 - DNA, 124 bp, Homo sapiens
ctctcctacttacagtgactcaacatactagttctacagccctatactcccgtctacattttaccacgaagcacaaggaggctcactcacccaccacattgacaacataaaaccctcattcaca

SEQ ID NO: 593298 - DNA, 254 bp, Homo sapiens
  misc_feature (16)..(16): n is a, c, g, or t
  misc_feature (56)..(56): n is a, c, g, or t
  misc_feature (73)..(73): n is a, c, g, or t
  misc_feature (84)..(84): n is a, c, g, or t
  misc_feature (87)..(87): n is a, c, g, or t
  misc_feature (101)..(101): n is a, c, g, or t
  misc_feature (130)..(130): n is a, c, g, or t
acaggcccctgggaancacccggttttggggggtgggaaaaaaaggggaggggttngggcaaagggaattgtncagtccccagnccnccccggttccgggntaaaggcaataaataaacccgttcctgcngggcccacccgggcccggccctcgggccccgtccccgggctgacgggggagggaggggaaaagcgggcgcagtttttgggtataaatcagttttggagcaaacccagcccggttgtgaaaagca

SEQ ID NO: 593299 - DNA, 451 bp, Homo sapiens
catacccacactgagttttctgtttgggggtcatgactagtactgttttattgttttgatgccatatggccatggaacctgtgggacatgccatgactccttatttgataagtcacttttgtaggtgtccaagtgtttcacagactatttcaaaagtcactgacataacggctgggtgtggtggctcacacctgtaatctcagcactttgggagtccaaggcaggtggatcactggaggtcaggagtttgagaccagcctggccaacatggtgaaaccccatgcactaaaaatacaaaaattaaacagatgtggtggcgcacacctgtagtcctagctactagggaggccaaggcaggagaatcacttgaacctgggaggcagaggttgcagtgagccaagattgtgccactgcactccagcctgggtgacagagctagactccttctcaa

SEQ ID NO: 593300 - DNA, 973 bp, Homo sapiens
gccggagcctggtgcgcgggggccgggggtggtgaccctcctggcgaggaggggcggggtcagacgcccgctcgggggccgcttcccccccacgcctgccccgggcacgcgccctgccggtccctcgccccggccattccagtccgagagagatgccctccagtttctgctttctctgcagctctagattgccagatgcgactgtgcgcctcgctgggctgatcagctgaccgaagaacagatcgctgaattcaaggaagccttctccctatttgatcaagatggcgatggcaccatcaccaacaaaggaacttggaactgtcatgaggtcactgagtcagaacccaacagaagctgacattgcaggatcatgatcactgacgtggatgctgatggtcatggcaccattgacttccgcgaatttctgactatgatggctagaagaatgacaagatacaggatagtgaagaagaacatccgtgaggcattccgagtctatgagcaagggatgtgaagggttatatcagcgcaagagaaatcagtcagtacatgacaaatcaggagaaacagctcacagatgaagacgtagataaaatgataagagacgcagatattgatagacacagaaaaaataaaaatgagaaatcgtaccaggcttaatgaacggcaaaaacgcacgcacataacatcgacagtctctgtcccccgctctacgacagccgctcaatcgactctccgtaacttcaccatgggcaggacacaacacaggcacaaggaccacttatacacagtgacaatctcacagcgctacgtcaaatcacttcagtcaacacacccctgaagctggtgggggcagccctaagacagcacgatcgcacagagacagacaccagtaagccctaggccgagcgtcaacgtgggccattcgccgcaggcagcggttaaacgcatccaaaacgctgtgacaagcacc

SEQ ID NO: 593301 - DNA, 158 bp, Homo sapiens
aacgtatttggtagggagtcacaatatagtcggctgtctaatgtagtttgcacctgttctgtcttttttatcttctgcactggacttataaatagccttagttataacaccttcaagttcttttaccagcttcgtaaactcatgatcaaatatcatgt

SEQ ID NO: 593302 - DNA, 718 bp, Homo sapiens
aattacttgaacccaggagatggagggtgcagtgcactgagatgtgccactacactccagcctgggagacagagtgggattctatctcaaaaaaaaaaaaaaaaaaaaattaaaaaaaatcaaccctaaggttcattgggaatctccccttaataccaaaacaatcctggaaaaaaggttcaaaaactcacgcttccggatttcaaactgggggctataaaattaccatcatgcgaaaccaccatgggtatctggtgtaggggacagacatacagaacacagatcctagaaagaagatggctggcttatgtgggtcaaatagatttatggaaaccagtgcaatgatcattaacaagggacgaacagggatgggtcttaaaaagatattgtaggtgggggaaaaatggggtatctacgtttcctaagaataattgttgtgacccttcaccttatataccaaaaatataatttgggaggtcaaaggatctaaattaaaaggccaaaaacaaataagaaagacttaacgacagaacaatatgggaagaaattttaatggactgtggagattacacaacacattggtgggaatatgaaactctaaaggcaagaggcaccacaaaaatataacggacttactggaaattgaaaacattttgtggcaccaaaagaagataaggaggaaagattggcatcaagttttgaagagtataccaaatat

SEQ ID NO: 593303 - DNA, 131 bp, Homo sapiens
gcatggtccgcgagcaaattaggatagttgagaaagctgcctatcggctggcgggagaggcttaggcagaatgccctattactttgcaaggggccctgtcagacatgtcgcatggggctcagagaggctct

SEQ ID NO: 593304 - DNA, 106 bp, Homo sapiens
ctggtaccaatttagagccatggtagaaaaacaagaaagtgaaacagtgataaagaggaggaacctgttttcactttcttgtttttctaccatgggctctaaatta

SEQ ID NO: 593305 - DNA, 202 bp, Homo sapiens
cagactatctaagaaggcaaccgagtatggacaaaagatcatcgctgacttgaacaagttgaccctggatttggtggctaatggtaatttaaacagcaaagcattttcaaagtttagcgctcattcgtccgatcaagccaaactacttcgtgttttaacggcattggattacatgtttgagcataaagacaaagaccagtcg

SEQ ID NO: 593306 - DNA, 330 bp, Homo sapiens
cgaatgcacaggaagatacgatggaaacacacctagagactgagctggacctgagcacaatcacaacagctggccgaatcagtgaccataaacagcagctagcttaactgagatcattggtagccagggtttgctaccaaactttgtaacctcaaggacaaaatgaggaagatgtgttttgttttgtttagagtccacaatgaacacatcttcctcatttttggactctaaaaaaaaacaaaacacaaaatcccctgttcaaataaacaaaaaatccaagattgattcatgaaataaagaagacatgaattgttacaaacaaaaaaataa

SEQ ID NO: 593307 - DNA, 433 bp, Homo sapiens
  misc_feature (151)..(151): n is a, c, g, or t
agcagtgagaggtgagcatacgtgtctgcacgagctctctggacccatggtgaggtcatgctcgcatcatgggtacatctatgatggtggctggaaccagaagggaaaaaaaggaaggtcgagaagtggtatgccctttttctctttctgncacaccaaaaagagagaggggactgaggaaagccttgtctcccctttttctagataggtaacaaaccgtctacagtttgcattcccctctagtgcattctgaaacactggaacctctttaaccctgaaactctaaagaaaaaatggcttatattctgtcgcacaaacccatggacatcttagagacaggaggcctggctttctaagggaagtattaattccatcactacccaacaaatagatctttctttgccctgtgagacaacccagatctttgtaagca

SEQ ID NO: 593308 - DNA, 143 bp, Homo sapiens
gagctggacaaaacttcatccccgaccagcacatactagggagttaacttgcaagcttagctgggggtcatagattctgtacagactaatcttatgtcgttccatgacaattgtaccgatggaaatcgcacgcttgacagtgt

SEQ ID NO: 593309 - DNA, 800 bp, Homo sapiens
atgggcggctctgaagagttgggctgtcgcccagcgtgacttcattcttcaggttcctgcttggctctagtgtgagttaacatgtgcctgacaatggtaagttcctaatgagtcctgatatatcaggattttggacggctcgtgcctatattgaaagtactgatctctcgtatctatccagtgaatcggagcctcatacccttagctagatgaatgcctgagaatgaggaagagactgctgtctttggataaccataagagacaccatcctaaacctatacctgcttcatcagatgcacaatactgcggttagatgagacagctattgagctgaagtaatacttaagggctcgttgtcatacgcctttaaactgtctctttaccccgatcccattagtacacagatgtgcttggggggcatagcatcgtagattcaggagggagcgtaatgcactgcaaagtggtcggcgacgggtgaatcattacgcgatgctcagcatgttctcgttaccacttgactattcaatagactagcaagcaggtacttgaagactggggataatccactttggaatggatcctgcagtttcgcgctctgttgcaggatgatgggacgcatgtacaggctgccttattcagacgtggtctgcgggattcaggcctcttataagcgactagggggatcgactttttcagggtgggtgacagctcgcggtggcaaggggtgcaaccaggttcccggatagcgaaaaccagtgtggagccgcaccctcgaagaggtcgtttggaccgggcccccg

SEQ ID NO: 593310 - DNA, 207 bp, Homo sapiens
gcggacatcagtagttaggacagaccgagtcatagtcatgctctgcggacctccgatgaatctggagggggctgtgggaacgctgctttgatctcctcgtcggcggacgtccttgctgagggtggtcatgtcgtctcttctcggggatgatgttgtcgacgggctggtcctccccgctagtgatgaacagggtgaggggtaccggtg

SEQ ID NO: 593311 - DNA, 589 bp, Homo sapiens
  misc_feature (414)..(414): n is a, c, g, or t
  misc_feature (457)..(457): n is a, c, g, or t
gttcacgcccacaggactgctgtgggtgtcgccatatctgctggcttcctggccctgaagatctgcatgatcaggaggcacttatttgacgacgactcttccgacctgaaaagcacgcctgggggcctcagtggtgagggatgtggtgctcgggcctggctctgccccacccagcgaggcaccgagggccactctgtgatgctggctacagcaagaatgaacccacaagcgcagagcccaacaggctgtaaaggaaggcagtgacctctgcatgtttctgtctctctcactaaccctttgcctctgtttctctttcttctgtctctatctctctctgtctctctatttgtgttcctttttctgtctccctttccatgtctctgtctttctgtgtctctttccctctgtactttncctttcagttgctcttggcagtcctgagaatcacatttcctgnagaaaaggtgggagaggaactaaaattggcttcacacagaaatttctgttctctcatccaaatgatgagatcaaataaacccagtcccagtaggcagcgaggttagtcctgtgggcgtgacggtaccggcca

SEQ ID NO: 593312 - DNA, 95 bp, Homo sapiens
accgagggtcctcaaagtaggagggaacgaagtcaccgaactctccacgggcagctcggggcacgactccagcctcttcgaagacaaaaacgatc

SEQ ID NO: 593313 - DNA, 292 bp, Homo sapiens
atgataatcacaggtgctctccctgtgatcgtgtccaattaatctcccaaaactcaatcccttacaaaacaacaactcctttccttcctaggcatggtgagtgcggtcagaattcttacacaagagccaggaccacaccctgtagcctttctgtccaaataacttaaccttactgttttagcctagccctcatgtctgcgtgcagtggctgctgctgctttaatacttttagaggccctaaaaatcacaaactatgctcatggataggaagaatcaatatcgtgaaaatggc

SEQ ID NO: 593314 - DNA, 217 bp, Homo sapiens
  misc_feature (135)..(135): n is a, c, g, or t
taggtgcctgctctaaggcgtggaccctcgccacagccctggccgtcttgacgcaagggtgtactgtacttgtcccaaccatacagatgagaaagctgagactcagggccagcaacccgggtcccagcggagctncggcacacgccgacacttcagcaccagtggcggtggcacaactgtgcgcggagatggctgcgacgcgtgcgcaggtaaagtc

SEQ ID NO: 593315 - DNA, 626 bp, Homo sapiens
cagagactctcgcagtccacggcaggtgtcggagtgggcctcattccagagttgtggtggccgctccacctggcgagcttcgaggggactccggcaggcgctcgctgtggggtcctcccaccagtcttctcagcacaggaacggtgccttcacattggtcttccggggcttaaaagcatatcattcctgattctgcagctggttctctctccaagcactagcaaaaccctccctaggagcccccagactctgagagcccatgaccaaaaagaaaaggaaagccaagttggggaagaacaggggcccccaactccacagccctccactctgcccagagggcccaccctgggctgcctggaaccccctaaagttgccacccccgcaacacagtagtggggcagttcctggcagcgcctgcagcccatgggctggctctgtacccgcagccccgccaagcgtctgttatcttatttactggaatctgcacagccaggctctagctcaccggtgactaaggagctgcagccattattaccaggcagatggcagactccctaaaagcagacattaaacaataaaatgccaccacataccttgcccacaaaataaaatcaaaacaaacacct

SEQ ID NO: 593316 - DNA, 552 bp, Homo sapiens
aaagcaagaacgtcttcatctaaggttgaaaacatcagttgtttgggttgtgagaaaagaaaagcccacaaggtttccgaggcttggtgctgtttctcactgtcctcagctcctgattctgcagctggttctctctccaagcactagcaaaaccctccctaggagcccccagactctgagagcccatgaccaaaaagaaaaggaaagccaagttggggaagaacaggggcccccaactccacagccctccactctgcccagagggcccaccctgggctgcctggaaccccctaaagttgccacccccgcaacacagtagtggggcagttcctggcagcgcctgcagcccatgggctggctctgtacccgcagccccgccaagcgtctgttatcttatttactggaatctgcacagccaggctctagctcaccggtgactaaggagctgcagccattattaccaggcagatggcagactccctaaaagcagacattaaacaataaaatgccaccacataccttgcccacaaaataaaatcaaaacaaacacct

SEQ ID NO: 593317 - DNA, 135 bp, Homo sapiens
agcagcacgctgaagagttgggacccacctcagtccccagcttcatggtcttctaatgtttccacactgggggcactctctgcagtcttggaggccttctttttttttctttttctgggtttttcgacttgcaga

SEQ ID NO: 593318 - DNA, 432 bp, Homo sapiens
cgggaacaatcacttgagcaggtgttctagaaatgcttgtggaatggattaacaggagtaggaaatagtgcttgagacatgacagggctatacatgtaggacgagctagtcctggtaggtcggtacggtgatacggtctagtagagcccagctggtgcagactgctctgggcaagctatggcagccgtaggggatgggacccaccttcaggagctgctgttcatccgtacagggaagccctccatagcttggcgtaagatagggaagaccaacccatgtaaccttgcatggtgagaatgttgagagctttcagaatttgagcacaaaggaaatacccagaacgctagtcttaggcaagtgcttactagaaaggagcagtgacttgaacaggctatgaagatcagtcagtcataaggtagacccaaggtgtca

SEQ ID NO: 593319 - DNA, 920 bp, Homo sapiens
ccgcgtttgtggcccttttgtcacgttagtatgtttgtaattatccgcgccctatgtccgaagtaacgttgttcgtatggctctctgtctatcgtgtgccccccagttgggtgttgctgtgggaagtcctccgcccaacaactggcccgctagtgccgggtcaatccccccttcagtggagggctgtctgaccaagctgggcaccgctggacaacagttgtcccgacacattacatgtcagggggtccaccaccatactaccaccatgaagtgagtaccctttgcgaaaaaatcaagccattatggccctcgccagccccgagacggataatagaaatgggcggggtgaatataaccaccggtgtgggggcaaaaaaaaacagaggggccatgggcggggtgacaaaagataaaatacatattggatgttctgtcagtaagtgatcgcgagagtggggtacaggaggaccaattgggtcgaccttcggacgcactgagtacgtattgtttggtcgcggcaccccagacccacggttagattgtgcatcaccacgttagatagcgccgacggagttcttgttgataataataatgtagcccccccccactgccaattgggggaaagacttcatgggcgagaactttgggaaataccacgtattactatgcaggccgctttttatagcaccaacttttttagattagagcatatgggggccacgaatatcgcgtggagaaaggtagggtacacgcaacagaaagattgtggcctttctctagttaaagtaaaaatccacacgaggctggccagtaatgtttggagctgccttttgtgagtgaaaaaggtattgtagcacatactgtcggcccttaaaatctaaaaaacttcccctaatcccgaaaaaacaaacaacaaaaca

SEQ ID NO: 593320 - DNA, 601 bp, Homo sapiens
cgaagagaggtaacggatcagagtgatcagatacaaagcaaaagcaaattatcttaattactatattagttactatatgtagcaagaattgatataatctttaaaacaaaattaggaacgcctcagtgctcaagatatggggatatcaggacacgcccaagtcggggttggtttagtaaatgtattaatttgtgcccttaaccgtgaacatctagaggctagaaataccgaacttgctggaaatgcagtcgagaaagtcccagcctcatgttcctagacctcactcaagatggagtggcgctgatgcaaatgcctctgacacttccatttccccgcatctaacaccatagtctacccagtggtctgaaatggccttcgctcctttacccagcaacctctcaggcattcttcagcactcagtcctagcatctttccctcaagaatgcatcgctgggctgagcatgggggctaacacctgtaagcccagcgcttggggagcgcaaggtgggtggactcgctgaagtcaggagttcgagaccagactggccaacctggtgaaaccccatctgtactaaaaaatggaaagtaagccgggcgtggg

SEQ ID NO: 593321 - DNA, 313 bp, Homo sapiens
  misc_feature (27)..(27): n is a, c, g, or t
  misc_feature (57)..(57): n is a, c, g, or t
  misc_feature (112)..(112): n is a, c, g, or t
  misc_feature (136)..(136): n is a, c, g, or t
  misc_feature (194)..(196): n is a, c, g, or t
  misc_feature (219)..(219): n is a, c, g, or t
  misc_feature (237)..(237): n is a, c, g, or t
  misc_feature (243)..(243): n is a, c, g, or t
  misc_feature (246)..(246): n is a, c, g, or t
  misc_feature (254)..(254): n is a, c, g, or t
  misc_feature (296)..(296): n is a, c, g, or t
ggcaagccattcctaaacagcccaacnggcatttaattacccaatactgtatatacngcaaatatggacagttactttcctctcgcctgttcatatccttcagtgacattgnggaagcagtgtttctctttttaanggagaatagttgtcaaccttcattcatctcttacatctctcaccctctcctttttttnnncttcgattttcccccttatcgangggactgatattcattcngttttngangaacattnggaaaccgccgggcttttattaaagctctgtagaattaaaangttctggaattataagc

SEQ ID NO: 593322 - DNA, 578 bp, Homo sapiens
tgatctagaggatcccgcatgtgggcatcactggtgaagagtggagttggtgacatgtcaagagcttagcgtggtgccgggtacatggtaactccggtaaaggtattagtggctggtatattatcatccttttcatctttatcatggtcattatcctcatgatcacgggcgtcattatcacgcgtatatagaagacaggttgagctagagatacaagtggggcagtcaaaagatcgtattggaaacaagggaaatacggcagcatgattcacaaggcaacggtggcacaagaaggcccaaggggagccctagttaaacgtggagccagaaaagaagagcaaggtatggctagagaagtaggcagggaaattaggcagtgacaccaacaagaacaggaaagagcacagtgttaacagaaggacggaggggtggacggtcgaatatgttaaaaatcttagacaaattaaatttaacagagtttagttgagcaaaaaaaaacaattcccaaattgggcaggacccaaagcagaagaggttcagagaaactccagtgcaggaatccaggtagtgagggatga

SEQ ID NO: 593323 - DNA, 527 bp, Homo sapiens
agcatcacagggacacggtcaggcctctggatgactgcgtctgggcttgactgatgtcaggacctccacaagaggtggtggagcagagtcttctctacctcctccggagaaagggagattccctttcctggtctgctaagtaaccggtgccttttataagcactgacgctaccgctagaccatggtccgcttggcaacgggcgtcttcccaggcgctggcttcaccgctagacccaggagccctctggcggccctgtccgggcataacaggaggctcgcacgtgttttctggtcactcctcactgtgtcccctcggctcctatctctgtatggcctggtttttcagcttcgatgaaaaatggaaaagcagccggacgcagtgactcatgcctgtaattccagcattttgggaggctggggcaggaggatcatttgaacccaggagtcggagaccagcctgaggctgcaatgagcgttcatggccccgctgcactccccactgggtgacagagcgagaccctgcctcc

SEQ ID NO: 593324 - DNA, 234 bp, Homo sapiens
tcgggtcgctcacgtgcggacagcgcgttgtgtgcatgtcgtccacgtgcgccacggcgttggtcagcgcgtcggcaccttcttgctgtggcccttaacctgggcagcgccgtggctcaggtcgaagtgcgggaagtcggtcttggtggtggggccggccaggaacatcctctccagggcctccgcaccatactcgccagtgtgcggcgccgaacttaccccagtccggcccgg

SEQ ID NO: 593325 - DNA, 349 bp, Homo sapiens
tgcataatctgcctaagagtgtgtttgaaatagcagacgaagaagtgtttaaaaagactcgaggacgtggatgtttggactggagggagtgtttgaaaaattgcctagttatgttttttgtgttagccagaaggccaagaagtgataagtgcctatgtattttcagaagttgagtagtgatacattgccattgtataccagtaaattgttgtcccatttagtgtgatattttaataagaattgcttgttccacatgagaatttcataccccttgaaaagtgtgttttagttacacttgatattttctaagttattttatatctgaaggattattatgtagtaacaagac

SEQ ID NO: 593326 - DNA, 117 bp, Homo sapiens
tggggttttataatagagttgcaagtcatagggtgttagctgggagatggttaaaggtggtaaggggagggactgtggtgtagtggtgttgcagtaacaaaatgtttccaacatacc

SEQ ID NO: 593327 - DNA, 204 bp, Homo sapiens
gggggggggtttcactggggggacgtgagcacgcggaggggcggtcgccagcaggggtggtcaacgcagaagcgagcggaggtgatactgagagaaacagcatggcggcccgtagaacagaacagtccagcccaagcagccccgcgcatgcccgtacagacaccctgcgagccccatggagcacggacaggagccacccgactc

SEQ ID NO: 593328 - DNA, 654 bp, Homo sapiens
gtgagaggagcagtcatgcagtgcccgatggaggcaggacttcctggtgtggggtgttgtcaacagcccagaaatgagaaagacggagatggcagagacccagtggtgagccgaggagctggagacactggacccagcagtggtcacgcgtggagtgagactcgtgtgacacccactctgctgtgcttgccacctgtgtgatgcatgagtggggtgctcgtgccgccccctcccacatcagtctccagacccttgtggtgcttcagatggcctgctcctagtgctcctcgtgaggagtgcgcgggttccttcttttcctggagatgcaaagctttttcctcgtgatgattgccttggcatgtgaatgatgcctgctgtgccccctgtgagagtgactgtggacatgcctcatgatctgcctgcctgctgtgccccgccactgcccatggccagtgatgtgccccagtggaactgtgacagcccgacctcttaggcgccgggaccctcaggctcagatcagtggccgaggccccagagtttgcaaactcagctctggagttcagcagcaacagcagcaggaaaaacctgccctggctgccgcagaggagagcgaggaggagatacaaagcgagggtaacagagagaggacgacac

SEQ ID NO: 593329 - DNA, 361 bp, Homo sapiens
acggggtactggactggactgcaatggactggacaggctgatggactggactaggactggctgatggactaggactggctgatagactggactggctgatggacaggactgtggatgatactcaggcttccggcttgagtggatcatgaacaaagagggaaatctatgtgcttggggtgggggtggggagctatagatataaggacacatagcacatatataggatcctatagggatacccccacgtttagtagtcaactagagcagcaggacacagtctagagtctagtaaactggaggtaagaataaagggaggaggagacatgggagaggggctgataaagctgaactgcccgtcttg

SEQ ID NO: 593330 - DNA, 157 bp, Homo sapiens
actaaaaatataaaaattagccgtgcacgttggcgggcacctgtagtcctaactaccagggaggctggggcaagagcatcacttgaacatgggggatggaggttgcagtgagattgcacttcagcctgggcaacagagctagactctgtctcaaaaa

SEQ ID NO: 593331 - DNA, 452 bp, Homo sapiens
  misc_feature (59)..(59): n is a, c, g, or t
tagaaatacctggtcttgggtttgaagctcctgaagcagtgggagaggtggtttacccncaggaaatgttttcctagccttggatcacagcaggttgttttatcctcccagggctgcaagtcattttgtacataaacgaagaggaatacaacccattcctcgtgtcctccactggagctaaggtgatcatccatcggcaggatgagtatcccttcgtcgaagatgtgggaacagagattgagacagcaatggtcacctctataggaatgcacctggtaagagaatattctcatttccataggcttggagagaacagatctttttttttcaaaggataaccaaaggggggcagctttaaggaaaagggggtttgtttccaaaggggacaaggctccacattttcccaagggtatcccattcaattccggaggtacaataaaaaatgggtttgg

SEQ ID NO: 593332 - DNA, 327 bp, Homo sapiens
  misc_feature (52)..(52): n is a, c, g, or t
agttgcagagttgtgtgtaatttaaagcacagcattttgtggcatctgggcncatttactgcatttgtagttctgggccaagttccttaacattctccatactttagtttactcaactgtgagagatgtgggtaatgccttccgtagagtgttgttaaatgagcatattgaaaccttagcccagtgcctaaccaggattagattgtaaatatttctataaacgatgttaaaggaactttctttgaagtatatattagtgttcattcttctagatcaaagtttggaaagtgttaactgcagtcctgcttctgagacctccacagtgtt

SEQ ID NO: 593333 - DNA, 135 bp, Homo sapiens
gttataaagggcaagccagtacgcatcatgtggtctcatgcgtgatccatcacttcgcaaaagtggagtaggcatacatattcattaaaaatctggacaaatccattgataagtaaagcactgtactgatacatt

SEQ ID NO: 593334 - DNA, 787 bp, Homo sapiens
  misc_feature (13)..(13): n is a, c, g, or t
  misc_feature (61)..(61): n is a, c, g, or t
  misc_feature (67)..(67): n is a, c, g, or t
  misc_feature (85)..(85): n is a, c, g, or t
  misc_feature (95)..(95): n is a, c, g, or t
  misc_feature (97)..(97): n is a, c, g, or t
  misc_feature (106)..(106): n is a, c, g, or t
  misc_feature (125)..(125): n is a, c, g, or t
  misc_feature (130)..(130): n is a, c, g, or t
  misc_feature (132)..(132): n is a, c, g, or t
  misc_feature (135)..(135): n is a, c, g, or t
  misc_feature (166)..(166): n is a, c, g, or t
  misc_feature (243)..(243): n is a, c, g, or t
  misc_feature (300)..(300): n is a, c, g, or t
  misc_feature (325)..(325): n is a, c, g, or t
  misc_feature (346)..(346): n is a, c, g, or t
  misc_feature (358)..(358): n is a, c, g, or t
  misc_feature (384)..(384): n is a, c, g, or t
  misc_feature (517)..(517): n is a, c, g, or t
  misc_feature (580)..(580): n is a, c, g, or t
  misc_feature (594)..(594): n is a, c, g, or t
  misc_feature (638)..(638): n is a, c, g, or t
  misc_feature (642)..(643): n is a, c, g, or t
  misc_feature (646)..(646): n is a, c, g, or t
  misc_feature (658)..(658): n is a, c, g, or t
  misc_feature (671)..(672): n is a, c, g, or t
  misc_feature (681)..(681): n is a, c, g, or t
  misc_feature (693)..(693): n is a, c, g, or t
  misc_feature (697)..(697): n is a, c, g, or t
  misc_feature (699)..(699): n is a, c, g, or t
  misc_feature (702)..(702): n is a, c, g, or t
  misc_feature (724)..(724): n is a, c, g, or t
  misc_feature (779)..(779): n is a, c, g, or t
atagatctttaanttactattaatctgtaaattacagcgagaagaagaagtttcacctgtntgcatntctgttgttgattctccntctgactttnanggactctgngggactaaccttatcctgntaagngntangattccccttctaagtgatcactactgggantttacggacctttttttccatggtgcagattgcagaggtgaacaaacagacgcatatattagctctttgagtttgcnattgggaagtgaaaatcaactgtctttaataaatgtaaggactcaggtagacatcancttttgattaaactatcagcaaatnatatgtaaataaaggccatgnagttatcggatngcatctactaaggaatacttagatgnggatttgactttggtagcaattgttcttttgtctttctcaccttccttcttgtcctgtctgggatgctgaagttatggctggtatacatatgccctgttgtgatgttgagataatacatgagattaaaagttngcgattacagatggcagataagagagagaaagataggatgtaggtggatattgatggaactangtttctattgcacnagttctaccactaacctctggacttcatgatatgtgagggaganatannctnctattttataanatatctatgttanntgcaactgnacggaatgcttnattngnacntcctatgtgctccaaaccttcnttaatttctgtgtgtaaggcatacttagtctttacccattattctgttcacattnattcactc

SEQ ID NO: 593335 - DNA, 148 bp, Homo sapiens
gccccccctatcccctgcctccccctttcagaagagggtggaagatgaaatgaaagctatgggacttttggaggatacccagtgtttattttgggttagagaagtgcttactaaggggttttttaataaaaaccaatgcccccttgga

SEQ ID NO: 593336 - DNA, 324 bp, Homo sapiens
  misc_feature (34)..(34): n is a, c, g, or t
cggtcttcctgggctgcctgaactggtgtaaatngaaagttcagctgaatcttgattttaattaacttattacaccattaatataaagttggaattctatattaattatgttgttctggctgcctgcagtatcagtttgccctcttgttagggagcagtgtaacaatctgccatttaattgtgcagggttttttacactgcagaattagcaggagtgtatgtacacagaattttcttggtttgtctctcacatttgagcattacaaagttttttttaattgcattttgtctcttgtgaattaattaagactgtagagaaaaata

SEQ ID NO: 593337 - DNA, 1074 bp, Homo sapiens
  misc_feature (238)..(238): n is a, c, g, or t
  misc_feature (273)..(273): n is a, c, g, or t
  misc_feature (302)..(302): n is a, c, g, or t
  misc_feature (449)..(449): n is a, c, g, or t
  misc_feature (581)..(581): n is a, c, g, or t
  misc_feature (1025)..(1025): n is a, c, g, or t
agcggagaagtaccgcctgcggagtaactagcaaatatacataccaagcgctagactaataatcagataccacacccgatcctacaacaaagccatgctattgcacctgggaaacatcataaaaatcgaacaatcaatacaatatgataaatcaaaccagagcgctcgtagactagcgacattcgaatctagaaagaacgaatataccaactgagaaaatataccgtcagataactanttgatattagtctgaataagcaagtgattctatgnaatccgactaatataaacacatttatagnaaaccaaatgcatataacaaggattatattaagaaaggagagatgtagcccatcataacatatgatgcaagaaaaagaataacatatcagatgtaaataaaatgaagataaacgaacaattcaagaataatgagaaatctcataaanctggaaaggccatatcaactaaaatggaaaggagatctatgatggaaaaagattataaacacgaataaaagtataattatacacaacactgaaacgatatagcaaaaggccaaattggggagctagacatantaaaaatcttaatcgaaatgaatgcatatagaagaaatgactctcgatagggaataatcgatgataatagatggggagtagccaaaaaaaaacctgtacttctgaattacttaattgaaagtactgaaatatcgcctccagggaaacgagggctgacattatgaacatagaaccattaacccagagaatctatgacgagaatggaggaggatcagcgagagagaattggactcatatatatccgccacatttgagattccaaatttgacatgcccaattagatccaaggcaggagaaaatttaaattcccaaagcattaactggtaataaaaggcccattcaaggaattcaaaaggtgacccggcgagatctatagagagcccacaaagagttcaaggacacaaaaaattgggactaaaaggaaagcacgaaactgagagctanatgcaagatgaaattaggaggccaacatggggacatcgggaggaaaccg

SEQ ID NO: 593338 - DNA, 237 bp, Homo sapiens
tctagcttctgcccctctcatgtctcctcaccataactgacttaattaagacctaatttttaattgtcagtttgctagcttacattctaagaggttctaaatagagcactataggtggcaaaaatagttgaaaataatgtagcctgcttacagtgagacagaaatacagagttattagtgatatccatgttctggtccatcagactgctatctacgtaagatggcagaagcaggaag

SEQ ID NO: 593339 - DNA, 1240 bp, Homo sapiens
  misc_feature (340)..(340): n is a, c, g, or t
  misc_feature (384)..(384): n is a, c, g, or t
  misc_feature (434)..(437): n is a, c, g, or t
  misc_feature (439)..(439): n is a, c, g, or t
  misc_feature (497)..(497): n is a, c, g, or t
  misc_feature (500)..(500): n is a, c, g, or t
  misc_feature (933)..(933): n is a, c, g, or t
  misc_feature (1006)..(1006): n is a, c, g, or t
  misc_feature (1159)..(1159): n is a, c, g, or t
ggggatgtctatgtcaatgatgctttgtggactgctcacagagcccacagctccatggtaggagtcaatctgccacagaaggctggtgggtttgatgaagaaggagctgaactactttgcaaaggcttggagagcccagagcgacccttcctggccatcctgggcggagctaagttgcggacaagatccagctcatcaagtaatatgctgggacaaagtcaatgagatgattatgtgtggtggaatggcttttaccttccttaaggtgctcgaacaatcatggagattggcgactactcgtgttgatgaagagggagccgaagattgtcaatagacctantgtccaaagctgagaagaatggtgtgaagattaccttgcctgtngactttgtcactgctgacaagtttgatgagaatgccaagactggcaagcnnnngnggcttctggcatacctgctggctggatgggcttggactgtggtcctgaaagcagcaanaantatgctgaggctgtcactcgggctaagcagattgtgtggaatggtcctgtgggggtatttgaatgggaagcttttgcccggggaaccacaagctctcatggatgaggtggtgaaagccacttctaggggctgcatcaccatcataggtggtggagacactgccacttgctgtgcccaaatgggacccggaggataaagtcagccatgtgagcactgggggtggtgcccatttggagctcctggaaggtaaagtccttcctggggtggatgctctcagccatatttagtactttcctgccttttagttcctgtgcaccagcccctaagtcaacttagcattttctgcatctcccacttggccattagctaaaaccttccatgtcaagattccagctagtggcccagagatgcagtgcccagggacccctataancagttgcacagcatctcagctcatcttcactgcacccctggatttgcatacattcttcaagatccccatttgnattttttagtgactaaacccttgtgccattctagagtgcatatatttatattttgcctgttaaaaagaaagtgagcagtgttagcttagttctcttttgatgtaggttattatgattagctttgtcactgtttcactactcagcatggaaacnagatgaaattccctttgtaggtagtgagaccaaattgatgatcccttaagtaaaccataaaagtgtcccttgaaaccctga

SEQ ID NO: 593340 - DNA, 413 bp, Homo sapiens
ctgggaaacagaaggggggaaaagagaacaaatccaaccaaatatccatagaaacccagaatgtgggaaaggtgtgtacagcgctgttcagaggagccaagggaaggggcggggcgggacccaggccaccactagcatgacgaaatgatgacttcgggcctctgtccctcaggctgaatgcgtctgcgctgggtgcccatgcagctcaccccagtttcgtttttgtgtctgtcaataagttcagcacagtattgtttgtaaaaggcgtggctttacactgtagtgggctcagacccaagtgactgcctcggaactcagtagaaaggggggaagcagcgatttgaaattttcaggtctgatgatggtaatatgtaacaaggagtcatcttgtaggaaaatacagaataaatagg

SEQ ID NO: 593341 - DNA, 190 bp, Homo sapiens
ccctgcatgtatcgtttacagtgggaatgatttatattcatttgggtatatagacaataatggcattgctgggttgaatggcaattctgtcttaacttctttcagaaaacaccagacaaatgttggtggctttccacagaggctgaatgaatttacattcccaccagcagtgttatttaaatgtgttcat

SEQ ID NO: 593342 - DNA, 239 bp, Homo sapiens
taaacagcgctattggctccgtgaccagagtgtcgtacaggacagatcaatcgtggcccactgccccgggtttgtaagtcactgttgtctcatcgtactgggtgcgactgaagataccttcatcgctgacctggttgtggggctgtgcactgggccagatcaagaaaggtgccccttgcaggatctgagcgcttgacgaagtacaaccagctcctcagaattgaaagaggagctgggga

SEQ ID NO: 593343 - DNA, 1750 bp, Homo sapiens
tagttctagatcgcgagcggcgccctttttttttatttttggttttttaccctagaaaataagaaaatgtaggtgtcccagcaaagtttaccacacactcaccgcttggcaccacgactgataaaaccttagccttactagatacagacgaccacatatgtgcgtcaccacgtctattcgtctgcactgcctggtgttctctgttcgtctctcggcgctctctcgatcggtttaagacggagccgccgatgctgacccaccgtcgccctcatccacatcatcgcaagaccaccctccctgcctcactagcactacacatccccacacacaacgacaccaacagcacacaccgtcaaaccatacatttgtgctactctgccgctggtgcgctgtctaccgtcttccgactctcaacactcgcctccatatccgtgagcctatcctccgccacacaagcggtctcacttaaccgctccgcgcggccgagcctgtcgccctgcgccgtgcgtgtcgcgtggcttgtcgtctgctgctagtcgcctggtgctgtgtcagtcgctcgcgcgcgggcgagccgaggtcgtctgctactcgcgcgctccgctgccttgtttgcggctccccgcgcaagtactagccctaaaccctaaccctccaacaatattactctataccctatcatccacccaaccaccactactgactctactcatggcacttcagaatccaaccaaaaccactcaccactcctaaatgtaaccaaacagacaatattcacaactaccactaccaaacacaccatcactcactctcacacactcctgcacactattcatcctccgccctccaattaagtaacacatacacatacgagaatacaaccaacaaagcaacgcgcccgccgatcagcccaccgcccgcgcacgcgttcagtcgaactataccgcacgtagccggctcgcgcaccatccaccgcgcccagcgccccaccacgccgacaagacggacacggcaagaccaggagcgccaccctacacagccgggcccaatccaggtgtcctctgctagacacgagcgaccgcacccagcagccgaggagacacgaaacagcccacgcaggcaccctgcgccagacagtccaagatgggcaccaccgacccgcgagcgccgcgaccgccacgcgacaggcgccgcgccacccgcggccacgacgccagcacgccacggcacgaccatagctgagggcgggcacgccatcagcgccgccgcgtgcgctcaccccggcgcgcgcctcgtacacacgacgctcgaagctcagcaccccacgagcgcaacgacacgcagcagaggctggcgcaccagcccccacctcgtctgttgcagcggttctcgtcgcgcttgtcaccgtgcggcgactggcgcgtccctctctcacccttgcactctcaccctaatccatcactctactctctcttactccgtactcatactcactccttctctcccctactccctccatccacacctactaccaaatcatacagctcctttaactaccccgccctagcatccctcttgccactgtcctattcacatcattccagtctcatactctatctccctcctccatcacctactgtatactctattcgtactctacctctaatatctcccactccatctcacacttactcagaccacctcatactaactacccatacatctctactaagtattagtagctcactat

SEQ ID NO: 593344 - DNA, 110 bp, Homo sapiens
accattgcccgagaggaaggggtactgctgtgtccgtcaagcaccagtgatgcccaccaccggcgcccggtgcatacagctggatcgccatatgggtagtagctgggtac

SEQ ID NO: 593345 - DNA, 291 bp, Homo sapiens
ctatgccctgcctaagatcgtataggaatgtatatatgaaatgacctgtactaggtgacctgacatagttctacctttccttgttgtctctagccctagcatctctactactgacttacatcacttcccatatatggtgtattgcagtcctgatcatgatcaatgataggcttaagtggtatggggaccttataggagatatagtattctttgatgactgcgcttatgcttataagatcctgtgtcagagcactgtgtctagacaactgtcacagcatgtatactgatgag

SEQ ID NO: 593346 - DNA, 104 bp, Homo sapiens
tcttttggtttacatatcccatatttctcagaggagtacattctttattctctttatttttgtctagagttattgttggagagctggtcttagagctctgggca

SEQ ID NO: 593347 - DNA, 161 bp, Homo sapiens
ccgatttattaaccggtggttccgagtccaaaatttcgtatgtcccagtgacgctattccgggggggtatcggacagtaaaacctgttatcccggttgttccctaggtgttgcttcccctagctgcggcttctgatccgagctgccggttatagaagaagc

SEQ ID NO: 593348 - DNA, 122 bp, Homo sapiens
gcggatctttgtacgaatactggtgacaaaaactgctactgcatcttgcaccaaagcccattaagccagagtcaaaaggagtccagaaatatagagcatcaacagtgatgccacagaacatg

SEQ ID NO: 593349 - DNA, 838 bp, Homo sapiens
cttggccctgtgacacgtagcaacggggctggttcaggctctgaaacagagttcgggggtagtggggagattagatgacagctacgtgcgctttgccgccagcgcagacgtctagagttgagttatattgcaatgtcaggctttgagaaacttaacacacggatttctaccagaacaagttacagcattcgatgatcagtacacagcagctacctatgattatggaggaagtggaggaccctgatagcaaacagtatgcgggctatgagctattcgcacgcaaggcaagagtcttgtacctcatccgagactagtgatagctagccacaaacagccatacaccgggcagatttaccagccaactcaggcatatactccagcttcatctcagcctttctatggaaacaacttggaggatgagcgagctttattagaagagttaggtatcaattatgaccacagtctggcgagaataaaggactaactagtgattagcatccgttaaaagtagcagatggcagcatcatgaatgaagagctgatttggccaggtccaagtggttgtcaggccttggctgtcgcggagccatcgattgctactggtctggcaacaatccagattggctatgtatactgggatcagtgcaactgggatgtctaaggaatgtctggtgttattgaaacttaatgagtatgacaggtgttgcatatggtcgagtggcaagtgtccgtggatacttgtgctgcagcccatgatcctactgtcccagacttgcagctcatatctgcttcgccaggaatggtaggaagcaattctcactggctgggatcatcggacg

SEQ ID NO: 593350 - DNA, 969 bp, Homo sapiens
  misc_feature (58)..(58): n is a, c, g, or t
  misc_feature (154)..(154): n is a, c, g, or t
  misc_feature (185)..(185): n is a, c, g, or t
  misc_feature (206)..(206): n is a, c, g, or t
  misc_feature (216)..(217): n is a, c, g, or t
  misc_feature (226)..(226): n is a, c, g, or t
  misc_feature (255)..(255): n is a, c, g, or t
  misc_feature (258)..(258): n is a, c, g, or t
  misc_feature (262)..(262): n is a, c, g, or t
  misc_feature (264)..(264): n is a, c, g, or t
  misc_feature (282)..(282): n is a, c, g, or t
  misc_feature (296)..(296): n is a, c, g, or t
  misc_feature (300)..(300): n is a, c, g, or t
  misc_feature (715)..(715): n is a, c, g, or t
  misc_feature (740)..(740): n is a, c, g, or t
  misc_feature (784)..(784): n is a, c, g, or t
  misc_feature (833)..(833): n is a, c, g, or t
  misc_feature (841)..(841): n is a, c, g, or t
  misc_feature (850)..(850): n is a, c, g, or t
  misc_feature (883)..(883): n is a, c, g, or t
  misc_feature (892)..(892): n is a, c, g, or t
  misc_feature (960)..(960): n is a, c, g, or t
tcccgggattccgtatctgcttcgggcttccacctcatttttttcgctttgcccattntgtttcagccagtcgccaagaatcatgaaagtcgccagtggcagcaccgccaccgccgccgcgggctcccagtgcgcgctgaaggccggcaagacngcgagcggttcgggcgaggtggtgcgctgtntgtctgagcagagcgtggccntttcgcgctnnccgggggcntcggggcgtgcctgcctgccctgctggangancaanangtaaaagtgctgttttangaaatgaacggctnttantcacgcctcaaggagctggtgcccaccctgccccaaaaccgcaaggtgagcaaggtggagattttccagcacgtcatcgaatacatcagggaccttcagttggagctgaactcggaatccgaagttggaacccccgggggccgagggctgccggtccgggctccggtcagcaccctcaacggcgagatcagcgccctgacggccgaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcnctggcgaggagagggcgctcctctntgcacacctactagtcaccagaaactttagggggtgggattccnctcgtgtgtttctattttttgaaaaaccagacattttaaaaaatggtcncgtttggngcttctcanatttttgaggaaattgctttgtattgtatattncaatgatcnccgcctgaaaatattgttttccaatagttctgtggggctgtttttttgttattaaacaaataatttanatggtggta

SEQ ID NO: 593351 - DNA, 444 bp, Homo sapiens
gtgaggccgcacccggggtcgcgactcgcctcgccggagtcggggcagcgctcgcccctctttaccatgtatcccgtccagggatcccatgacagattctgtgtcacgtctccttacagagttgagcggtgctgaactgtcaagcaccgatcatggtccccggggtcccacaaggcatgcctgctgagaccccccagggagaggggggccacaggctgccccacgctcaggcacactcggcgaaggggagctggagaaggggtcccagaggataggaagccaagagccctgtggatccggcccgatgctccgagcaggtggactggcagctgggcggctgctccgagtcccaatcacacacgcccggaaaactccaaaaatctgccagatatctgaagaaacgggacaccctatggtcagaatcaaagatgcacgagtcggcga

SEQ ID NO: 593352 - DNA, 776 bp, Homo sapiens
  misc_feature (54)..(54): n is a, c, g, or t
  misc_feature (67)..(67): n is a, c, g, or t
  misc_feature (99)..(99): n is a, c, g, or t
  misc_feature (122)..(123): n is a, c, g, or t
  misc_feature (131)..(132): n is a, c, g, or t
  misc_feature (141)..(141): n is a, c, g, or t
  misc_feature (149)..(149): n is a, c, g, or t
  misc_feature (153)..(155): n is a, c, g, or t
  misc_feature (157)..(157): n is a, c, g, or t
  misc_feature (162)..(162): n is a, c, g, or t
  misc_feature (165)..(167): n is a, c, g, or t
  misc_feature (170)..(171): n is a, c, g, or t
  misc_feature (175)..(175): n is a, c, g, or t
  misc_feature (180)..(182): n is a, c, g, or t
  misc_feature (186)..(186): n is a, c, g, or t
  misc_feature (191)..(191): n is a, c, g, or t
  misc_feature (215)..(215): n is a, c, g, or t
  misc_feature (253)..(253): n is a, c, g, or t
  misc_feature (255)..(255): n is a, c, g, or t
  misc_feature (522)..(522): n is a, c, g, or t
  misc_feature (547)..(547): n is a, c, g, or t
  misc_feature (591)..(591): n is a, c, g, or t
  misc_feature (640)..(640): n is a, c, g, or t
  misc_feature (648)..(648): n is a, c, g, or t
  misc_feature (657)..(657): n is a, c, g, or t
  misc_feature (690)..(690): n is a, c, g, or t
  misc_feature (699)..(699): n is a, c, g, or t
  misc_feature (767)..(767): n is a, c, g, or t
aaaagggggaagggggatgaaggtaaggggtaagatatgaaaaatataaggagngttaggagaaatnaaggaaggggtgtgttaatgttaagaaaaatngttattaattttaaagaaggggnntagggggnnagagggggngtgggagnttgnnnanattangtnnnatnnttgngggtnnntggntatgngggggtgcctaaggagcctggaanaagcgctcccccgtcgtgcttcctggggaagggggcgntnctgcgctcggagcggcgtcccttccaacccgccggtctcatttcttctcgttttcacaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcnctggcgaggagagggcgctcctctntgcacacctactagtcaccagaaactttagggggtgggattccnctcgtgtgtttctattttttgaaaaaccagacattttaaaaaatggtcncgtttggngcttctcanatttttgaggaaattgctttgtattgtatattncaatgatcnccgcctgaaaatattgttttccaatagttctgtggggctgtttttttgttattaaacaaataatttanatggtggta

SEQ ID NO: 593353 - DNA, 116 bp, Homo sapiens
cgatattattagaccaagcgagtcctccctcccaatatgaaatatgaatcatctacagcctctgcctggtcgcataatttgtctgtgtctctatgcaataaaatgattgtttaact

SEQ ID NO: 593354 - DNA, 789 bp, Homo sapiens
  misc_feature (54)..(54): n is a, c, g, or t
  misc_feature (67)..(67): n is a, c, g, or t
  misc_feature (99)..(99): n is a, c, g, or t
  misc_feature (122)..(123): n is a, c, g, or t
  misc_feature (131)..(132): n is a, c, g, or t
  misc_feature (141)..(141): n is a, c, g, or t
  misc_feature (149)..(149): n is a, c, g, or t
  misc_feature (153)..(155): n is a, c, g, or t
  misc_feature (157)..(157): n is a, c, g, or t
  misc_feature (162)..(162): n is a, c, g, or t
  misc_feature (165)..(167): n is a, c, g, or t
  misc_feature (170)..(171): n is a, c, g, or t
  misc_feature (175)..(175): n is a, c, g, or t
  misc_feature (180)..(182): n is a, c, g, or t
  misc_feature (186)..(186): n is a, c, g, or t
  misc_feature (191)..(191): n is a, c, g, or t
  misc_feature (215)..(215): n is a, c, g, or t
  misc_feature (253)..(253): n is a, c, g, or t
  misc_feature (255)..(255): n is a, c, g, or t
  misc_feature (522)..(522): n is a, c, g, or t
  misc_feature (547)..(547): n is a, c, g, or t
  misc_feature (591)..(591): n is a, c, g, or t
  misc_feature (640)..(640): n is a, c, g, or t
  misc_feature (648)..(648): n is a, c, g, or t
  misc_feature (657)..(657): n is a, c, g, or t
aaaagggggaagggggatgaaggtaaggggtaagatatgaaaaatataaggagngttaggagaaatnaaggaaggggtgtgttaatgttaagaaaaatngttattaattttaaagaaggggnntagggggnnagagggggngtgggagnttgnnnanattangtnnnatnnttgngggtnnntggntatgngggggtgcctaaggagcctggaanaagcgctcccccgtcgtgcttcctggggaagggggcgntnctgcgctcggagcggcgtcccttccaacccgccggtctcatttcttctcgttttcacaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcnctggcgaggagagggcgctcctctntgcacacctactagtcaccagaaactttagggggtgggattccnctcgtgtgtttctattttttgaaaaaccagacattttaaaaaatggtcncgtttggngcttctcanatttttgaggaaattgccttcagttgtatctccccatagtccgcccgtcagaacattctcttcccatagttctgtctggccgcctctttgttcttggcccaatgatttaaatagtgcgaccaaacttcgact

SEQ ID NO: 593355 - DNA, 352 bp, Homo sapiens
tgagatgagttgttgctctgttgcctagtgttgcaccattggtgagcaggggtgcagtcatagcacaacctccaactcagctcaatgatcctccagtctcagcttcctgagtagccgtgactacaggtgcatgccaccatgcccagctaatttttttttttttttgaaacaaagtctcgctctgtcgcccaggctagagtgcaatggcgcgatctcagctaactccaacctttgcctcctgggttcaaacaattctcctgcctcagcctcctgagtagctgggattacggcacccaccaccatgtccagttaatttttgtatttttagtaaaggcgagtttcacgatgctgg

SEQ ID NO: 593356 - DNA, 337 bp, Homo sapiens
gtctatcagattcaagagatcaggttgtgacggtccaccaagtacaagacttcaacttgttctctgatatccttatgacagaaaacttagcgtagagatagtcaatcagagtctgtgatacactcaggacaaaagaatgtccttaacacatcaacaatgctcaagtgtaagtctgggcaatgtgccggtgcgtgtcttaatttctccacattgaacaggtgaagtgtccaagagatggcccaccaaatctgtatctcacatcattcctttgcaattgttagaactaattacttatacagaacctaattctgtgctaagtgctctacatgcatcagga

SEQ ID NO: 593357 - DNA, 242 bp, Homo sapiens
  misc_feature (8)..(8): n is a, c, g, or t
  misc_feature (198)..(198): n is a, c, g, or t
tgtagtantgagcctggggacacacagctgggagggggctggtccacgtacgtgccgctgcgccccggcatctgcagatgcgttcacaaactcagggaccacttgcttgatctggtggcttcacgtatccatcaacagctttagcagtagcagactcgcagggaactggtgtgtagtatttgggagtatacttcatcntttgggcgcgatcaggaaaccaggtagataagggtaaattcaag

SEQ ID NO: 593358 - DNA, 445 bp, Homo sapiens
tttaggagttttccttttgaaaagactccccctttttttttttaaaaaaatttccctttgtggggggggggctccccctttacgaatattttttaaaaaaaatttttttttttttttggggctttaaaaaattccggttttttttttaaactttttttagggtttcaattttttttgggggtttgccaaattttttttcaaccccttttaaatttttttgtggaaaattttaaaaaaacccccctcttaaggtttttttttcctttttttaacaattttcgggttgcccccatttcccctttttggccctgggaggggtgtttttttaaaaaattttttttttttttacctctttggtgaatttttttaccgtggccttaccgccttacacttttagggggcaacgaggcagcaggcgccacccaagttgtgcgccgcacattgt

SEQ ID NO: 593359 - DNA, 339 bp, Homo sapiens
  misc_feature (18)..(19): n is a, c, g, or t
  misc_feature (53)..(53): n is a, c, g, or t
  misc_feature (73)..(73): n is a, c, g, or t
gcggtgatctagaggacnnatccccggtctgggtagacactgaacaccctggnaagggagagttagccgcagnagatgacccagtccactgctgtaccagaccgggtcctgcaaagagaggcgtccatcaagcctcatccctgcacaccacgttgggcctggcccgattctacctcagagacccacttgaggagaggcacagggatgctgcctgagcagcagatccttctggcacggagcaggctgtccccaggcctgtccgacaggtccttgtttctaggtgctcttggcttcccagacttcagcaggcctaggaaggccccggtctcccttagctga

SEQ ID NO: 593360 - DNA, 245 bp, Homo sapiens
cacgagtggagctggtgcagctcgtcatcgatggggtgaactatttgattgactgtgaacggcgtctggagagaggacaggatattcgaatccctccacctcttgtccacagcaaacattaactccccatccccagcggatgagtcaagacccccaggacttctgcatatttaacagtggcctagtctacttgccctggacctgcctctctccctgtcctagtaaagactccacattatgttgca

SEQ ID NO: 593361 - DNA, 121 bp, Homo sapiens
acaaagcatgtgaatactggcattagctctcataggagacccatatgcttccttgctcagtgcagaactgagtgattctacttgcgtgtaggatgaactggttaacacgagctagttaaac

SEQ ID NO: 593362 - DNA, 358 bp, Homo sapiens
ccttctacgtctcatcactgaacctccacaggcacctgctgtgaactaatgtgccagcttaagggacagcctgccctggttgggcttcttgggtggaacaagaagattcaaggaggaggctggaccaagagagaattagccggatcttgctaggatttctttttttttgtctttttgccatttctgggtctgctcccgtggcatatggaggttcccaggctaggggtcgaatcggagctgtagcagccagcctacgccagagccatggcaacgcaggatcagagccacgctctgacctacaccacagctcacggcaacgccagacccataacccaccgcagtgatgagacgtagaagg

SEQ ID NO: 593363 - DNA, 380 bp, Homo sapiens
gcccccctttggggattttgcccccgggccaaagatttcggcccggggaaaattctccaatttccgaaacccctatatttttaccccttggttgggaaggaatttgttttttgctggaaccccccgggttgaaaaagacccgtccaatggagtttctgaaaccccttttttttgcgagggttttttccgaggggtcacttcctttggccttgaaaaaaaatgcggagaccctcgtgggcctggtttttattttcttctctcaaagaaaccccccaactggataattttgactatcaagggggcagtttaaataaccgtttcctttcatttactgtggcttcttaatcttttcacaaataaaatcaatttgcatgaccgta

SEQ ID NO: 593364 - DNA, 133 bp, Homo sapiens
cccgcagttatttgggtgaatggatcattccatattaaccctcttagtcatcctaaatggcaatatggtgtagtgatcaaaagcccagtgctccagtataagacatgatgtagtggctagaagcaccagcacc

SEQ ID NO: 593365 - DNA, 125 bp, Homo sapiens
gagtcacatcatgacatgacactaaggactaatggcttgaggggaagtctttagcattataccaaggatcaactgtaaacaaagagacagttccctgtgtcagttaggcatctccaccgcgtcat

SEQ ID NO: 593366 - DNA, 340 bp, Homo sapiens
tctgcttctgaaatcctactacaagggcgtgcacgttacaccgttgcagggtctgttttaggccctcacatgtctaaaacagaactgttgatgcccacccacctttctgttctcggtgcgtagcttcagcattccctcacacctcatgtccagtcactcatccctgttgcctctttgtccacagtagcccctcaatctcaccacttctcaccgcttctcctgtccaccagcaaacctcaggtcaggccatgcctccctctgcagtaaacagtgagacacagggcatgtggaccagaagctgtccagaacagcatacttcctttcaagaagcaggaactgg

SEQ ID NO: 593367 - DNA, 310 bp, Homo sapiens
agctgagctcatccatttgcataattttcagtgccatttctcagctgatgagtcctgaacttttgtcttgaggctagacttctccttcaaacagcagtcttaaacactcaacttctttcttgttttttccacttgtgaactcatgaacacctccatcttgttacatccaaagccaaactcatggcttggagtggtaggtgatggctgtaaccccagtgctatgggaggctgaggcaggaggattacttgaggccgggggtttgaagccagcctggaaaacacggtgagactccctatctaccaaaaaaaa

SEQ ID NO: 593368 - DNA, 290 bp, Homo sapiens
cattcggccagggatttgtctggagtctcaaatgccaccaaaggtgcttggggcactaccctcaacatcgcaactgtgttgacctctattcagctgctcatgtcgaacccaccctgatgacacgctctaggctgacataatcctcagaatttaaatataatagaccggacttcctcgggaaatgccggccagtggcggagaggcatgcaggcggaaccaaaaggctgttggggagagatgctttatactataccagagctgtgctcagagtcaacattacaggaaaagga

SEQ ID NO: 593369 - DNA, 281 bp, Homo sapiens
actctaagtcactggggctatgcccatgctaaccttgtgactgagaagagttacacctccccaccaaccattcccaccaacatacacaacagttggtcctggtggcagaggaatgggaagaggcccctctgcagtaagtcagcgtaaggacaagagtgggtggtgggtgtctgtgtcacttttgacaaggacaggatagagcgtacctcagaggtactcgtaaccctatgtgcctggggagaaataacttgcttaagtctaataacttcaattataaacca

SEQ ID NO: 593370 - DNA, 179 bp, Homo sapiens
cagtcgcgtgtgctcagtcgcgtgtgcttatcattgtttaggaagcaatccttgtaccccccaggtcatgcatgtcgctggaatctctgtccacaccagcaggccagccttacgtccctgcccctttgctggaaaggcctcaatccaggaaagagtggctatgtgacctacagcacacg

SEQ ID NO: 593371 - DNA, 1025 bp, Homo sapiens
  misc_feature (1)..(1): n is a, c, g, or t
ncggatgatcagtgacacagcataaaaaaataactcaggtccacatgctgctggtgtctccacaggtggactccccttcggcgagttaagtgctgcgccttgcacggttcatgtgctgcgacggtgtgttggcagtgtcgtgtatgtgcttttgtcgcgctgccccgtggggatatctgcgcaagtagaggctggagagtgcaccgtgctgtattgcgcgataaaacctggggtgatgtatgggtgaaaaactcgcctgagggtgtgtctcaattccgagccggcgcccggtgtgtatggtgtttcatccctccccgcttcttggtgtgggttggaagttttctggcccccttgtgacaccgcgggtggcacattgcgctctgtggtgaacaaatgggggccgtgtggcacagccgggataatacacgttggctcgttgggggtttcgcggaattattagcacgaccgtcgattgactggctgtgttaagggttgtatagatgggctacttgcgaaaatcctcgctgcttttcctaggggtacagcagaccaccactcgtgggataggtgccacaaaatgatagagagagaaggaacccggcgtgttttaatatggggttatcccacccccccaatacatttggagcccacccccttttttgggcgcgcgcacaccaccgggctagtacgtgacccctcccccatctgtggggggggaacatatgccccttctctgatgaatagtgccacagctctccccatagagggataatatcatgtatgtgatagtgcagtgtttttggtaaaaacgagattctttgtctagcgatcaaacttctgctcaaccatcttactcagtccccctagatgcagattctttttaaaagataaagagtgttattttagatgatagtagggaggatgtataatttttcttggatttaaaagaggggctcgaaacacctgttgagagagaaaagcactctaaagggaaacccaaaaaattttcagcccccaacatgaaa

SEQ ID NO: 593372 - DNA, 795 bp, Homo sapiens
cccagacccctggggtcctccaaggtcccgcgacccaggactcggagccatatcccgatgacctcagggctggctggcatacgccactgcaagcgagccgtcagatcatcgtgggggaaagcagcacagaagcccatgcacccctttgaagagccagagagcatcgagtgcagtggtggtgaaagagcaagagtggtccggcggcactccgcccagagtcactcgcagcacaggaagaaatcgcttcggaaggacatcgagagcttgggcaacgaggacgcggaccgaaactggcccagagtccggcagcagcagcacaagcattctgccttcagagctggtacgagattgagcaactaaagaagcctcatgtctattgaatgcagacccggaccacagagaactgtagtcgtgccactaccaaagccttcctgggctcatgcggggcgccaaccgtgcgccaaccccagcacatccccacaagagtgaccttgccaaaccaacaagggcctggccccgtccccagtcccgcagtacatcccctgtcccctccccaacgccaagtgccttcatgccctagggccgcccaagtgcctgcccctcactcagagtattaacgtctccaagagtattattaatcgctgcttgtacctcgatctgaatctgccggggccgcagcccactccaccaatgtcagcagacttccagtcagtcccaaacagcctcatcagctctcttgcaccgtgttttgatactatcttcccccagcccccagtaacccataggggcgtcaga

SEQ ID NO: 593373 - DNA, 756 bp, Homo sapiens
atcgcaatggcattcctaatgcttacctgaacgaaaaattctagtgctatatacaactacgcaaagcgccccaacgttgtagtgcccctacgtggctactacaacccattcgactgacgccatacacactcttcaccacaagagcccctaaaacccgccacatcataccatcaccctactacatcacacgacccgcaccttacgctctcacacatcgacatcatatctactatgaaccccaccatccaccaatacacccaaccccactggtcacaccctcacacctacggaccatacctactctacttacatagaccaccacatcatagaaccatacaccgatacacacatcgaactacactcctgaactccacgtaggcctgaaggccatcacacaactacaaaactaacgacaccatgaactcgatgcccgcaaccctgcgacacccagcctaagccccacaacacatcctcactatagacgatcacccataccacatcattctagctatcaaacatctactaatcaacgtggacatccctattcaaacccatcgtccgacccctctatcagcaacacaagaacacctactgactcactccatgccactcaatgaccccctggaccaacaaacatgactccatacgccacactagcaaagaacaaaccgaacccccaccagacactgccgaggagcgagccgaacaaggcaccaggctacaacatcgaataagccgaaggcaccacgcccatca

SEQ ID NO: 593374 - DNA, 364 bp, Homo sapiens
agtcggtccggtacgtgctgagtctttcccgccgcttcgtgattgacgatgctacatgtctgcaggttgctgttcatccaggagtcctgcgccttgcatattgtacacagtcttatccagggcggtgcgtgaagctctgggcagcccacatccatgatctttgggttacgcttcgttaggtcatatctctttcctgtttggtataataccaggtagttgtccccgtgcttggacttgagcatgcgcgtgacctccgtgtaggttgtgcaggtaggactcctcagagcagccggcagggaaggacacagcgatgatgcgctccgtgatgtaagtgaggtccagcccatggccctcctccatggtg

SEQ ID NO: 593375 - DNA, 422 bp, Homo sapiens
  misc_feature (43)..(43): n is a, c, g, or t
  misc_feature (62)..(62): n is a, c, g, or t
  misc_feature (65)..(65): n is a, c, g, or t
  misc_feature (75)..(75): n is a, c, g, or t
  misc_feature (78)..(79): n is a, c, g, or t
  misc_feature (90)..(90): n is a, c, g, or t
  misc_feature (122)..(122): n is a, c, g, or t
  misc_feature (204)..(204): n is a, c, g, or t
  misc_feature (211)..(211): n is a, c, g, or t
  misc_feature (214)..(215): n is a, c, g, or t
  misc_feature (229)..(229): n is a, c, g, or t
  misc_feature (322)..(322): n is a, c, g, or t
  misc_feature (329)..(329): n is a, c, g, or t
  misc_feature (332)..(332): n is a, c, g, or t
  misc_feature (339)..(339): n is a, c, g, or t
  misc_feature (369)..(369): n is a, c, g, or t
  misc_feature (378)..(378): n is a, c, g, or t
ggggggctactgggacctcacgttaaacggttttttttgaggngggggggggggggcaggtngtntctctgtgtnggnntcccttaggtnttccattatttgggggggggggtggggggggngaattcatttttgcatgcacaagatgtactgcttaacgaaacactatcagcttgttttaaatgggtcttttaaatatcaacngtggccnggnnggcgaattctttcnaatcttccccattactttcgcctagatttcccataggtcaacgggcatggtaaaatgcctcatcggaacacccttctccacacaattcaaaangggggcnccngggggcncaaggcgaccatcggtccagcaatgcccangatttatcngaaacggcttcccaaggggcaggggtgcggatctgggtggctgt

SEQ ID NO: 593376 - DNA, 293 bp, Homo sapiens
cctctcatttcaccacagctattgtggcccaaggtcctacggtagtgttctatgaagccaaattcccacatataatccatgttaagcacatgtagttaaagaccctgtataccatatacagatctatcaggcttggtgctacacgagatgaggacgaccgtccaggcctcccgggggcttagagcctgggggtgcgcgtgggggtgggcgacgtttacaaaatatcccatgcgatgtgatcagctttggcactgcgctgctgtcaccaaggttgatggcctcggattcccctc

SEQ ID NO: 593377 - DNA, 310 bp, Homo sapiens
tttttttccccaggggtgggccatggggagggaaggactttttcccaggggaagcccccacccctgtgggttatggtttgtgaaagggggcaggaatggggcccctccccccccaagcagcctgggccctttggccgccctgtaaaatggctgtggggtttggggggggcctggggctccctttgcaggggcctttttcggcacccccagccaaggggggggggttcgggtttccagtttttttgtttttcagcggccatttccggggccccagaaggggccagggataataaaatgtttttcagaaaga

SEQ ID NO: 593378 - DNA, 654 bp, Homo sapiens
  misc_feature (350)..(350): n is a, c, g, or t
ggggagttggggcagtttccccctgagacctgcctcttccttaggcctggcagtggcccgcgatgagagagggtccttccccttcaggctaggtgtccctggtcaggcgacccttggggcacccagcaatttagtggcttcagcttccttttccttcgatacccaggagcccacgtccccagctcacttctcccccaggacctagtgctggtgggccccctgcccctgactccagtgagcccaggagttttgaagcccaggcgcgttttgcctcagtcctggtggtccaggctccctcctccctcagaccaggggttccaggccagaatgtccctcctgtctcacttcancttcccccagtgattggaccctccagtccatcttgcgtctctccattttgttggcttgcgtttcttgtccagttgcccctgagtgccctcggctgcttggggtcctgcaggaagcctgtgccatgaatgacctggagcagtcggagtgcggacaatgaagtgactgattgagaccttcgagatctccattccctttcgatgaggcaccccaactagaccacagatcttttacagtctgagcccctctcggagaaactttcgaggagcctccggaggcttgcgtctccgccctgtgtctgatgaa

SEQ ID NO: 593379 - DNA, 265 bp, Homo sapiens
accaggctccatttaacgatataatggaggtcagcacggtgctcacgtgtcgacggaacttgtacagggaggcatgcaccgaattggtaaatacacgtacgaccaggctccatgttaacgatatttggtggtcagacacggagctcactgtatcgcacggaactatgtccagggaggtatgcaccgcagtggtgaatacacgtcgagctggaggacatgcatagcagtagcatcgggtactgaaagataccactacagagtcgac

SEQ ID NO: 593380 - DNA, 1881 bp, Homo sapiens
  misc_feature (1279)..(1279): n is a, c, g, or t
tgtggtgtcgatttctccccctctccggttgtgtgtgtgtcgagaacagtcttgttactctgagctggggggtggtccccctacccacagtgtaggtggtgtaggttcgtcactctgtcttctccctagcatgttatggtgaccaatcctgggtagcttgtgcatgctgcctgctgtcccgaacctgtgctttgcttgcggtgcgtcctttgtgtgttatggaattaaattattctattgcgggcggtcacgtacctgctttgctgtcctaccttatgtgggtgtgggatcgccaccaacgtggggagggagcctccccatcctagggaaggaaccggaacctgccctcccatagctgatgttgggcgcccccccccaccgaggaggttgggtacgtaacctaacgtaacatagctaggtcccgtccagtcaggcaggtaaggaacgcatgctaggtagttcgcttggcgatggcagcacagccacctcagccgggtggggcgccagccacccagcagagagaaagtaaggtaggcaggatgagggcagccagatctagtgagtccaatcaggcggccgccccaccaacaaaaatgtaggcgagggcggccggacaccccataagatgggttgactccccccccatcacccctcctggatgtatggatgtacgggcgggcgcccccctccccccccctctggcggtctgacccacccaatctatgatgaagggaatgaccccacactagggggcgccatcggtgggagggacgtgctctcgccccccccccgttggacggactccacccaccaaccacctcggtctgccggccgtcggtcgggcggaaggaggaataactacccacctaacgatggaggaaggaagaagtacgttcgtacctactaccttgctggctggtggatggatgtagtgcgctcgaaggatggatgggaccaccaccccacccaccatccgagcgacgaccccctggcaggctggagttggcctccccctccttgcttggctgccgcctgccactccctgctggcacttgctgctgcttggctcgctggttggtttgttggttggtcccccctcgtcggcgccccccccccgcccggggggttgaatcactgctgctcgacaaacaacacggcggcggcggcgcgcgggcccccgccggctgtaagaacaggagcacacacgctggtagctgccgtcgcagcaggggggacaccacagccgccccacacagcaccgctgctgcgcagtacaacncctgctgctgctagtagctgcgccacacagcagcaggcagagaataagacaaccaccgcggccactctcacaccgcgtcgcggcaggacccaggtgtgcacccccagcagcagcagccgtggtggagatgactagtacagagagatagactacacacagtaagagactgccctgctgttgcgtggtgtggagatgagtgtgtgagtaggagcgaagacgaccccgtgatgttgcacgagcgccgccccccacgagggacgacacacagtagaacacacagcagctgcgccgcacagtgagagatctccacaccagagtccacccgcgcgcgcgcggggacacacagagagtccccctgtggcagctcacagcagaagtgtgcgcgcgtggcgctcacacagcagacacacacacaagagcagtccgcacactatagctcccacagtggcgcgtgataaaaaacggggttcccacggtgataaccgtgatgcgagcgctctaagagagcaacaccgcggggtgcacacgcgtgtgtctgtggggaccagtgataaaagatcacgtgtgtaaagtaggacacaccccccagagggtcccgccaa

SEQ ID NO: 593381 - DNA, 102 bp, Homo sapiens
actgttgctgtttgagcggagtcttgcatacacgaggagttcagcatgcggacaaggacacttccatgacagaaggacacagcatgtccatcaggcatggtg

SEQ ID NO: 593382 - DNA, 109 bp, Homo sapiens
ggctaggggtgaatcagagctgttgccaccagtctatgccagagccacagcaacgcgagatccgagccgcgtctgcaacctacaccacagctcacagcaacgatggatc

SEQ ID NO: 593383 - DNA, 447 bp, Homo sapiens
tgcctgcctctttccttccctgccacacccaattctgtggcctgtcgctttcctcttcctgcccctgcatcaccccctttcctgccccgcccataccctgcccctgtatgccccttccggcttgctcctccctgtcccctcttcttgctcacccgtctttctgccgctcctaacctgctgtgccggcatccagctgggaccgagagcggcactccaagagacactgagccagctttgccccccaccccctctcttgaggggccgagcaccactcggggaggagccaggcggggcctgacacccacaaagctttagttcccccggggagaggctggggacaagctacccattctggggtatgacacctatcagcacgtgtgagcccgtcctgtgcacggaaccacttactgcttcctcttagcgcaagaggggtcccgcactggagag

SEQ ID NO: 593384 - DNA, 318 bp, Homo sapiens
cgatctagaggtccccgtggttctgtctggaaagtataaaagaaggctggagacaccacttctgtagtctacttttggctttcattgaacacggtggagaattcagaatttttcattttctaccaagaaagctgacagaggaagatgtttcacaattatgagactaatcacaacatgaaggcacacagccgtcaggactctagactctactgatgatgatgaaattgatcatataagtgaaatctcagagcgtgagtctttatataacaaaatcctggctgggcacagtggctcatgccgactaggcccagcacaaga

SEQ ID NO: 593385 - DNA, 143 bp, Homo sapiens
cctgctaccacggcaagctggaacatgagtacaaaataaattatggtagtattttattatactcaaaaataaatagcagagtcaatattgataaaaataaatggttgtataaataaataaatgtgggaggagggctgagtctg

SEQ ID NO: 593386 - DNA, 231 bp, Homo sapiens
aacaagcgaagccgcacatctaacacaaaaaagaagaagggcagagtacgacaatatagagggtgtcatactgctattctatgacataacaaatcaatagtataatgatagtctaattgccctttctactgatagagactccttctactgcatcttaacggcttctaaccccagtgcattctcaaacttgactgcaatgaaatcatgtagaaagcttataagtaattgcca

SEQ ID NO: 593387 - DNA, 352 bp, Homo sapiens
aagctcactacacggtacatcaggttaaacttcacagcgtgatcggtgtctgtgaaggtgtgcaacaagttggtgctctagcaccagtgaatcaagtaacgttggtagccaagaatgatgacgctcataggggggtttcgacaggctgatctccaccatgatattgtcaacagatagaggccctttgtcctagttagtacatggcgtacagctctcagacaagttacgccagccttctgcatagcataatcaacagcacgagcggtgaccacctatacgtctcggcagtcaatgtgccccacaaagtgtcaaccgcgtgcaagtctagcctagtagtcagtgcgcgcgtgtt

SEQ ID NO: 593388 - DNA, 304 bp, Homo sapiens
  misc_feature (68)..(68): n is a, c, g, or t
  misc_feature (71)..(72): n is a, c, g, or t
  misc_feature (243)..(243): n is a, c, g, or t
  misc_feature (272)..(272): n is a, c, g, or t
aggaaggacaacacgacggtgacaaggcttctcaacatcaaccccaacaagacctcggccagcgggantcnngcgcccacctggtgactctggagctgcacaggagggcaccaccgtcctgctcttccagttcgggatgaatgcaagttctaagccgggtttttccctacaaaggaaatccagtttgaatacaaatttctttccttgacggccagagaccccttgccttttaaaaagcttgcnaacgggttcccccttgcgaagcggcttgnagggccacaagttcgggaaatttccttacaaa

SEQ ID NO: 593389 - DNA, 162 bp, Homo sapiens
acctccagaagatacctcgggtaggagtcaagacagcctggcgacatggtgaaccccgtctctactaaaaatacaaaaattagccaggcattgtggcgtacgcctgtagtcctggctactcaggaggctgaggcagaagaatcgaggtgatcttctggagga

SEQ ID NO: 593390 - DNA, 246 bp, Homo sapiens
gtggtagctacatgttgaggtggtttattgttgtagtttttgttattataattggtcaaatctggaaagttagcttgtactaataggggctatgctctgcacttcccttttttttatatccctcccattacttcaactccttatcaaatcatgggggtatccaaaggagtgccgtatttaaccccggtggggatccaatataaggggtcggaggaaaaccagctcactttgaacacctatggatgc

SEQ ID NO: 593391 - DNA, 410 bp, Homo sapiens
  misc_feature (44)..(44): n is a, c, g, or t
  misc_feature (52)..(52): n is a, c, g, or t
  misc_feature (86)..(86): n is a, c, g, or t
  misc_feature (95)..(95): n is a, c, g, or t
ttaaggtgaaccttggaaaacccctggctggacctctctgaacntcccccgnggaccccatgctagccttcccagctggttccccnagacaggcnagaccagcgccctccccagggtctctgtcagctgttccctctggctggcatgtcttcctttccttcagatatcaactccagtgagaccaacccggccacacaactgaacaccacaactttccctctttcatctcctttcaggcttcttctctagcaccaatcactgtatagcacatgtgtcttaattgttttctgtcttccccatcagaatgtctgtccaaggagccaggggtttttgtctgttttgtccactgctgtttcctcagtgcctgaaacagcacctggtgcaaagcatggtctccataaattctttct

SEQ ID NO: 593392 - DNA, 262 bp, Homo sapiens
ctcatacacggatcccctgttagtatcgccgcgactgtttctcaggccaaggaaacacttgtaggtactgatatttgattgatttattataacgcaggaagcaattgtggatctaacaggatcttttggtagctcaacacttgagatgccacatttgtagccaaataactctctaatattagttattctaggtttccggtttacaaggaatattatgctttgcaatccagctgatatacatgcgtcatgtgtggctcagcgg

SEQ ID NO: 593393 - DNA, 406 bp, Homo sapiens
aaggtcatagagtttgtaaataacagtgctgggatacaatgattgtgcctgatatgaagttcgtgctctttccaccagatcaagcccaaatatgaagaaaaccaaaaaaaaaagaaaacaaaccaaaacaaaaaaaaaaccttaattttaaattacatatccattctaaccccctttagtagcctcaaatttgtttatttattaatgtttattggtaaattgtaggtatgttttaatagacttcattattttttttttgaggcaggatattattctgttgcccaggctggagtgcagtggcatgatcatagctcactgcagcctccagctcctgggttgaagcaatcctcctgcctcagcctctcaaagtagcacacaccaccacattcagctaattaaatgaaaa

SEQ ID NO: 593394 - DNA, 987 bp, Homo sapiens
agctgacgaccagcaacgatacgcgacacagaacttcgctccattcatccttgggaccctcgagtttgtcgccccccaaggggctcccccaaaggttcccccgaagtgtcccccgtaatcgggcattggggaagactgagaacacagggtgcgacaaaaacacgcggttctgacgagggatgcccttcggccccgggaaagtgcctcgcgcgcacggagacacaacctctgggggaccgggaactctttccaattaaaaggccaagcgggacaacacactggcggcgagcgcggaccctctatcctagccccgcacacccaaaagagactaatacctgggggggcaacacaaaatgggccggcagaatggggcaaaaggaggactggcgttcttccacttttaagagaaaccccagcctttttactctaaaccccgaggcgaaatatgtcttccagcaaggcaaacatgtcctggacctccccccccccccgcggacggttcctcgccgctgctcttgcgtcgccgtgcgacacacccgccccacgtcttaggtacgttgggtattcccgtacccctactcccagaaagttagttgtagaggtcaagttcgccttgttctctcaaacacagttctgagtcgtgggtgacgccctgttggttagaggaatagaaaacatgttatagcaatttatcctgtagacgaggacaaaggaagcataatggtggtgcgtgaaggatgaggagagacggcttcaccacacaaccgaagaggggcgataagaaacttcctcacagccgcaaccccacgcgcggagcacgccaccaagagggggagacgcacgccacccgcgcgaggccgtcccatgcatgatgagacgtccagagaggggtatagtgcaccagatgaccccccgagagaagcgagcatgtagacaagggaaaaggatttctatttctttttacaaaaaggccacccccacaaaaca

SEQ ID NO: 593395 - DNA, 982 bp, Homo sapiens
atagtatcccacaaaggtattattgtgtctaactcatcgtgacctgcttaaaatctgtagaaccggatgatactgtcgatgtacactcgtgtatgtgcttataaagttctaacatattcagtggttgacatcattcaaagtgtatgctattgcaaaatcatataagtactatgtcccgacacgtgccaattttctaatgtgtcgcctcacgttgggcttcttaactgaggacatggctaattactggagccatcactactgagatttgatgcatttattatattattggagtctatggaccgaatctaacctgatatggataaattcatccaattcgatcgtctcatttcatatggtgatttgctttggtttgaatctgcataaaattatagtgatatatgtatagtaatagatctatgtgcagtttaatttgttagaatggtaatttctgttaaatgtttatactctgtatacatatgatagttgttaaggtgcctgtgactcatggtgtccgtgcctcgtattagtgattctgtaaattgacatgtattttatctaatttcttagaggtgttgggaagtagggagctggtgcccggtggggggttatttgtaccactgaatttttcactaaattggattcctcactaggtcttgagccgggagaaatgaacgtgcacatgcgtgggctataatcgaatttaaagcatcattgtaagacaagctgtgttgcctgccttggtaatattccccaggtggtatgaagcagaaaagcctggtatatgtaacagtgtatctaaaactggggcccaaaagaggatgccgtccacaaaatatcgtccgatggttacccacagaagccttagggtgtaactctgtcgacgcaacatggccagaacatcagaccggcgcggagccatataggcgcacacatcggcacaacacctagtgtgcatagcgtatcatatagacacgggagatct

SEQ ID NO: 593396 - DNA, 215 bp, Homo sapiens
ctgcctcagcctcacaaagggctgggattacaggcatgagtcactgcatccaacagatggatttctaatatgtcaccaaaaggagcacctttagctatgatgggtgggaaaaatatgactaaaataggtatccaaaaagacaagggaaatgctggatagaagagccattccatgaagaacccatggcagtgattttctcattccccagtgcttca

SEQ ID NO: 593397 - DNA, 185 bp, Homo sapiens
cttacctaccttttccccgcaaattctaagacagagtatgtcaattggaagttcacttatgcacgcttccctctcttaacaagcttagagtgcaagagatagaaaagttcaaatctgaccaagatgttaatgttggataagagaattctctgcaccccacctctaagtcgccagccctcctagag

SEQ ID NO: 593398 - DNA, 3110 bp, Homo sapiens
  misc_feature (2789)..(2790): n is a, c, g, or t
  misc_feature (2793)..(2793): n is a, c, g, or t
aaggtctgagcttgttacagcttatcagatgcttcagagagagaagaaaaagctacaaggtatattaagtcagagtcaggataaatcacttcggagaatagcagaattaagagaggagctccaaatggaccagcaggcaaagaaacatctgcaagaggagtttgatgcatctttagaggagaaagatcagtatatcagtgttctccaaactcaggtttctctactgaaacaacgattacgaaatggcccgatgaatgttgatgtactgaaaccacttcctcagctggaaccacaggctgaagtcttcactaaagaagagaatccagaaagtgatggagagccagtagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggaccttcatatggccgagaagactaaacttatcactcagttgcgtgatgcaaagaacttaattgaacagcttgaacaagataagggaatggtaatcgcagagacaaaacgtcagatgcatgaaaccctggaaatgaaagaagaagaaattgctcaactccgtagtcgcatcaaacagatgactacccagggagaggaattacgggaacagaaagaaaagtccgaaagagctgcttttgaggaacttgaaaaagctttgagtacagcccaaaaaacagaggaagcacggagaaaactgaaggcagaaatggatgaacaaataaaaactatcgaaaaaacaagtgaggaggaacgcatcagtcttcaacaggaattaagtcgggtgaaacaggaggttgttgatgtaatgaaaaaatcctcagaagaacaaattgctaagctacagaagcttcatgaaaaggagctggccagaaaagagcaggaactgaccaagaagcttcagacccgagaaagggaatttcaggaacaaatgaaagtagctcttgaaaagagtcaatcagaatatttgaagatcagccaagaaaaagaacagcaagaatctttggccctagaagagttagagttgcagaaaaaagcaatcctcacagaaagtgaaaataaacttcgggaccttcagcaagaagcagagacttacagaactagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaacttgaaaaacaaaatagtgaaatggagcaaaaagtaaaatctttaacccaagtctatgagtccaaacttgaagatggtaacaaagaacaggaacagacaaagcaaatcttggtggaaaaggaaaatatgattttacaaatgagagaaggacagaagaaagaaattgagatactcacacagaaattgtcagccaaggaggacagtattcatattttgaatgaggaatatgaaaccaaatttaaaaaccaagaaaaaaagatggaaaaagttaagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaaacaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtnnaanagaagagatgaacaaggaaataacatggcttgaaggaaagaacgtgttaagcaggataccaccattaacttgactttcccggaacacgttaaagcagaagtctgcccatgttgaattctcttgccacaagattgaaacttaactgaaaggtcaatcttgaaaaagattagagggttgacttgcaattagtcctctggaaggcaaatacttttccttcaaagaagcagataagttgactggaagattgctggcgaaagaagattagaggaaagggttactgaatgtgataggcagtttgaaaacaccagatttgagga

SEQ ID NO: 593399 - DNA, 412 bp, Homo sapiens
ggacgttactacgccaattccgccccccaccaacccccttctacggcctacttaacaaaaataaatagtttcctagggaacggctctaagataagaaaaataaattttcttaaattccattatgacctttttatttacatgactctaagcatataaaaaaatcggagggcggtgccaaggtgctagcatttatggtcatctaataaagcactggcgcatatgtgcaccttaggagtgtatcagtggtggcatgtaatttgggccttggttaaagccgggacctggtacgcacatgaaatttcaattttttttccaacggcggcgctatagaaaagctatggacagtatctagtaacccagggcgggggtgggaaccctggctggtgtatgtgatgtgctccggggctttgga

SEQ ID NO: 593400 - DNA, 2174 bp, Homo sapiens
  misc_feature (1853)..(1854): n is a, c, g, or t
  misc_feature (1857)..(1857): n is a, c, g, or t
catgggaggagagagatgttgacgttacttatccaacagggttgggtgcagatcaaaagaaatgaatgattcctggggaagtactttgcgaatgctgaagatttatgtgcgtttaaggtggtattaattatttttggcacaggaaaagagtcaatcagaatatttgaagatcagccaagaaaaagaacagcaagaatctttggccctagaagagttagagttgcagaaaaaagcaatcctcacagaaagtgaaaataaacttcgggaccttcagcaagaagcagagacttacagaactagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaacttgaaaaacaaaatagtgaaatggagcaaaaagtaaaatctttaacccaagtctatgagtccaaacttgaagatggtaacaaagaacaggaacagacaaagcaaatcttggtggaaaaggaaaatatgattttacaaatgagagaaggacagaagaaagaaattgagatactcacacagaaattgtcagccaaggaggacagtattcatattttgaatgaggaatatgaaaccaaatttaaaaaccaagaaaaaaagatggaaaaagttaagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaaacaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtnnaanagaagagatgaacaaggaaataacatggcttgaaggaaagaacgtgttaagcaggataccaccattaacttgactttcccggaacacgttaaagcagaagtctgcccatgttgaattctcttgccacaagattgaaacttaactgaaaggtcaatcttgaaaaagattagagggttgacttgcaattagtcctctggaaggcaaatacttttccttcaaagaagcagataagttgactggaagattgctggcgaaagaagattagaggaaagggttactgaatgtgataggcagtttgaaaacaccagatttgagga

SEQ ID NO: 593401 - DNA, 274 bp, Homo sapiens
gatagaccaagagctcctcctggtcagatatggcgcccaggtcctcatagaagaatcggccgcccacaggtttggacatcgtcatggtctgcccgtaatccttcccacggcactgaaaattggtgtccaagtcagacattggccgagagctgatccacagccctggacagctatagaagggctgtataggtgcctggggtacttccatctccaggggcccagtttttgggccacactgcctccggactgcagttgggcacactgcaattgccca

SEQ ID NO: 593402 - DNA, 310 bp, Homo sapiens
gcaggtaatggctagatcctgtacagccagtgtgggcgatgtgatgagcggccctgggtcagaaccctaccagcgccgaggtgctcaaggtcctgaataagaacaaccttgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaaga

SEQ ID NO: 593403 - DNA, 110 bp, Homo sapiens
tgcgtgtcaggatgtgtggtgatgctgctgtactcgctttgcagcgggtgctggaagagcccggcacggctgcccagctgcgggaagggtcctccatcctggacccagtg

SEQ ID NO: 593404 - DNA, 248 bp, Homo sapiens
  misc_feature (4)..(4): n is a, c, g, or t
  misc_feature (163)..(163): n is a, c, g, or t
  misc_feature (174)..(174): n is a, c, g, or t
  misc_feature (233)..(233): n is a, c, g, or t
agtnggttgccataaagatcattgatctggaagaaggctgaaggatgagatagaggacattcaacaagaaatcacagtgctgaggtcagtgtgacagtccatatggtaaccaaatattatgggatcctatctggaagggatacaaaattatgggataataatnggaatatcttnggtgggaggctccccactaggatctattaggaacctgggcccattaggatggaaacccngatcggttacttatt

SEQ ID NO: 593405 - DNA, 452 bp, Homo sapiens
cctgacgacactacctgcgcttctactcaggagattttaaccactgttaacatgtcattagaaatacactggttcctttgttcactgctatacttcctggtacctagaacagtggtgcatgtatggtagacaataaatattcattgaattttaaaatgtctgaatactttcccgatagggttattcacaactgtacttcaggaattctataacacttctgactacattagccatgctggctgtctttgagagtttctgcagtgacttacagttttcattggattaccacaggtgtctgtgatctaaaaaggtgcaaaaatactcagttattcccaggactaaacctacaaggtctttacatttctgtctctttatgactgagctccatagagaatcagacttttttttttacccagggctgtcatccatgactaatccaagtcatctatctg

SEQ ID NO: 593406 - DNA, 175 bp, Homo sapiens
gagttctgagcttgctgactgcgccacaccacagctgtgtaaccacaggtcgaaattccaccttaaatattacaatctagcagtacctcgccggccgaactgggccgcgccctgccgcatgtgggcacttcttcattaagtctattctttggcagctgacacgcgtgctgacaga

SEQ ID NO: 593407 - DNA, 1049 bp, Homo sapiens
gaatagtggccgaggcggcagatgagacggcgtaaaccgggtctgtcatagcggctgcagcgtctggagagcccgagggcaacactggccctgggccagcatcgtgtgtgcgcccccgacagagagccggggccccaagtgcccgccggaacaccatgaaaccagcatgacacgttgcttggcacaaaaagcggcatctactgaccaaattggttggacagaaggtaccacccagagaattgaagcatctaccattatcccagacaaaagggggtgaacaatcaatggaacaggagaagcctaggggacagccaggggaaaaacgacacaggggcctcgttgaaacagaggccttgagtgggacataacatgcactaagcacatcgacaatagagaaacagaccaaaggggacaattacgaggtgcccccactggcaaacaaaccgcgggaacttacgagggaacgtcccatatagcgactgcggcgcaaatggcaaacatggaacatacagacggaaacaggccacagccgaatgaggagccccaagggagaaataaccacgagggaccacaaaacaccgggaacaaacacgacagaggaacaccgaagggagacatagaacgcgacacgatgagagacccaaccaaaattaggtcccagcacagagctgggaccaaaaccacgagagaacaatagaccacccaaaggaaaacacatcagagaccggcagaaaatggacgctacggccagcaggaacagccgagagacataaacaccagagaagccaccacaaacgagcaacaaaggaaaaagacggaaagagcaaacactaaccccatgagggcataggcaccaccagagcaggtcacacaccagaagacaaacaaggagggacaataccaactaaccaaaaaagggtgcacaccgtataaccaacacaccacgaagaaagatacaacgcgcagggaaagggacagcacactgagacggacgaccacgattacaaacgcggcttactaacacgcaagaggagtaaacagctcagcca

SEQ ID NO: 593408 - DNA, 296 bp, Homo sapiens
gctttacacgggacatgctgtttacttttccagagtcgtaatctcctccgtcctttgtgcctaagaacaactatgtcagcgttatctattgtcatacgctttctcctgtctagtcttaaaagacgcagattctttcacttacgtgcaggaagaacaggaacccagccattccatgacaaacagacaggatgtgaggactactaagggttgaattgagtccacctgtgttacattgaagtcctaaccgccagtacctgtgatcatgaccctattacaaatagggctgctacagatgg

SEQ ID NO: 593409 - DNA, 332 bp, Homo sapiens
caaacttctggtaggactcaaactgacttgtcccacttggaggcccaggattgggcctgaggtaccgagcactgcacactgggggcctgggaccaagctgggtgtccagcaaggatgacgcgaatagccagtcagcatgttgctgctggcagcctgtgcctttgtcagctcttcttatacaaaggaccccagcgaaagatcgcatttcacccccaacattcggcactagagggacatcgggggcaagtatgcagtggggccgtaacaatatggtggccaccctaccatgagagtcagccgaaggggaccccagatctccttgatgcctctga

SEQ ID NO: 593410 - DNA, 997 bp, Homo sapiens
ggtgggccgattcgcgcgcccgtccgtcgccgccggcgccgagcgctagaccccatcgggtcttgctatgtcgagcttcacccgtgaatagcgtcagaggatgtgagtccgcgtcttggaccagtctcaatatgcagtttcacgcgatcgatggatggcctgacaatcgggacgtacttccactgccatcgtacgagtacaagtccgccaggatgctatcagcaacccgtccctgatcctggccgcagtcactatgattgcccggcatatagccatggcagcttgcagtggcagtgaggcagacttgcgcgtatgggccagggatatgcttgggctggtgtcatcgcagaggaccaaggaattaaaaaagtgctattagattaacactttttggtgttgttcggcagcatggaaactagtacagaagattccgggccgagtatccacagaagtagacgcaaggggtctccttgtgatcaaggatgcgatggttggcctcgagccaggcggcgttcagtcgagctctacgaaggaagctggtgatcagctaggaccggaattcttcatgaagctgtcatcaagcgtgggaaggaagttcaggctggaaccggagctcgaggagcagcactggaatccacttgggacgatgacgttacctcttcttccttcgcccaggcttgtggcctgttgccgaggcgggtgttgaccctcattcttccccataaggtcgggcgcaatccttgactggggcatgctggcaaacaatgcgacggagacgtcgtatggagcccttggaagacccttggggtacaacaggtgtcactaaggatcgacaagtagtacaaggaagttcagttacacagacagtggtcattgtgggcctctttcggaaacaggggcgagataaatgcatgggccggtggggattcctaaacattaagccaggctcggggaagcttgtgtatgaaggccacgtggtgcatgttttagcaaggga

SEQ ID NO: 593411 - DNA, 159 bp, Homo sapiens
ttcttctgacccaccccacaacaggcctggcgtgtgatgttccccattccatgtgtccatgtgttctcattgttcaggtcccacctaccgttttgccacataggtgatgaaaggggaggacaagggcacaggatgaccctagcctctagattggctcca

SEQ ID NO: 593412 - DNA, 113 bp, Homo sapiens
aaaaactctacctctctatactaatctgcacttatgactccctaaagccatgtcgaagccccgatcgctcggggaatagtactttccgcagtactcttgaaactaggcgctat

SEQ ID NO: 593413 - DNA, 1268 bp, Homo sapiens
  misc_feature (625)..(625): n is a, c, g, or t
  misc_feature (658)..(658): n is a, c, g, or t
ctgaactataggcatcacatttactgcgtcatctggatatagcactactatgagagcacaaatgtgctactaaatgatctgtgctaattatcacattgcatgggagctcgtaacatgcagcctaatctacttgattgataaccagtcatatccttgcagcagctgagtgtctgtataatgtccaccattggccagcatattatactcacagtacggtactattacaaagatgactctacagtttacactgaatatgaacatgcagaagtatatgcatgtataatatatgttgtatacagcttttgctagaaatgatagttatggcattagcttttattcatctagaggtgacattagccagcttatactaaacattagctatcgcatatctaagcataaacggagccatgaaatttattcgagactgcaaaccttgttgcataaggtaagtaaacatgtggacctatataccttaatgcattctttatttgaaaggcattgaaatagagagctctctcagtgaaagcaaagaatctctgtattttagaacactctacttctcgcaaacagggttgagataattgccatgtgaaagaggcattctatgtagaatggcctgtagtangtaatggtaactagctgctaataccataggatnataaactttatttttaacactttctggcagagcttttctggatctctttgaactaaagcattaatgcattcagttcttaacttgaagatggacttttaatagaagaatggtaactgtggaacacttgcagaagagtggagtcacagttctaaaccatccttttagagtacctatgccttatggaggtgtaaggcttgcctaaagttcataaagtcccaaacttaattttaaagattccccgggattcccatttacattttctgaaccggtaaatcttcccttaatccagtctcgcggaatttaacgtggcctccgtttgctcacttggcaactgctcggcctattttcacgcctactctcgccgctcttctcctctcctaacctcccccttccccctctattcttccacgcgtccctactcccctctctccacttgtctcataccctcctgccacttctcaccgtgccccgccactggcatcctaactctgccgaacacatctaacatctttcctcttcccatcctcctctcccgcctgttcctctccactccacttctcgtcaccgtcgtcctcctcctcgcgctctctcgatcacccttcatccttcc

SEQ ID NO: 593414 - DNA, 419 bp, Homo sapiens
  misc_feature (166)..(166): n is a, c, g, or t
  misc_feature (259)..(259): n is a, c, g, or t
catggtgtccaggaatgtgatggacaagcatattgtgagtgagctgaaaagttaggatattgtgaactcaaaccatggacggatcacatcccaagagagcgacagctcagggagagggagagggtgcctggtaggctgaggggtggaacacacttttccatcagcncaaggtaacgcaggcacaggcagcctgtttactgtgtgtgtgtgtttggaaactgtgacctggctgcctggaatgctctttgctgcttacagntcccccaaatcccgtctcccgctggggccaatgcttaactcacccgagggctgcactccagacttcgcagagcagcttcttgggcattagcttatcgtttaatccccagcacaacccagggagtatttcctctttatttttttgatacggagtctcgctc

SEQ ID NO: 593415 - DNA, 173 bp, Homo sapiens
gtctagaggaccgtgcatcctcgacaggagattgagtagatagaacgactggattactcggtctgaactcagatagtagactttatcgttgacaaacgaactttataaggtgtgccatgggatgtccggatccaacatcgagtcgtaaccctattgttgatatggactctaga

SEQ ID NO: 593416 - DNA, 120 bp, Homo sapiens
atttatagtagcaaaaaacctaaattctataagattgcattaaaggaaagatatattctattttgctcacttgggcttcctgggacttcaactgccctccaggggttactttagggccgg

SEQ ID NO: 593417 - DNA, 254 bp, Homo sapiens
ccctgcccccctttcctaaggattgctgcaaaagttacctgttgagcaggattgactggggatgtttcattttgaccttgtcccaagctctccatctttagatttggggactgactgttgagctgatggggaaaaaaaagctttcccccaaaccggaagccaaatgtcccctatttcttgaatgatcaagtcccttttggcaacatccaggtgaatataaaaacttaataaagctgtggaaagggaaaaaaaaa

SEQ ID NO: 593418 - DNA, 448 bp, Homo sapiens
aggagttcgagaccagcctgggcaacacagggagactctgtctctacaaaaaataaaaataaaaaattaccctggtgtggtggcacacgcctattttcccagctacttgggaggccaaggtgggaggatcgcttgagcctgggagatcaaggctgcagtgagccataatgacttactccagcctaggcaacaaagcaagactctgtatattaaaaaaattgtacacacacacacacaaatggccagaaaaacaccgtgaaaaggtgctcaacatcattagtcggtgttaagtacaaatcaaaacctcaatgaaatagcacttcacacccactgggattgttgtaattaaaacaaaaaaagtcttggtgaggatgtgggaagattgcaacctatgcattgccagtaggaatgtaaatggtgcacttctttggaaaacagtttgggaatt

SEQ ID NO: 593419 - DNA, 1260 bp, Homo sapiens
ggtccagctgagacggccttggccgtactctagcagctcaggtcctgctgtacatcactgaatatagcaagagcaccatccagagaaaggatctagttccatcgggattgtgcccactcatcacgagcatcatgatgaacgagggcattcaggagacatagcagcctgaaagcggaaagaggggacatgtgcagtattcacggaaggtgcatgtgtgctacatggcgtgaataccgcaaccatgtgtggctattgccaatgcgatcagagctcagccatgcgcgacccgttcgcctgatcaccaacggtcacaggtacgtcttccgaaatctagacgaatggggagccaggtgattgtacagggtgactccagcgtgttctgacggtggtcagcttggattgtgccaacacttgagggacacgtgagcggacgcattcacgtgtgcatacaccctggcacttcgaagtccgatggaccactacgaggcggtgaatccaagaggtgactttcaaccgaggtagatgattgcatgttgttataacgcgagggagtacaagcgtggctgagtacagcaccttagtaccttagcgttccgccaagcaacaggcaagatgggggacggatcgggcgcagtggggatacgcacgatcgggggaagataccgaatgcttagcgtcgtctcgtttaagttacacacaatgtgggcttcacggagagcacatagcttgaggaggtcaagagcagaacccacgttccatcgtgcaacgtgggtcgaagtgtcgtcttagtgagtggattgttccaccacaacaggacagtacttgcaggggcagcgaatagcgcaggcgactgtcactttgctccactaagagaacttcaaccctttaatttgcctcgaaaggtccagaaaagcttcaccccggaaacgaactccgggccattgaagaaacgccaggggttcaactattaatggcagttggaacgtcgaacgtgcatgtaaaagatcaacaacacatgggaatcataggcaggttctccccaacataagatccccagactggcatccaacgggagaaagaaaccaaggctatggcaccaggcgataaggcgtgagagactttcacaaagcatcgaaggatctaatatcacagagaagattagaaatagaatacaccccctgatctagtaacatgtggggcctattaaccacctcggttggaaagagttgattgaagcactggtagaattatctaaacaaa

SEQ ID NO: 593420 - DNA, 127 bp, Homo sapiens
cctcgtgttggcggccggctgaggagttcctgacccagagctcagcccttctacttctttatgaatggtgaccgcatcgactccctgctggggaacgaccggcagcagacgcacatgctgtacggca

SEQ ID NO: 593421 - DNA, 1733 bp, Homo sapiens
  misc_feature (1)..(1): n is a, c, g, or t
nagtatgtgcctctcccgctgttgtgccgtcctggttttctttcttttgttgttatgttagctttcacgccacgtgcggccctttttgtgtgatgtaaaatatagataggatgggatctggcatctgttctgcctggctttttgtgtgtctcatggagatacgtgtgtgtttgtgaaccaccacacccagagggtggttgcttcattgagacgcccgcccctagagagggtccgcccaacttcttttggggtggtgtgcgtccctcctgccgcccgcactatgtagatgcgacgcaggtgcttggtttttattctgttttgatgtaataagctgccagctgtgtggcgtcttgtctgtgtaagtaatgacagcgttgtagggggaggatgctaccgcaccctccctaatcactaacgaagacagggaagtggtcgatctcgtcagagaggagcaggctctctcctgcattggcgttgatggttcgatgcacagcactacattatatgccgccactcccattaatagtgaggccatggatggatgtaatggtgatagtgaaagtcttcctctccttggtgatggagggtgtgcaccttctctggttgttggtttgtgggtgagccaccccccgcgagaggttcctccggcaagtatgctaatatgtaggaagtagtagggggatctttttgtctcgagttcgtgaagcaacaacagaaaatgatgggggtgttggatacataccagagttggtgcgatcctccatccaatccatcctggcagtaattagatgtatggtagcacccaccatacccctcacttctgtgtgtgagctaccttccttttgtccagtagtgctctccatcagcatgtagtatagttgtgtatgacaacaaccacgccgggttgtcgacaaccaacaacaaccacctgttgtggggttgtggcgaggagaagacaacaacacaagagtgagagagtctgctccacagctactgcttgtggtggtggggtggagatgttgtggagacacaacacaacacaacaaccgttgtgggatgtgtcgcacttctgttcggagcagacttgctggggtgtggtgttgtcttgatgtagtctggtcccctctgcgcccctcgtgtgtgatgtcgcgtgattatatagtttggtgagagatgtccaccctcgtgatgtctgcgcgactgtgagttgcaacacaggggagataaagggcaacacagagactgctgggaagactctgtgtgagagtggcacacacactagagatatagagctcatcgagcaacgccaacacatcggtttgcgcgctcgtggcacaacacacacgcggtggagaactctcgcggataagacacacacagggcgcgctctgtggcgctatagactcttgtggttggtaagacctctatctcacgcgaagaccacacttgtgatacacactggtgcaccagaaatatcgcagtgtagaaatctcgccacgcgtcacacatgtgggagtgtgacacagaggtccatgggggtctcttatagagtcttgttgggcgtctggtattctcccacagagcgtctgaataagagcacacaaggaggcggtataagagaaacactgtgcaccacgttaacgtgtgggttctaaatgtgaccactgtgtgtagatttgtcttggtacacatataaaagttagttgaaagtaataccaaaggttccggccagc

SEQ ID NO: 593422 - DNA, 230 bp, Homo sapiens
tgtaaatacagctggtgataacagctttgaaggaagtaagctgttgtgatggaaagagggaaaggcccactttaggttggttggactggaaaggcatctctgaagaggtggaatttgaacagagatttaaaggatgaaaaaggaacagtcatacgaggattttgagaaagagcatccggatagtggcataattgctgtgagccaccgcacctggctttatcgttctttaa

SEQ ID NO: 593423 - DNA, 514 bp, Homo sapiens
ggacctgcatactgggcgtatgggggcaggatggaagacagtgtgtggcacagaaattcctgtccatccaccatcagtgctgctcgctgatgtggtgctttaggtgtgagtggtcccgaaccttggcccagtgctttgtcccaggccagagtcttggtaatgccacatgctggcaggtttctcactgagaaggtcctagcttatccttgtgtgctggccttggattcaggccccgtgagaggggagagaccgattcctcctgtggagtgggttccttatcaccagaccggccactctcagaactggcgtccactgtaaatccaggtgccttacgtgtggctctgtcccttatgctgcaggggaaagctgcattgccattgttcccacctcctcactggcagaaagatgccagggctgttagcactgtctcctcaccttctgtttctcattgtggctcctcaaatgggatttgcatgttcctgtcaagcgtaacaacaatcccttctctctttga

SEQ ID NO: 593424 - DNA, 133 bp, Homo sapiens
tatgagttgtgggactgacccattccatgtgcagtgagggctggagcctctgttctgctgtggctgagctcccagagtctgaggaggagcgcagttgcctcgctacagacacacaccagccctcctgggccag

SEQ ID NO: 593425 - DNA, 1043 bp, Homo sapiens
tttttaataaggggacccaatgcaacctttttaattcaaaggagagtccccctcccccagattagggtcccaaacacgggggaaagggatggcagggtggggggaggagcaaaacccaaaatcggggcaaaaaatatggatacttacttatattacaccgggtgtcgcgtgaacagcaagctcaagcggggcgggagtaaggatagggcctaggaggcgaggttgaggaaagccagcggggggggccccaataaattaacctttcttgagaaaacgcataggggtggtgggggggtgcgtggtgatgataggtagaaagctggctagccaggggccacctccccaaaatggtgccaggccgttggctcttgtgacccccattaccagagggagggggggaagggccacagatattcggaccgcggggtgaccgggccatatagggcgcgtgggaatccccacaattcatcggagggccgctggaggcacaggtggtgagggagactccggagatcgcggagtgttaggcgggggagattcttccaacgcacataacgaacccacaggtacttttctggggagaacaccgcaaggggctgtggaaaccacaaaacgggtctgagagcaaagcccctccgggggttatgagcagaacgcggacgaggtttcaggggcaacgacgatgcaagtgtgtgaggggtggaacccaacccccgggcgagagagctccgaaccacggggagccgtgtgttcccccaatataaaaaggtcacgaagcgaaacccggagagtctgcaacgatgcaccgagacaaacgcttgtcacacaggaataggacacattggcgacaagcgccgttggggtgtgggcagaaccaacacacagatcgtgtgaaaagactctgtggccatacatcatattagaagaaagcacccgaggatcattggtaacccaaaaaagggggggcaccactcaacacagcctcactatagagaaccccaggagcccagcacagtgggtaaatgaacaggttccacaatcga

SEQ ID NO: 593426 - DNA, 779 bp, Homo sapiens
  misc_feature (193)..(193): n is a, c, g, or t
  misc_feature (450)..(450): n is a, c, g, or t
  misc_feature (457)..(457): n is a, c, g, or t
  misc_feature (460)..(460): n is a, c, g, or t
  misc_feature (464)..(464): n is a, c, g, or t
  misc_feature (470)..(470): n is a, c, g, or t
  misc_feature (472)..(472): n is a, c, g, or t
  misc_feature (480)..(480): n is a, c, g, or t
  misc_feature (486)..(486): n is a, c, g, or t
  misc_feature (498)..(498): n is a, c, g, or t
  misc_feature (500)..(500): n is a, c, g, or t
  misc_feature (545)..(546): n is a, c, g, or t
  misc_feature (549)..(549): n is a, c, g, or t
  misc_feature (560)..(560): n is a, c, g, or t
  misc_feature (564)..(564): n is a, c, g, or t
  misc_feature (567)..(567): n is a, c, g, or t
  misc_feature (597)..(597): n is a, c, g, or t
ggcgcggcccaggactcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcgagtggttgatggcgccttcaaagaggtgaagactgtcggactacnaagggaagtacgtggtcctctttttctaccctctggacttcacttttgtgtgccccaccgagatcatcgcgtcaacgaaccgtggcaagaggactttcgcaaggctgggctgtgaagtgctgggcgtctcggtggactctcagttcacccacctggcttggatcaacaccccccggaaagagggaggcttgggccccctgaacatccccctgcttgctgatctgaccagacgcttgtctgaggattacggcgtgctngaaaacnagntganggcatngnctacgggngcctcnatatcatcgatngncaaggtgtccttcgcgagatcactgttatgatttgcctgtggganngcnccgtggatgangccntgnggttggccaggccttcagtacacagacgancatagtggaaagtttggcgccgcgtgagctggagagccttggcagatgacacgattaaggcccagttgtggtctgacccggctagggcattatttctcgcagacagcagtcagggtgggtaaccggatagtgcggcttgtgcccttgcctatgttcctgtggctgggtgtccccctggtccc

SEQ ID NO: 593427 - DNA, 1001 bp, Homo sapiens
  misc_feature (265)..(265): n is a, c, g, or t
  misc_feature (486)..(486): n is a, c, g, or t
ggacctagaatgcgctcgacggtctgtggccacacagcccctgtgctaaacatcgtctggtgcccgcacattggacaacgtcatttggcctattggctccttaggacatgcgatcagttcgatggatgtgggagatcccgcgtatgggtggcctgattgctgcttcctgcggtaagctcccgtccggtcaccgctgagagggccgacacctagccgctgtgtcgtggctatttgtcgtcctttaggcgtcttcccactatgcccnagaagcgttgcttgctcctagtcgcagagtcgcttggctgagtcagtgcaagaggggcttctgggcgggtgcgcctcggtcgttcgtggtcgttgtgttccgggctgcgcggctcttggcgttcttgactctgtgggcggttgagtagtggaggttgctgggcaactgttgatcactggtgtgtggactgttgtggtctctggtggccggtcatgtcatgnacttgctgggcccagaagtgatgggacactgatgaaatgcctgtattctaccagtgatggaagctgtgcacgcccgacgtactgtgaggtgctcactttgttcccctgctgtccgctgacgggctgccgctgctgccatgagtccggacgcccctgggaagggggcactggtacggtcgtcgtagtacgagggggatccggtacccccatcccatggggggaacccggccactgctggtggttgcaggttgtttcgctggctcaggaatgtggcgaacccacttcgtagcatcctgttcgcgctttctcggctcccgccattgaacgcttgatccgtgcgaagtgattgtgcgcgtagtcgagggactcccaccgtgacgtttcgctagggggccattcgtagagtcctacggggccccctctgtgctggtcctccttccagttgtctcgttcctgtcccttgcctctttcgcttcacgttggcccatgattggcgtcctgctccagtttgcccg

SEQ ID NO: 593428 - DNA, 140 bp, Homo sapiens
tgctgcgtgactctaaggatcccccaatgataatcgctgtctgacatttaccctgcgcgataacgcccgctggtccgacggaacgccggtaacggcggaggatttcgtctatagctggcggcggctggttgatcctaaaa

SEQ ID NO: 593429 - DNA, 646 bp, Homo sapiens
agcggcgcgggcggtgagagtgcccggcggtccatgcatccgctcgccgcccggcgccgcgatggatttcagtcagaacagcctgttcggttacatggaggacctgctggagctcaccatcatcgagaggccggtccgccagtgagtcctcatatgactaccggcaagaaatatgaaacgatttgacagtccgatgaacgacctcagtgactattgaaacgggcttgtttatctgtctcagtgctgtgtcaagatgtccaaaggaacaagtagtcattgcaatatctccgcattttgtgatgcgacgagaatcccactggagacgcttcggagagtgttgccaaaaggtcacgaacatcatgccatgtttcaaatggaattaggcccacgatagtaccaggttatatgttaaacgtttccaaatttcctgtgatactatagctgacctactagcttgtcatgcatgacacctgtgacagtgccatgttaaacaatatgcagacaatggaatcaggcaggcactgttcgaagcactgggaacaatagaagtgaacaaaagatgggggacttgccctcaaggcatgaggctacagtccagatggagaaagcagacattacacaagtaatccctcctcacccaagtaag

SEQ ID NO: 593430 - DNA, 260 bp, Homo sapiens
gagcggaccccgcagtgaggctggatctggtgacatctgtcacattcattcccatgcggtggcgaactttctgtcgcagctggtgtgatctggcatggacgccgtggtctgtgtttcttgccttcttgcagacgatatttcctagctgcaggaccgatgataccaccttcgctatggatcgctgctcctcctcgctgaaaaccattattgccatggcctccacagtttcctggaacatctcatcatcctgggccagctgg

SEQ ID NO: 593431 - DNA, 461 bp, Homo sapiens
gctgcatgtctgatctcttgaggatcccccatgctgcaccgagggtcaaacacccagcctgagtcgacgcaagctttctcgcggtagcggcaagctttgcgttggcgggcgtgtcggctgatcgactgttcatgacctggccccgaccagagcccggttcgggctgcgtcctcggtcgctgaatacatggggctctacacgccccagaccctggaaaatctcagcactgacgccgactcccatatcgcccaactcagttcggtcgggagccaagtcgggctgccgttgagcccggatgcagtgcacctgcccggtgccgaatttcgccgggcacaaatccttgattatgacggggtaatgatcggccaactgacttatctcgacgcgcggaacggccccgtggcgctgtgcattacggcggcgaaaaaaggtgcggtgcgcatggccaccagaacagggcc

SEQ ID NO: 593432 - DNA, 409 bp, Homo sapiens
  misc_feature (188)..(188): n is a, c, g, or t
  misc_feature (203)..(203): n is a, c, g, or t
  misc_feature (209)..(209): n is a, c, g, or t
  misc_feature (212)..(212): n is a, c, g, or t
  misc_feature (224)..(224): n is a, c, g, or t
  misc_feature (231)..(231): n is a, c, g, or t
ttaacccctcattgttattatgattgatttcttccaccagactttgaactccatgagggcgctaatgtctttctatgcccccagaaccaagcatggtacctgacagattaggccactgagaaaaaatggacactttctttcgatttatctatttcgtcttttgagagcatctttccataacgaaatantctgacatctctgcnaacagntgncaatctgacatncaccggntatttatattctttgtaaaaaagagactgggtgtgggtgtcacgcctgtaatcccagcgctattggagccgagggcggaggatcgcttgaacccaggagtttgagatcactatattattttaatacagtgggacctcgtcgctacaataataataataataagaataagaataagaat

SEQ ID NO: 593433 - DNA, 244 bp, Homo sapiens
  misc_feature (184)..(184): n is a, c, g, or t
ggcacgagccgagtagctgagactacaggcacctgccaccatacccagctaagttatgtatttttagtagagatggagtttcaccatgttggccaggctggtctcaaactcctgacctcaggtgatccacctgcctcagcctcccaaagtgctgggattacaggcatgagtcattgctcccagncattagaaagattgttaatcctatggaactccctttttgtaggagagaaagggccaatct

SEQ ID NO: 593434 - DNA, 813 bp, Homo sapiens
  misc_feature (303)..(303): n is a, c, g, or t
ggactctcttcacccttcggcgtggttgcggacccccaccccctggctattccgccgcaccgccgcttcgcgcacggtacccaggccgctgaggacgactctccctgcggtgcaccccacggggtgtctgaaggaccccccacccgttggtggggcacccccacgctaggacgtcacttttttgccttctatttgtttagccttatatacggacaaacagtgcgcagagtactattgtgtcgcagactctttttcttcgctataaatacattgggcttgtgcgttgaagtaggattcaaacangtcaatacagcgagtcctattttttccctccctacctgtcgcacataaaacaatgtgggtctctatacccacaaacacccttcaaactgcaccccgctcccataataccccccactctattcgccagatacccccttcacttaggatcggaacatctgtgtagagagttgcggccagccctttctcccaccactccccatatgaaacagtctgttttatacaggcatttctcctctctcctttcggctcatgatgtttcccacccctcctctcacccttctgacgaagcatgcccgctccacgacccttgtcttatggctccctccacttcttcatcccatcaacacggtgccacacatctcttgatgtttatatgtcattattgtctttgagaaccacacttcagagcaggggtctcctctttaaaagcccacatgatatttagtccgctttttcccctagagcccgccactaaaatcaacaattacttccccccactaatcaaaacgc

SEQ ID NO: 593435 - DNA, 166 bp, Homo sapiens
tgctaggattacaggtgtgagccaccacatctagccaggaatatttatgttctacctgctgtaagaaaagcctacccaaaagtcaattctgtatgtcaattaatttttttgttgatggagagggagtagtttcaaggaaaagtgaattcagcagattctttactga

SEQ ID NO: 593436 - DNA, 375 bp, Homo sapiens
taaaagaagggcttctcttccgcttgcttggtgggattgcatgctggctttcctggaagtcacttgataacaaccgttaatgataacttaaaaaagaaatggactcagtaaatttgccataggaatgattccacagaaatcacaagccgggcgtggtggctcatgcctgtaatcccagcattttgggaggcccgaggcgggtggatcacctgaggtcgggagttcggagaccagcctgaccaacatggagaaactccatctctactaaaaatacaaaattagctgggtgtggtggcgcatgctgtaatcccagctacttgggaaggctgaggcaggagaatcacttgaacccgggaggcggaggttgctgtgagc

SEQ ID NO: 593437 - DNA, 184 bp, Homo sapiens
ttgctattcgtgcaagttgactcctatgaggaatcaccgccaagggtggcgtggatcatgaggtcaggagttcgagatgaggctggccaatatggtaaaaccctgtctctactaaaaatacaaaaaattggccgggcatgccggcacgtgcctgtagtcccaggctgcgtcgggagggcttggg

SEQ ID NO: 593438 - DNA, 354 bp, Homo sapiens
aggcaaggatgaatagatgaaacatagaagatttttaaaggagtgtaactattctatatgatactgtcatggtggctatatgtacataaatacattagacatttgtcaaaactcatagaatgtataataccaagagcaaactctaatgtaaactacggactttggataataatgatacatcagtgtaggttcattgattgtagcaaatgcaccactctggtatgggatgttgatagtggggaggccatatgtgtaggggtagggggtgtgtgggaactgtctgtactttcatctcaatttagctgtgaatctaaaaaagctctaaaaaaataaaatccattttttaaaaaccta

SEQ ID NO: 593439 - DNA, 235 bp, Homo sapiens
gtggggctcagcagattgacgccattcaaactgcctgctgctaccggggaactgctgagaataaaattagccatctcgtgctgggcgcagtggctcatgtaaattagcatgtactacgatctaataaaaattttccaaagctaactgaatgtcagaatattacccagtgtattgattctccaggggtggggctcagcagattctgacgccaattcaaactgcctggagtgtcgag

SEQ ID NO: 593440 - DNA, 322 bp, Homo sapiens
cgtcgactgaatgtggctgcccttgcatttggaatcacataagagttttgccagtggtggtggcccacgcctataatcccagcatgtagacagccccacctgccacaacaagatcaaagatcttctccatcaacgatatagttctgggaaagtccctaaatgtgctaaccttgcctattggctgctctagttttgctctggcttgagtgttcttgctatcctgtcaatctaggatgtggattttgtgattaaaagctcaccctgatggaattgcaaataggtcccaaacagcctggccaggtaatgaagactttgtcgacgc

SEQ ID NO: 593441 - DNA, 504 bp, Homo sapiens
aagtaggtaggtcagcccgagggtatgccctggttcacaccatatggaatttcctagtcccttacagcatgaaagatgtggcgtatatctcagaattaaaacacaaaaaggataacaaattaggcttgagttctccaccagccagtgtgtgcaaggatttccgggacacgattctcacggacaactactgagaattatcacaaagaggacaggtcactcgtgtgacgaatgcgtctacttcaaaggagccaggaagaattaagaggtgaggtgaaagatgggtcccccaggctcgtacaccaggcacagaatgcttgcctgctgactctggagtctgctccaccaagtatcgggcaaaggcctgctccatcttcactgtgataagatcactgtggagtatggctggagccatggctcctcttcccagcaaattccagtttaacctggaacttcggtaccaactcagtataaggggcaccgaggctcgaattcggaactccatgg

SEQ ID NO: 593442 - DNA, 307 bp, Homo sapiens
aggatcctctagctcccaacaagatgagctgcagcccccctagagagagctctgcactgtcaccaatgtaaccaggcccagcctccaggccccaactccgccagcctctccccgctctggatcctgcactccaacactcgaactctgctgctcatggggaagaacagaatttgctcctgcatgcacctaatttcaataaaactgtcttgttggggagcttgctcccaacaaggatcaaccaaacaacttcccatataatctctctatgcctgtttcctacatagtaataaaattgggatgtaaccag

SEQ ID NO: 593443 - DNA, 261 bp, Homo sapiens
cggactaacctcaccctaggcccctgtgccaagtttgtctgccgcaccagccacatcctcaatgggcaggtctttgcctcctctggccggctccttgctgctcctgtcatagtgagcttgtgccgtccccctaggatggggggcatggccctggctgccaaatgcccacagcaccctggcatgacctgccacctctgcttccacaccggagccagctacctttcctgtgcctgccactcaataaacagtgtttgcgcccca

SEQ ID NO: 593444 - DNA, 111 bp, Homo sapiens
  misc_feature (104)..(104): n is a, c, g, or t
agagacacagtatcagactcaggacttcaggagcccttacttggttttgatcaggtgtagcaaattagggatgaagagttcaaacctttgggccctttctttcnttttcat

SEQ ID NO: 593445 - DNA, 294 bp, Homo sapiens
gcggggcttggacgggattgtggcggtcctcctcccaattcggaagctacgctacctccggacgctctcaagatggcgacctcctgggttccaacacctacacaggcagaactgggaggatgcggacttcccattctgtgccagacatgtcttggagaaaacccatattcgaatgaccaaagaaaagtatggaaggaatgcaaatctgtgccaggccattcacagtgtttcgctggtgcctggagtccgcatgggtttcaagaagactgaagtgtgccaaacctgcagtaaatt

SEQ ID NO: 593446 - DNA, 196 bp, Homo sapiens
gcggtggaataagcactgattactacgtgaaaactgatgggtaccatagctgacaagtagaatactttgagatgggtgtgtcgatggctgatgtgatacttcagttcttatcttctttttcctttttttttgagacagagtctcatgaccagactggagtgcagtgatgcaatcttggctaggctcactagcagcc

SEQ ID NO: 593447 - DNA, 957 bp, Homo sapiens
  misc_feature (1)..(1): n is a, c, g, or t
  misc_feature (372)..(372): n is a, c, g, or t
  misc_feature (742)..(742): n is a, c, g, or t
ntatgtggtggtccccccccctggtggtgctgactgtgagtacacactggttgccgcctttttgaggagtagtgatatggtgtgggggttgttcccccccccctccgtgttgtggggcgagggtgttccgcctctctgtgttgttgttgggggcgccgctcatagaccacccacaccacagggcgcgtcttgtgttgtgtttttgctgcacaccacaccccctcttctcccgcctcccgtcaacgttttgccctcgtgggtgttcgccacactgtgtgtcgctctatgaggcccgctctcgcgcccgcctgcggcgacgtctctctgtgtgaggagacgacagacgcttctgctcttagatgagagagacgncacacagtggggcgcccccaccacctgtgtgtgtctctcacacaccccctctgagagagatatatttgtgtgggagagacacacacgtgttctcacacacgcgccacgcagagagatctctctctgtgagacacatgtgtgtctctctctctcttgagatatctctctgtgtctcacacactctctcacgtgtctctatttgtctgtatgttctctctctctctgtctgtgtgcccctgctggggcgtctctctgtggaaagatatctctgtgtgtgtgtgtttatcacacccccgcagcgccctcagagagagagtgtgcacaccccgctgtttgtatacacacagctgtgtgagagagaatgtatgtnttctttttttggcccctcggcgcactctcttcgcggagaactctgagtggcgcatctcctcggagaaggggttaatattccctcttttgtggaggttttggtgggggagaagggagagaggggatataagaggtggtttttaaaaaaaaaagggaaaaaagcaaaaatttaaaaaaaaaatgacccccaaattaatttatggggaatttttttta

SEQ ID NO: 593448 - DNA, 810 bp, Homo sapiens
gctgcggcggtggcgggcgggcggcggcgcgtgagacgcgcgatccccggtgtcttgggagcagtgccccgtgccccgccgctcccgccgccgccatgtcgggccggtcggtccgggcggagacccgtatccgggccaaggacgacatcaagaaggtgatggcggccatcgggaaagtgcggaaatgggagaagaagtgggtgacctgtgggtgacacgtccctgaggactatctaagtgggttcctgtgacagacagcaaggagaaagaaaggtcaaaatcgaacagttcagcagcccgagaacctaatggttttccttctgatgcctcagccaattcctctctccttcgttgaattccagggacgaaaacaagcaaccagagttccgtgtctgacggtctatcagcttagaggtggacgggggaggcaccagactcaatgccccagcccccagcagatgtgagtccctgagcccagtacacacctccgacttccggcacggattgactcccagcccccaatgctgggccaggagatcctggaggagccctccctggcctcctcggaaggttgctgatgaaccttccttaccctcacccagggaaagaaccatgttccatctagaagacaccaggtccgttgagtgacgaggaacgactcaggtgccccggccctgaaggcgcttctgtgttggaccaaccaaaagtggccgaaaacggggtcagaaaagttgcaccatccgggcctccgccttctggcctggcgccataatggatctggttctggcggcccagtctgggtaggcagcc

SEQ ID NO: 593449 - DNA, 174 bp, Homo sapiens
agtgaagatcacggtgtcagtggggttggcttccttagaaggcaactctccttggttggtcagtggcatcttctccatgtgtcttcacatggtcttccctatgtgtctgcatcctcatctcctcttcttataagaccactggtcttactggattaggagaccgcgtcaacctcg

SEQ ID NO: 593450 - DNA, 693 bp, Homo sapiens
caggaacacttgagcttctcatgttcaatgtgaataaaccgtcaaatcattctctgtgcagttatttcatgagaattcagcgaaattatgctgtagtgagggtctcatccttattaaacagttaagggaagtagctgacaatctcaccaaagctctatacaattgcagatgagttaattctctaaaagttgactgaggtgctaccgctataaaaaaagaaatggaggcaagacagatatgatcaagagatggtcatattgatgaaacagtatgtcttaaattttgctatgctccgaaatagggaaagttaagagctaccttaaattagaaataactaagtgaacaggtgcctcaggtacatttagtggagcgatgtgtagcagtcgctttcgtcaagtttcgttcccacattattgttcattcccaaatttctcaactctaaaagaatcaactttaaagatagctataattgatcacatccatatcaaatactaataattactttggtccatgtcccctcactcccagattttaacctatataccaggtgcacctatgtgtctcctcattttgagttcaggctcattgaattttaaagaacacttcagaactcagataggcagtaagtttataaaaggccaccttgtctggctcaatatatagaaattttcttctcgctggatactggggatc

SEQ ID NO: 593451 - DNA, 197 bp, Homo sapiens
atccccctccatagtgtgtgcccagactcaagagcagagacttgaccatagctcactgcagccttgaccgcctgggctcaagtgatggtcttgcctcagccttctgaggagctgggatgactggtttgtgccaccattcctggctaatttttaactttttttaaaatttttatttttgtaaaaacagggtcttgctc

SEQ ID NO: 593452 - DNA, 131 bp, Homo sapiens
  misc_feature (91)..(91): n is a, c, g, or t
gacagacggcggcgacggcggcgggaggcgggacactccccccctccggcgactggaggcgggacacctccccggcggcctcgtgtcgcgnccgctctctccccgcgctgaggctgcggaccgtttttttt

SEQ ID NO: 593453 - DNA, 159 bp, Homo sapiens
gacccagcagttatacagactcagcagatcgcgtagtgtctggctgcatggttaattagagactagaaatttgcccctggatagtgcacacacctctatgctagcctcacgaaagtggtaatacgccttcgaaaagaaattgtcctttgaggcttgtat

SEQ ID NO: 593454 - DNA, 367 bp, Homo sapiens
  misc_feature (71)..(75): n is a, c, g, or t
  misc_feature (80)..(81): n is a, c, g, or t
cttatctattcatttcactcaatttcactgccatatttcaagtcatcagtagtctatgtaactgtcttgtnnnnncatannctgtaaaactgaatttattttcacctgaagacttacactctccttatatctgtccattaaaatatcaactcttccagtccatctgaaatagaatgaagtcatctttgacctttgctggttcctttgcacccacatagcttgcattctccccacatctagaataaacttcctccccaccactcaccaactgtgaattactgtcacattggttttcttgaggtttcctgaatatatcacatttctacccaagccagtgcctttgcatacactgtttgctctgcaacga

SEQ ID NO: 593455 - DNA, 461 bp, Homo sapiens
gggtgatctagaggatctcctagtctgatcgttaaaggtgctggttttagttaatctcttcagggatgggagggcctggaagaaaaagatctagctatgttagtagagattcttcacagacgcagattttcccacacaaaggatggcttgcagtgccatttcaagatatggcagaaaaacgtgtttgggggtaaaatatgtggattttcttccttgtgtggtagtgttatgccagagtcagatgggaaagtaagtcacgatatatagaattaaataaaacccatctgatgagaatgtatagttggtagggcacaactctccagaccccttagacaggaattggggcaagattaaaaaatagagcttagtcctctcctcaaaaggacagacacaagagttttgggccttaaagaggagctagagagagagagatcagagtagaaagtctcccacagaaataa

SEQ ID NO: 593456 - DNA, 176 bp, Homo sapiens
gtcactgtcagcgacagacccctcggggtgtccatcacaaaagccgaggtagcccctgaagaagatgaaaggaaaagaggcgacgagaaagaaataagagttgcagctgcaaagtgccgaaacaagaagaaggagaagacggagttcccttcagaaagagtctgagaagcttgaaa

SEQ ID NO: 593457 - DNA, 712 bp, Homo sapiens
tcacccaggctggagctcggctcactgcaacctttgcctccggggttcaagcgattctcctgcctcagcctcctaagtatctgagattacaggcatctgccaacatgcccggctagttttttgtatttttagtagagatggggttttgccatgttggccaggctggtctcgaactccctgacctcaagtgatccacctgtgtcagcctaccaaagtgttgggattacaggtgtgagccactgtgcccggccacttagcaaaaaaaaaaaaaaaaaaaattcctaccatgattcacgaggctgaggggaattgaaaaaaaggttgggtctgggctatgggctgaatttcgtgccaaaggggcagaggcaggagacccagggggatgtggtctgcgccagggaggctcaagggagagagcagaggcagcacctggagctcctgtcccatttgaagttcctctgggggccgcccaattgcccaaacccttggagggctcacacgctgtgttccattcagggatgggtcccctcagagtcacttctcggggccagcaggccattctgtcggggagccccgaggggccgtgcttgtacagtagattgtcccgcatctgtcatttgccctggaaacggctgggtgccttgtgggtacccgagggggacccgccgctcctggcacagtagtccgcatcattttccccaagaacctttac

SEQ ID NO: 593458 - DNA, 352 bp, Homo sapiens
ttggctgaggcagcatctgcaccaacaattccagaagctgctcccactgatacaacaaacacggatgcagttctggtggatgcatttgcattgccacagatccctgcttcatagatttgcaccactcaagcatatcttgtaacaccaacacctattatgggactaggaaatacttatctttccacatttgccacaacagatttaggtttctttcctttctttgaaggaaagtttacttacattgctcttctattttcttccattaagagactcattgcttgggaaatgccttcttcgtactaaaatttgactcctttttctcttatgaaaaacgaactcagtttaaaagtat

SEQ ID NO: 593459 - DNA, 454 bp, Homo sapiens
  misc_feature (65)..(65): n is a, c, g, or t
  misc_feature (142)..(142): n is a, c, g, or t
  misc_feature (186)..(186): n is a, c, g, or t
  misc_feature (198)..(198): n is a, c, g, or t
  misc_feature (230)..(230): n is a, c, g, or t
  misc_feature (258)..(258): n is a, c, g, or t
  misc_feature (293)..(293): n is a, c, g, or t
  misc_feature (300)..(300): n is a, c, g, or t
  misc_feature (398)..(398): n is a, c, g, or t
  misc_feature (401)..(401): n is a, c, g, or t
  misc_feature (422)..(422): n is a, c, g, or t
ttagggggtgtcagcagaggagaaacacaattcagagtgtaagggtatggaccatgtgggttttncatctggtaatggttcaggaagcccagagtctccagggaatcgttcttggattcccactccagaagtccagaggagntgcgctcactttggcctgagaatactttcacagaagatggccgnttcactcccagntcatcgaagatctcaaagaagttctcctcggncacctccagcggggcgtggaagaagtgnagaacgttgttggggtgctggatgcggttcttggntgcctgntctggggtggagaaccgattgttccgggattcactgaagtcttggtaactgaaagaccgtcttccaacccgtttgactgaccaggaatgatggttggntgnttggagacacagacattcagnttctgcccaaacatgaagttgttgttgaggtg

SEQ ID NO: 593460 - DNA, 87 bp, Homo sapiens
  misc_feature (7)..(7): n is a, c, g, or t
  misc_feature (17)..(17): n is a, c, g, or t
gatcatnctgccccatntccacgcacccaaaaccagccctctcgcttctaacacagggcacctgctggggctcagggatgttaggga

SEQ ID NO: 593461 - DNA, 646 bp, Homo sapiens
  misc_feature (36)..(36): n is a, c, g, or t
  misc_feature (101)..(101): n is a, c, g, or t
  misc_feature (105)..(105): n is a, c, g, or t
  misc_feature (153)..(153): n is a, c, g, or t
  misc_feature (175)..(175): n is a, c, g, or t
  misc_feature (242)..(242): n is a, c, g, or t
  misc_feature (286)..(286): n is a, c, g, or t
  misc_feature (319)..(320): n is a, c, g, or t
  misc_feature (337)..(337): n is a, c, g, or t
  misc_feature (373)..(373): n is a, c, g, or t
  misc_feature (408)..(408): n is a, c, g, or t
  misc_feature (435)..(436): n is a, c, g, or t
  misc_feature (439)..(441): n is a, c, g, or t
  misc_feature (469)..(469): n is a, c, g, or t
  misc_feature (493)..(493): n is a, c, g, or t
  misc_feature (507)..(507): n is a, c, g, or t
  misc_feature (520)..(520): n is a, c, g, or t
  misc_feature (533)..(533): n is a, c, g, or t
  misc_feature (541)..(541): n is a, c, g, or t
  misc_feature (567)..(567): n is a, c, g, or t
  misc_feature (614)..(615): n is a, c, g, or t
  misc_feature (630)..(630): n is a, c, g, or t
  misc_feature (634)..(634): n is a, c, g, or t
  misc_feature (646)..(646): n is a, c, g, or t
tgcgcatggggctcttagcctgaatgctctgagggntggccccttagagcaggctcaggggaggtcctgcgccacaagggctttgggcccctccctcaggnagangccaccggctgcgagtggggtccgtggcccttgctgttacatctggcnttggttgaagctcagggagggngagctctcttagggagaactgtggggtggcgtgatgtcgccttgggagggcccttcaggaagttggngtcgggggttggggagtttggtagacccagagacgttctggggncgtcagtgatagtgactaatatttggaggcagnnggtggagctggccccanggttgaggtatcagttagagcagaacaattggaccnagagctggtttttcctttgggtttaggtgtcagtnaactattatcattgttgtggagagctnnttnnngagggttgtgactgtgcagcacgtacanagctgcggggacacagatggtacncattcccagagagngacagaggtaganatgtggctgttcncccatgcncacacacacaatcacgcctgcctgtnggcatgtgtgtcaacacccacatgctcccacagcccacatgcgtggnngtacacagaactgtntgcntccatttgtgcn

SEQ ID NO: 593462 - DNA, 204 bp, Homo sapiens
gccaccggctgccttgcaggtagatgtgggggtcagcgtcagaccctcgtagacagcagagaggatctcctcggctcggatactgtcggcgcttgaagacatggtctccatcagggtggatctcgggctccacgaggggcacaatgcccttgtgctggcggatactggcctttcgggccagatcgttggcatttggcatgatgg

SEQ ID NO: 593463 - DNA, 373 bp, Homo sapiens
  misc_feature (6)..(7): n is a, c, g, or t
  misc_feature (12)..(12): n is a, c, g, or t
  misc_feature (29)..(29): n is a, c, g, or t
  misc_feature (39)..(39): n is a, c, g, or t
  misc_feature (138)..(138): n is a, c, g, or t
  misc_feature (141)..(141): n is a, c, g, or t
  misc_feature (186)..(186): n is a, c, g, or t
  misc_feature (333)..(334): n is a, c, g, or t
gggggnnctcgncattagagtgcacatgncactgagcantgcacacggcacccagtgtgtagtcttttatccctcacccacctctcaatctcccctcctacatccccaaagtccattaaatcactctgtatgtctttnggncctcatagcttagcttccacttataagtgagaacatatggtattnggttttccattgcttcacttagaataatggcctccagcttcatctaggttgctgcaaaagacattatttggttcctttttatggctgagtagtattccatggtgtatagatatcacatttttcattatccactagtgcttctctttnnaacctcaaccctgagccaccctctgtctgagcttcatgc

SEQ ID NO: 593464 - DNA, 909 bp, Homo sapiens
atgcaacacacgatggggacgaaaacggggagaagatccttgcgggaaaaagcgcccgtcgccttctctggtggagaacggcctccccccagccagagctctttgtgcccgagagaccaccccagggggggtttggagccccccgccccaccgagagggtgggaagcgggcccccccccccctgggtcaaaacacaaggcggtcttcccccgccgaatgtaacccccgggggccacggggtccgcccaacgaaagggccccaaatgcgcgcccattccgccccgcgctccgaatagactccgccgtcgccccacgccccccgtttggtgggatttgggggccccacccccggcggcctccaacgggtgggccgtttacacgttgcgaccggcccgcccccccatgggttcgcacggccgggaccctttgcccacagcgattacaccagagaagctctgttcgttcccggacctgttggcaatatccccctgcggcttcttcaccagggcgccgggtgcatcttctcccgtggcccccagagctggtgctcccggtgagatgttatcgccacgcgggcgcgctttgtaatcatcctggaacttgtggtaaggggcacggtggcaatccgtgggccctttctcgacggcgaccctagtgacgcacaggcccccccctgaagaacgagtctaatcaaggaggctttgggcgcacaatcaagcctggcccgcggcagtgtatgggacgatacgacgccacaaccactcacgtggcgtaggaaacgtatacaacccgcactggctggacagggaccattgtcacccttggtttgctgctttacaaattcttttccccctaattttaaaaaatagtttcccccccccacaaacaaaaaaaacagacacatagaaa

SEQ ID NO: 593465 - DNA, 171 bp, Homo sapiens
gtttgggctgtcgttgcactgagagccgtgccagctcgcacggtctcgagtgagagcgcagagtagccctgagacagtccctactggtagcacctcctgggtgatgcagccacgatgtcatccccgtcccagggtcgagctgcctgggtgatctccttcaacctggacctc

SEQ ID NO: 593466 - DNA, 312 bp, Homo sapiens
tgattgtgtgctacctctgatatggtgtggatgggtcgccatcgagatcatatgggggatggtagtctcctataatcgccatgtgtcgttggagggacccggtaggaggtcatcgaatcatgggggcagtgtttttcccatactgttctcgtgatagtgaatgcatctcactaaatctgatggttttataaatgggcagtttccctgcacgtgctctcttgcctgctgccatggaagacataccttttagctccttcttagccttccaacatgattctgaggcctctccagccttgtggacaatgggcgtga

SEQ ID NO: 593467 - DNA, 1285 bp, Homo sapiens
cattggaaacagttttgcaccgccttcacattcaaggaacacgcacaataattgacaatacagaccttggctatgaagtgcttccaattaatacacaatatgagggaatgcgagactgtatcaataccataaggcaggcaggccaggagtgtctggtcttttcatcaagggtttggtgctgttataatacagtacacactgcatgcagctgttttacagattaccaaaattatttactctacacttcttcaaaataacatttgagattaggttccttcactgagtagtctggaagatcataatctggataatctgctatgaagttctgagggatacacagtgacctactggggcaagacacatggcttggacacgtccaccattggtcactacaagcccatactgattatcttgacttccgtcttttaaggcataggtatatatctcggatcacaaatccttccaaatttgaacaactcaataaaccctaacacttacttaacattctagttagtcgtcagcactcatgctgaagtcacacatgatcgtcaggcagcaagccacaccctttcatctcatccacattctaaaaccaaaactttcatcagagctcgcacatctaattccactctgagcttccaactatctcgccaaaaccgttatatttcttacgcctccctacgacttgcatcgtttggcgtataacggtattccctttcatcaccacgtggtcagtcactacttcacagcgccccttccaataccaacctccacggcaggatattcacacatttctccagccaacacatcaacaagcactctcccatattagcacaacacacacgattccaaggggaattcactcacaaccttcggcaactccttgtaccccggggcgctaaacaacatcgtttatctacatactatgccaattctgtccaccactcatgttcacacacccctttcactggccccacaatcacactgtctatctcaaacacacatgccctctccaccgtctatcactccctgtctcaaactgcatgctcactctcttccaccaccccctctcaatctcttctcaccactgacaatcctcatctctacctcccaccataaccaacaatgatctcgcactcccttgacaattatcacactcaccattcacatacaacctcacggtcacaccctcatcactcactacacacacataatctcgatgacactctcccacacccacatcatacccttctcaaccaatatccacacaaacatcaaacacaaa

SEQ ID NO: 593468 - DNA, 243 bp, Homo sapiens
gtttttcccccccccccttttttttaatgggggggcggaaaagggttttttttgggaaaaacccggttgggtttgggttccccccctgtgtttgaatttttttttttaaaggggggggggttttttttaaaggggggaaaaaaccccctttttttttttttggaaaagggcggggggggggttttttaatttttttgggggggggggggtttaaaaccccttttttttttggggccgggggga

SEQ ID NO: 593469 - DNA, 573 bp, Homo sapiens
acctggtccgtggttgatcgtatttgctgggatctttttctttctttcttttctctctttcttttcagattgccataatggcagtctggcgaggctatttgggactttattttggaagggccctcaaagtaggggccttattcttttattattgctgctgttttgtgtcagttttcaagcaggtctggctggcgagcagcagaagggagccggctgttaaaggggcagctctgagggccagggcggatgtccaaagatgctcttgacattgtacaattaaacaattaagacgctatggccatggctcccacttaagccagggaccttggtgcaccaagttttcagaggctatgggatagcagcaactgtcatttcatcaaagatttttttaatacatatgtttaacattttttgcctccaactaagtgcaatcttcagttatgcctgggtgctgccaagaagctaactgatagtcacccagataactgaaaaatgaagtgctgcagcctctaagccaaggcaaaaggaatccacttaacagggatttacagtgcaatgtactcggctaaacaa

SEQ ID NO: 593470 - DNA, 284 bp, Homo sapiens
cctcaggggtacgctttcagtctcacgggcagacgtcacaggtgtcagccaggttgtggcttcacctgcaggtctttgctagcacgggcaggcagttggctgcgacagcagttcctgtgatagtgggactgagggccctgcttactgtcccgtgttgcttggtgtcactctcagctccacatgcacaggtccttgcctctcctctcaaagcaagcactcttatctgcttctagaccagcaaggagcactctgcctgtatgacctgctgagatagggcctctatg

SEQ ID NO: 593471 - DNA, 809 bp, Homo sapiens
attaagagctagtgatgggcaagattacagtctgagggccaaacgtgcctgcttcctgtttttgtaaataaagttttgttggaacacaaaaaaaaaaaaaaaaaaaaaaaaaaaaaaaaaagccggcgcgcgctctctcagaacgcgaatagagttatcctccctctgtttataagccacgagagttatccactccccatggggagcggaggagtaggacacttcttaggattcccccggcccatctataggaccgtgatctacaagacccacagatgtttcccagtagagttgtggagaaaatatttttgtgaaccacggggggactgttctatcttctcaataaggtttaataaagacctctccgtgtggtacacaattattgaggcacacaagcgtgtcttttacaacagaacattttggagaatattacgaacgttttcacacgcgctatgagccccaccaggtgtttggctcatagaaaaagcgctcccaaaaaacaacccacaaattgtctctcctgttttttaaaaaccccacacaaaaaaaaaaaacaactctgtttttgtttcttctctacacaaaaaacacaaatcttgttgagaagagctctctactggtgtgtgcctctttctgtgttgtacaaaaacaacccacagatgtatacaaagaggatgttgtgagaaacaaagttgtttgtggggctctcacagaagagaggggagtcttcttttttttctccgacaaaccctgtgaggaggagatgttctttctccaatagaaagagaaagaaaagaatctttctgggg

SEQ ID NO: 593472 - DNA, 692 bp, Homo sapiens
attttgaggtaattctagccttttaaaatattctacagacctacggggcttaaaagaaccccagtaccgactaagcaaataggcaaaagacatgttggaaatgtagtatagtacttgaaacagtcactatcatagggataatgtggtgcatcctgtgtaaatggaagctgagcttgaacctggtgctttaaagtaggggataaaagtcatccttctcaatgcaaagcacaagatacctgttacctcccaaaagttgaccgttttagggtgaaacaggccgttttttcaaaccaacttgtgtgccctgtgggggtgttcattgtgaaagtttgtgtggaaaattaacgtgattgttttcctcaagttctccttaaaagtttaaggtccaatggctttaaaaatgtctgtgtaggagaagaaggtgggggtttaataaattgtgtttcctctaaagataatctttttgggtggtttttaccaagacttttgggaaaacttattaaaaggcttcttaaaagtggcctctttaacggggagaatactttcgtgggagaaaactttcaagtggtgcccaaaaaagtgtgcattgggccataacaaggttccactaaggagtttcttggaaccaaaagctggaaaaagagattgggatttaatttttaaatttcctttcccaggatattaatctaggg

SEQ ID NO: 593473 - DNA, 449 bp, Homo sapiens
ttcgacggtgttctgggcctggagaggctgccgggaggtaggagcataatgtagaatcagtgggcgtcttaagcttgttttcctgcaactggatggtcccacgtttcactgtcacccctctggaatccacgtatacgaaaattccaaatattagttgggcatagtggcaagcacctgtagtctcagccacgtgggaggttgagatgggaggatcgcttcagcctggaacgcagaggttgcagtgagctgagattgcaccacggcactccagcctggacgacagagcaagactctgtctcaaaaaaaaaaaaaaaaaaaaaaaaaaaagggggcccaccaatttaagttccaaatttctcccctaaggtgtataaagctttctagggcaagcttactatccatctcctaacttgataaaacataatttcccaaaagggggaccctctgtc

SEQ ID NO: 593474 - DNA, 160 bp, Homo sapiens
gccaccgtcgaggattcagcagcctcccccttgagccccctcacttcccgacgttccgtttccccctgcccgcctttttccgccaccaccgccgccgccttctgcaggccgtttccaccgaggaaaaggaatcgtattgtatacccgctacccagaacct

SEQ ID NO: 593475 - DNA, 1002 bp, Homo sapiens
agcgggagcggcggtggcagatgcgcaagagcgagacgctggagcgcggcgtaggtggctgccgagtcttttggctgtcgtagggtcttatcctgggccttagagtggcggccggagctggcgctttctgggtcgatcttggcactgggggtgggcggttttactagggatccgcacatgagcgcagcggtatcatcaccacggcaggtgggcttgggtggcacggatggatcagacgacattattgcaggaacagcatcctcgagtcaacgtaaggtaaaggtggtgtgaatagcaggatcccccgagataggttggaaacgacctatcgtcccgagattggaccacgcagcgatgcaactgggacctcgttctcatctgccttctccaaaagtctccctattgcgaaaagcagctttttggacaagaacgtacaagggctggaactcccacgtaaagaatgtgtgcgtatgatcccaccttttgcgtaactacatgttattagagcacagaagatcgcgcacggaaccagataactgacagggcaaactttgggacctgagttaattgaatttctaaatcactactacttcaaggcggctattgtactcaagagcgcaaggacggggatttttgcgcgaggaaaaaacattggtgtgcccgtgtaacgtttaggaacaagtgtgtttatacaacgtttggggaccaattcaaaaggtgggcgctgggagtgaattggacgaactgaatttgggataaaaatgtccaaaaagcgagcggcttggttgaagtaggcggttttttgtgagaacggatacatatctaaagaagaattatactcgaatataaacgtataatattggggtgggtcccaaactggtgtacaccgaatgggttcttttaacagaccaaggaagcttggggctaaccttacccatgttggccacgaattactgttggaattcgatggttaagaaaggggcgtgagggggccacgaatgg

SEQ ID NO: 593476 - DNA, 267 bp, Homo sapiens
tccgggccggggtcagccccctggaaagggcccggggtcccccgtcctgtttttttgctgtttttttccttgtttcgcgaattgctgacctcgtttaaacccttgcctaatgggctgctttgttctgtgtatttaaaggtgagcccctccctgtttggatggttttgatttgcaccagggccaggcctgttggtcattcccttgtttttttgaaaaaaggcttcattgccgggtcagcatttttccaaatagattttagaatcctta

SEQ ID NO: 593477 - DNA, 655 bp, Homo sapiens
tcaggtgtccctcctttcagcgggggcgtcctcctgttttgtcagtcacgtgcgtgcttccacccgcggggtgtatcttcgtccgcccgctcctcgtggttatgccgccgtcatgtcatattggcgccccccctctctgtgtttgccccgcctcactcctatcgtgcaggcggccacccacgtgtgggtggcacccactgtggtctcccccccccctccactagcggcttgttgccagcgcacccatgggtgtgcgtcgcgcacgcgcgggcggctcgccgcacaagacatctcggcgcagcatcccttgtctatgccccccctgacatgtcgtgcggcggtggcgccctcttcttgcgcgaccgcagcagggtgtgctccaggttgggtcttttcccgcgcttctacggcgccgtagatcgcactcacgcttggtgtctattcctccctgcgcgcccctctctaggcgtgcctggagccctccccctcctccttcccccaccactccttcaatgcgcatcttctctaggatctatttttctgtcaacccgctgtgcccccttcataatatcaaggaggacgaccatttgtcttactgtggggatggtgggtgtgtagagaggggcacctgtgggcggacccacaatgtacagaa

SEQ ID NO: 593478 - DNA, 208 bp, Homo sapiens
acaactctatgcatactacagagccactcccaattcgtcttcacccagagaaagccttcctgggaatggagggtggagcatgcagaggagcactcacagatagttgagggcatatgccagctgttgaccacctgcagcttacagctggctggcaccaggtggccacgtattcgcagatacatgtctatggcccccaggtgtacaaatt

SEQ ID NO: 593479 - DNA, 406 bp, Homo sapiens
ggggctcgcctcggtgctcacgcgcagtaggcacatgggaagtgcgggcattccccggcactgctggagtgctgagcgcgatgtgttcccacgtagacatggatttggtgagccacggttccctctctcaggggtgcctttccctgccacagttgcaggttgtggggctgatctgtcaccttcagtgttgtgatctcaggaagatagcagaccagccacctgacataaaaatccgcatagagaaattcaggatttctctcgatttattaactgtgtgcttagttgagggcagctcgggtgatgataagtacatttttataattatgcatcattaaatagtaattgttaaatagacttagagttttctttcctatattaaaaatctagatttaaaaaatccagattt

SEQ ID NO: 593480 - DNA, 172 bp, Homo sapiens
ataggaataaataaagtctctgatataggaagacaagatgctcccataatactctcagatagtgaagaaaagaaatgatcattttggaaccaaacaagaatccaaagaaaataagaacacagaccaccagatgcaaaacaatgcaaaagcaccaccagtgaattcttccata

SEQ ID NO: 593481 - DNA, 418 bp, Homo sapiens
  misc_feature (7)..(7): n is a, c, g, or t
  misc_feature (34)..(34): n is a, c, g, or t
  misc_feature (71)..(71): n is a, c, g, or t
  misc_feature (147)..(147): n is a, c, g, or t
  misc_feature (231)..(231): n is a, c, g, or t
  misc_feature (268)..(268): n is a, c, g, or t
  misc_feature (286)..(286): n is a, c, g, or t
cttttancagtagtaccccagcctggatgttttncaaaaatgtttaccttggaaaacttggggttttgttngtgaggagaaagagtacttgtggaaaacctctgcttgagtaccatgtgccaggcctatgtggatgctactccgtgntgtgcgcttcaccagcggttgggattgccccagcttggagtgcttgtgtgtccaacctcagtctgcccccatagtgactttttnccccatgattctgctttcactgttggatcctctttgnaagtcccccctctctttnctaaagcagtgaaggaagagaaccagagacaaactctttggactgtgaaagagaagggtagagaattcccaggcaacagtctgacccaagggtgtaaaccagtttattatatatatatttttcctttgaatt

SEQ ID NO: 593482 - DNA, 397 bp, Homo sapiens
ttatcgttatggctggtgatgggcaagtgttcacacactcatcgtcctccagcctgggcaacaaaagtgagaccctatctctactaaaaatacaaaaattagccaggcacggtggcgcatgcctctaatcccagctactggagaggctgacgcgggagaatcgctcgagccacgggagatggaggttgcagtgggccacagatcacaacactgcactccggcctgggcagcacagaaagagaccccgtttcacacacgaacaagcagatgggcgcagtggctcacgcctgtaatctcaacatatttgggaggccaaagcggatggatcacctgaggtcaggagttagagaccagcctggctaacctggataaacgcctctgccaggtaccgagctcg

SEQ ID NO: 593483 - DNA, 1045 bp, Homo sapiens
taaaacccggtcctggggggggtgtgggtataatactaagttgaaatgatatcatttacgggggaaggcgcttgggggaagtaggccttatttctctggtcctttcgtacagggaggaatttgaagtagatagaaaccgacctggattactccggtctgaactcagatcacgtaggactttaatcggtggaacaaacagaacctttaatagcggggtgggaccatcgggatgtcctggatccaacatcgaggtcgtaaaccctattggtgggatttgggactctagaataggattggcgcgctggttatccctaagggtaacttggtcccgttgggtcaagttaatgggatcaattggagttatagtagttccgctttggactgggtgaagtcttagcatgtactgggtcggaggtaggggttctggtccgaggtcgccccaaccgaaattttaaatgcaggttgggaagttaaggacctgggggttggtcaggtacggttggccttaataaattaaagctccatagggtctaccgacttgacgggtcatgcccgatcttcaagggcaggtcaattaactggttaacagtacagagacagttgaacctcggtggagcattcctaacggtcctatttaggacacgtgatcatggtacctttggcacggaaggacccggaggcgctacactgtgcgtccccggggcagacgggggactctaaaagcgggagccacaggggagatcgggacaccagcggggaaactcgccagactctaacatgtaaccgcccctatgaacgccgtgttggtctacagccggcgaacaccagtgtggggagagaaaaatcggaggacgacacacacagttaatataccgggtattgggagaagtagtggtacaccacaagtgtattagaggaaacaagccgtgagaacgtaggatataatgagggtaaacacatgactgcgccggaaagcatacactcgacacgtctcacagctgctacgtcggttgtccattttttgttgtttgctggggggaggggt

SEQ ID NO: 593484 - DNA, 214 bp, Homo sapiens
atacattgtctgatgacagataacatctcactatatgtcgcccaggctgaagtgcagtggcgtgatcttgtgctcacagaaactccactaattttatagtatttttaagtagagacgacggtttcacctagtgttggacaggcatagctctacaaactcctgcacctacatgtaatccacctcgccttggcctacccagaagtgctagggatta

SEQ ID NO: 593485 - DNA, 156 bp, Homo sapiens
caacgcgaagccagcccattcgtgctgcaggaagtgcaggatccccgggagactgtactgggtcgggccgccccccggcagcgcccgtcgccggccgcggcagcatccgcagaggcccgagcatctatgaccgcggcgcccgggtggttgttgctg

SEQ ID NO: 593486 - DNA, 348 bp, Homo sapiens
tgagctcggtccagtgtactccacaaacaggacacacaagcaggacacacacatatgcaacagacaagccgtactcagcacagctcacactacgaacatacgaacaacacacaatagaccacatatcagtgtgcatccacacaacacatacaacgcacacaatagaccacgcacaacggacgacacacccagctcacacgacagacacacagcatgacagcatatacaacccataacacagcacacacaacacacaacaaacacataccacataccacacacaaacacataccacacaaaccacacaccacattccactggctatacgctgtttgtggaggtagcact

SEQ ID NO: 593487 - DNA, 157 bp, Homo sapiens
tgttgccgacgtggtcgggtgtgctgaccgccgctgttcggccatgcttgccctgcccaaagaagtgactgctgccccagccggtggtgtgccacccgagctatgtgtggccatcaccacagcattgagcaaggttggcccggacaataaccaaccc

SEQ ID NO: 593488 - DNA, 554 bp, Homo sapiens
agtggagagagaagggcatggattgctgtaacggggacagttgtgtgggcgcctttgctgtacatgcgatcccatatgtacatatgaccaaattctacgcagctggcctggtgtcctgggggccccattgtgggacctatgggctctacacacgggtaccgcaactatgttgactggatattgaagactatgcaggataattgcaccccccgtgaggactaatccagatacatcccaccagcctctccaagggtggtgaccaatgcattaccttctgttccttatgatattctcattatttcatcatgactgaaagaagacctgagcgaatgatttaaatagaacttgattgttgagacgccttgctagaggtagagtttgatcattgaattgtgctggtcatacatttgtggtctgactccttgtggtcctttccccggagtacctattgtagattacactatgggtggggcactcctttcttgggctattccacagggatacctttattctttgtttcctctttaactcttcaaattccctttacttgatcc

SEQ ID NO: 593489 - DNA, 283 bp, Homo sapiens
gcacagggtgtaattaaaggtatatcataactaagagagaacgtgacatctagagatatagtaaaaactagtaccacgaatagcagaggcctactaggggtcctgcaggaccctcaaggccagaatgtgggcccaggccacattgccaacatagactgggttcacagtggagaactttccaacacttgacaggatcccattgttgttcagggcctcgtttatactagcagaaaggaatcggcttccttccccatagatctacataggtcgtacggcacaagtg

SEQ ID NO: 593490 - DNA, 359 bp, Homo sapiens
ctcaaatcatcagacttttaaaatgtctctctccaggtatttcttgagagtttggaaaatcagcatcagctgggcacggtcgtcgcgcctgtaatcccaggactttgggaggtcaaggcaagaggattgcttgagcccaggaatttgagaccagcctgggcaacatagcaagacccagtctctggaaaaagataaagaattagccaggtgtggtgtgcatgcaggtggtcccagctacttgggagactgaggcagaaggatctagaggtcaggctgcatgattgcaccaccacacaccagcctgggcgacagagtgagaccttgtctcaaaaaaactaactaaataacattcaaatata

SEQ ID NO: 593491 - DNA, 419 bp, Homo sapiens
ctccagcgtgtaacgttagtctctaggtcgctatctccttttcgtaatgccattccagatcagcaccggtacccaaatatgccacactcactacttcagtttgcaccctgctgtacctttagtgccgaggtcactacggacgccatccaagaacagatcacatggtacgcgagcagcttattttttaaatgcttcaaaaggatctcctccctttcatcttttttttttcctctttatgcttacagtgttcagtgaaaatccgtttggttggtttattttaggttttttggagacggagtgtagctctgtcactcagtctgcagtacagtggcgccatactggaacaattagaacctccgactcccaggatcaagcaatactcgtgcctaagcctctcaagtaagctaggataacaggcg

SEQ ID NO: 593492 - DNA, 225 bp, Homo sapiens
gaccgcacctcgtcttgaaatagccttttaaatgttcaactcagcttgcctcacagttgtaaaaataagcatttttttgtttttgtaggatcagaggagcttccacaggcactttgatacaccttttgatgtgggaaggaggggctctgtagagagctacacagatacacccaaccttcacagccctctcattagaggggtagatttgggtgtctcttttcggcc

SEQ ID NO: 593493 - DNA, 774 bp, Homo sapiens
  misc_feature (3)..(3): n is a, c, g, or t
  misc_feature (75)..(75): n is a, c, g, or t
  misc_feature (77)..(77): n is a, c, g, or t
  misc_feature (79)..(79): n is a, c, g, or t
  misc_feature (112)..(112): n is a, c, g, or t
  misc_feature (115)..(116): n is a, c, g, or t
  misc_feature (119)..(119): n is a, c, g, or t
  misc_feature (123)..(124): n is a, c, g, or t
  misc_feature (148)..(148): n is a, c, g, or t
  misc_feature (154)..(155): n is a, c, g, or t
  misc_feature (163)..(163): n is a, c, g, or t
  misc_feature (165)..(165): n is a, c, g, or t
  misc_feature (206)..(206): n is a, c, g, or t
  misc_feature (209)..(209): n is a, c, g, or t
  misc_feature (211)..(211): n is a, c, g, or t
  misc_feature (213)..(214): n is a, c, g, or t
  misc_feature (232)..(232): n is a, c, g, or t
atngacgtccagcgaagcgaggagcagcgatggacggtcgggtgcagctgataaaggccctcctggccttgccgntncnggcctgcgacgcgtcgctggaggaacccgattnccnnttncccnnagacgtttgacgtgcgataccganccgacnncccggagntncatcgtgcagacgggctcctacatgttcgtggacgagaacncgntncnnccagcgacgccctgaagngtgacgttcctcatcacccgcctacacagggccctgccctgcagtgggtgatacccctacatcaagaaggagagccccctacctacaatgatataccggggctattctggccgagatagaagcgagtactatatggatgggaggaggacgaggactatctaggccgggagaccctcgggcctgggggcgggtgctactggggagggtaccgctgtagtatacttggccgccgaccagggtcgccacctggctgccactaccctaccgagcctaccctacccgcctacgaagccgctgagatgtacccctgcgctacctgtatccctaccctgcgtagtagctatagccctttatgttaccacgggaataagctgctaccaggctccaagctagacgacccctagggcctacattactgaaagcgagcctgcgccctcctacctataccagtgcagacaggcccctccacatggtacatattggaaagctgtccatgcgctaccagttagaaagtagggatacttgttaaacattggacatac

SEQ ID NO: 593494 - DNA, 253 bp, Homo sapiens
tggattatcacttgagtccaggagtacaggtacagcctgggcagtgtggtgagaccccatctcaaaaaaaatataaaaagcgaaatacaccaaaccggctaaatgcattttttattcccggacttggctttgcctactttttttgggttgcttgaaggaacgcatcttaattggcgggatttaccccaagaataaagaaagaattatgattcatacgttcaaaggggaggaggatatatgcacagcttcagca

SEQ ID NO: 593495 - DNA, 914 bp, Homo sapiens
  misc_feature (3)..(3): n is a, c, g, or t
atngacgtccagcgaagcgaggagcagcgatggacggtcgggtgcagctgataaaggccgttcctaccaaaaaaaaaaaaaaaaaaaaaaaaaaatttggggggggcgaaaaggctttttaaacccttccgctggggcgccgcgggcgccaggctgggttacgtggcacactggcccaatagctgtgccaaaggaaaatccggcccaagacacaaggtgccgggctttccctccacaataaaaaaagcgcacgcgggggggacaacccagagcgtcttcttggaacacaaatccccgacaggagactccggagggccaaagacgggatctccaacaacagaggggtccagcggcgaagcccgaatataaaattagacgcgccgcggggggggaaaaaaaggctaaataagaaaaaaataacataaaacattcatcagaaaatgaacgcaacaaaataacgaatataaaaaaaaaaaaatatataaaacaaaaatgacatacaaatataaaaaagaatgatatagaaaatgaaaataaaaataataaaacacaacacaacaaaaaaaaaaataaaaaaaaaatgcacaaatgaaagaagcacaacagaaaatgattaacaaaggagtatcataatatcacagagtgaacgcagcagaggctgcacggcgcctacgggcacgacctgacgcgaggtgataggagaacgacgcacgacaaggaccgacagcgtacagagccgcacgagtgcaagcggcacagggagggcaacacgagagagacagaaacgaggccgccccgcgcagcgagccgaacagaacaaaaactagggttcaccatgaggcggcggagccggtacagacacgtcagggaaaaagacgcacagcgacaagcacacccaggcggtgaacgagccc

SEQ ID NO: 593496 - DNA, 129 bp, Homo sapiens
tcattggtatatggttactgtgtggttaagtaggctattatgaggagcgttatggagttggaagttgaaactcacattgctaggccggaggtctcgtttagagagggctgagaagggcccctgtttagg

SEQ ID NO: 593497 - DNA, 816 bp, Homo sapiens
  misc_feature (260)..(260): n is a, c, g, or t
  misc_feature (581)..(581): n is a, c, g, or t
ggaactcggtgttggccactgtgcagaccagacttcgctcgtactcgtgcgcctcggttcggcttgacctccgcaaccatgtctgacaaaactcgatatggcgtgaggatcggagaaattcggagtaaggtcgaacactgatgaggacacgagacgtgcaacgagaatagtagtcctagctgcctttcctaccatgacacaccgatgtgaacaggggacgaaacgcaatgcaggagcgacatcggtaattgacgtgcgtngcgccgccagagtatggcactgttaacatttccacaaagccatttggcacctgtccttagtttatcccctttgcctgtattaacggcatggttcaagactatctattgctacagggcacttgccacagagcccgaggttgtgtgcactcccagcaagttttgtcacacgaattgcacctttgttcgcctttgccctctcatttgtcccaacaagttcaacaggcaacacttacctgggaacaaacgggaacaagtggcccagggaggcaccgttggcccttttgtccccccaaatcttgggttcccttagttcgtaatttncgtgggcgctttggcgccacgcggcaacaccgcgaccactcggaaacgttttggcccattatgttccgtgttgtagacgcgacaccaccccgtgggcggtttttgggaaagcccaaccgctggggggttgggcgaacggacgcagggttaaaactgtcgtcacgcaagttaggaatacgccaagcgctgggccccaacgggttgtcccttgccagggcctggtcaactgcaggtc

SEQ ID NO: 593498 - DNA, 111 bp, Homo sapiens
tctgccctgcccgtccgctggcccatgtcatcctcagcactcctcggattcttctttctttgcttccacttatcttctcctcgagctggcgcagcaggctcgtgaaggggg

SEQ ID NO: 593499 - DNA, 849 bp, Homo sapiens
  misc_feature (815)..(815): n is a, c, g, or t
tatctcctgtccgagaacgaatgcaagctaacgataactcagtgtgactcccactgttgaaatgtagagagcagtcgtcttgattctgcctgcgtgggggacagttgctactttttagtgtccttacaaggtctttgcttcatcgctctagatacactctagctactctcctctgctaacggctgcagaaatcattaagacattaatttgtttacatttctgtttaaacatctcaagatgggctaggttaattctttttctccaaacgagaataattcctggatataaaatatactgtttggacaagtgtattagtccattttcatactgcatgtaaagatactacctgagactgggtaacattgataaaccaaaagagttctaattgacttacagttctgcaaggctggagaagcctcaggaaacttagaatcatgctggaaggcgaagcagaagcaaggcatgtcttacatggtggtcaggatagagatgagaatcacatggggaaactgccacttttaagtaactcagatctcatgagaactccctcactatcacgagaacagcatgggggaaccaccgcccatgatccaatcaccgttccaccaagtcccgtccctccatagcgtggggattacaattcgagatgagatttgggtggggacacagagtcagaccgtatcaataggtatataacacagtcttgttaactatagtcaacatgctgtacattagatctccagaacttactcatcttgcatgactggaactttgtaccttgggtactgaatacgctaaggactagtcttagtgtntaaccgagggtatgaatgtacttgtcatcctcgg

SEQ ID NO: 593500 - DNA, 635 bp, Homo sapiens
tagatcgagctcggtaccgtcagcgcttgccttacgatgcgatgacagtggtcttcccgctcgtcgcaagcacggcttcgaaaatgccgagttccgccgccaccgctggggcaagaggttctgctgcagctgtcgccagaacgagcctacggccacgcatatgctcctgacgtagataatccagaaaatcccgacgataaggcagtaaccccgcatccatggaaatgcggctcgcaatctgctgcttcaagtgggcttggccagacaccaaccagatgggaaacaaaaacagaaacaaagggttccgcttcaaaagaatgaaagcgctttcccatagaagatctgtcgcgaccagtgttccgtcgaggtctacggccaaaggcacttcctggctttttagccgctcatccatttttagtcattatcctcaaacccgccccggcaactctcgtcagccaagccccctgggcaacgaataaaaggagagcacaaatgaacaatgattagtcttcgctacaatcgataatggttattcatgggcttgtctctaccaaagtggcctttaagcaatcgctacgagttttggttaataaacacgtcatcctacataattgctggtctaacttgtcatcgcg

SEQ ID NO: 593501 - DNA, 102 bp, Homo sapiens
ctatgcaatgtgcatattcggcaacccagtgagtgccagcgcaggtgacccagtcacctgaatctctaccgaagctgccaagcccttaattcaaccattcaa

SEQ ID NO: 593502 - DNA, 663 bp, Homo sapiens
caaatttaaggggttcttttgtgtgatcaaaagttaatttccttcctgtaaaggttcccaggtaaagggtttattcccgtcccttcaagggataacctgattttctgcctcccaaccaccttgccttcccccgataaacattctgtaaggttctggaaaaggattgtgtatatcaacggcgcaggcattaatggccctcagaccttttggatccagtgtttccccctataactgtttttaagtctgtccaaggctttactcgctgccaccagcattggcccatcacctcgtgcagctatgccagcatctgcccatcgaacagtcttttcatcatattctctcctctttactagacgaacctcaattccctcattccgtaaactatctataatatgttctacattttgggtgtgaatatgatgtcgtccaaaaagtcccctgtaactagagcctttcaatgcaagcagctgcttcaggtcttcctccgaaagctccgcgtaacggtaccgctgctgctcaaactcgtaccgggtggttttggccaccccccccacccgggaggggcgaaagccgccgtcagggcggcttgccccagtcatccagctggcgcggctgcccttgccccaggtgccgccgcccgcctcggcacggccaagccggggc

SEQ ID NO: 593503 - DNA, 254 bp, Homo sapiens
atctagaggatccctggcgcgggattcttcggccggggatccgtgacatacccccgtgctggtagagccagactaatctggttattaccgaccagacttcagttgccctcttcatgtaggaacgagcctctctgggctgtcttctatcgggtggttgtaggtcgggaaacatcaagcctgtgtaaccttcctctgtggggtgaggggtgagaggtgtaggaaccaatgtagaggaatccacggtgggacgaggt

SEQ ID NO: 593504 - DNA, 638 bp, Homo sapiens
ttaaaagaagtattagcggccaggcgcggtggctcacgcctgtaatcccagcatttgggaggccaaggcgggcagatcacctgaggtcaggagttcgagaccagcctgaacaacatggtgaaaccccatctctactgcagtacaaaattagccaggcatggtggctcatgcctgtagtcccagctacttgggaggctgagacagaactgttgaacccgggacgcgaaggttgcagtgtgccaagatcacgccattgcactccagcctggcgacaggaaaacaaaaaaaaaaaaaaaagaagcattagccattctgatcttgtgtgcacctgcataatggatagagccccaaatgactacaaaacaaaaagtgtcaacgaaaggacccctgactaaatgagcacattctccacgcggaaattataccacttctcactgggaactggtggtttaagcagactcaatgagtacgaattatcgaacaaatgtggcgcaggcatagtggtctcatgctgtgtaaatcccaaacacttgtgggaggcgaaggcaggcggatacactttgaggtcgggagtttgagaccagtttgcggccagttgttgaaaataatatacaaaatacaaaattgagacagatgtg

SEQ ID NO: 593505 - DNA, 796 bp, Homo sapiens
atggcacatgcagcgcaagtaggtctatcaagactgctacttcccctatcatagaagagcttatcaccttttcatgatcacgccctcataatctatttgccttatctgcttcctatctccatgtatgacccttttccgtaacacgtcacaacaagaactaactaatactaacatctcagacgctcgggaaatagaaaccgtctgaactatcctgcccggcatcatacctagtcctcatcgtcctacctcgatcccgtacgcatcctttacataacagtagcgaggtcaacgagccctcccttatccatcgaatcaattggccgccaatggtactgaaccttacgagtacaccgactacgggggactaagtcttcaactccttagttacttccccggattattcctagaaccggggcgtagcctgctgacgtcctgtgaactgttgactagagtcagatgtatgtactcgccgcttgaaggcccccgatttcgtcataatagttacatcacacagacgtcttgcagtcatgagctgtccccacattaggcttaaaaacagatgcaattcccggacgtctaaaccaaaccattttcaccgctacacgaccgggggtatactacggtcaatgctctgaaatctgtggagcaaaccacagtttcatgcccatcgtcctaggaattaattccccctaaaaatctttgaacctaggggccgtatttaccctataagcaccccctctacccctctaaaaactgcaaaagagataaaacagggaaaaacggaccaaaaaaagga

SEQ ID NO: 593506 - DNA, 379 bp, Homo sapiens
  misc_feature (115)..(115): n is a, c, g, or t
  misc_feature (204)..(204): n is a, c, g, or t
  misc_feature (207)..(207): n is a, c, g, or t
agggggcccgcaatccaaaaaaggtggcccgccccatcggcatttttttggattcaagaagggggaaaaattcccgggagtccttccagcccaactgcaagcgggtaaaaaagtnccgtttcaaatttatctttttccccaggaagccctcggcccccaaaaaaggaaacagttttttttaaaaatttaaattggccccccaanttnccgggccggttatgcccctccggaaggtttataaaaaggaaaaagctcgggtcctcccttaggaaaagaaaaattttaaacccttcgttagtttccgtatggcccgtgccaacccccggttttttggcaaacgggcaaaaaaaaccaaggaaccccccaaacaggattttta

SEQ ID NO: 593507 - DNA, 178 bp, Homo sapiens
atatagaggatccggaatagttaggataaggtaggagatagggcactagaagacctacggggaggggtactagagctggggcccgaccaacaggttcggcgacactactaagactagaggcccccaccctaaagtacactacactataccctacaggcacacagggcctagcatgtgt

SEQ ID NO: 593508 - DNA, 121 bp, Homo sapiens
caagcggaccataccttgcattatccccaattccatctacactatgaacggacgtgctattcaagcttcaatcatctagcctatcttttggtgtcacatcttctatggttcctgtgtttat

SEQ ID NO: 593509 - DNA, 167 bp, Homo sapiens
agaggggcgtaggtatgggtatggcaggggttatattgatattgttgctgatgcaacttgatggcccctaacgatagagtgagacacctgctaggtgctaacgagagaagatagtcaggatctacaggaggctccagtgtgggagttagttccctcgctaagggcag

SEQ ID NO: 593510 - DNA, 109 bp, Homo sapiens
gggcatgagtttttattcttcagtgcacagcagtattggctgttcatcagcaaaaggctttattggctccaacaaattatcccttttaaaactcctcttcttctttttt

SEQ ID NO: 593511 - DNA, 226 bp, Homo sapiens
cttcggcacaggaggagcagctgcagctggtgacagaggctgtggcaggccagctgggtcggggacgccacgctgagaggagcgcgtgacgagcgggacctcgggaccatgagcgacgtggctattgtgaaggagggttggctgcacaaacgaggggagtacatcaagacctggcggccaccgtacttcctcctcaagaatgatggcaccttcattggctacaagg

SEQ ID NO: 593512 - DNA, 208 bp, Homo sapiens
  misc_feature (75)..(75): n is a, c, g, or t
ggtgacttagaggatccccgttcaatttttctcacctgtaagcctctgtaccactgcttcaaatctaaggatgtngatggagcccccacttgtgccaagtgtatgatgccaaggagctgcttcttggtcagctgactttacttctctgcctccttttttctctctctctctctcttaaagagtaatgtttagtagagacagcatatca

SEQ ID NO: 593513 - DNA, 418 bp, Homo sapiens
tatagctgttctagaggatccctcacgccatgtcacaacatggtgaaaccccctctctactaaaaatacaaaaattagccaggtgtggtgttgggcgcctatagtcccagctactcagtgaggctgaggcaggagaattgcatgaacctgggaggcagaggttgcagtgagccgagatcgcaccattgcactccagcttgggcaacaagagcgaaactccatctcaaaaaaaaaaaagggaaagaaaaaaagaggcgcagctacgaccagaggtcgaccgccatgtgcaccttgtccattggtccttgaaacccacgtggctctcaagctcaggatggttctatccacgcttggaattgtaggtgactcttgcctattgtgcttaaagaatttcacaaagcagatgtagttaaggggt

SEQ ID NO: 593514 - DNA, 132 bp, Homo sapiens
ggcacaggaacatgctcacccacggggcagttggcaccatagagtgatcacctccgttcttatatgccagagtagagtagtgaccagcaaaatggagaacatcagagaatgcagcagtagtttttttactta

SEQ ID NO: 593515 - DNA, 396 bp, Homo sapiens
taacatcctgcgcgtgatgtccaccgaggcctcccaaaacatcacctaccactaccagaacggcgtggactacatggaccaccagactgtcaatctcaagaaggccctgctccctcacatggctccgacgagatcaagatccggcgccaaagggcaatagccgcttcatctacagcgtcactgtcggtggctgcacgagtcacaccggagcctggggcaagacagtgattgtatactaaagcatctagacctcccgcctgcccatcatcgatgtggccccctcttggacgttggtgcccctagatcaggaatgcggattcgatgtcggccctgactgcttcctgttaactcccatccaatcctacctgggtccctcccagcccaccaacttttccc

SEQ ID NO: 593516 - DNA, 256 bp, Homo sapiens
gcttctttaccaaaatactatattcctaatagactaagtccttaaccatggcctggtaattctttcacttccatttggatggattattagctaaatcctaccacccacaaaagggttttatttggtattcagaaggtaccacttttggacaaaaggctaaaatattttatatttccaagggaaattaggcaccataactttaccaatatattctaatggatattttggcttggtggaggggatcctacggaaaatc

SEQ ID NO: 593517 - DNA, 409 bp, Homo sapiens
taagcaaactacctaggcttctgtgttctgacatgtgcatattagccactgtgagtaagtgtctgtgcaggaatgaatcatttagttaatcagattctcccccatactcccttctaatactctgtaaagcgcactggtctaaaatgttcaattcacattgtgtaatcaaacttcctcttatctttcctagaaccaaagaccaattggcagtaagttcatcaagaaaagtttgatgtggctgtctggcttcctgttgcctctcagttgggcaccttcgcacactctgacgggtctactccaaccaagagtgtcgcgcgacactctgggaggaaccaggaggcagactggctcagcaaataaacagaatttcgggagcattccccttggataacccgcataagacaaggga

SEQ ID NO: 593518 - DNA, 619 bp, Homo sapiens
  misc_feature (2)..(2): n is a, c, g, or t
  misc_feature (6)..(6): n is a, c, g, or t
  misc_feature (13)..(13): n is a, c, g, or t
  misc_feature (21)..(21): n is a, c, g, or t
  misc_feature (33)..(33): n is a, c, g, or t
  misc_feature (41)..(41): n is a, c, g, or t
  misc_feature (75)..(75): n is a, c, g, or t
  misc_feature (196)..(196): n is a, c, g, or t
  misc_feature (200)..(200): n is a, c, g, or t
  misc_feature (244)..(244): n is a, c, g, or t
  misc_feature (246)..(246): n is a, c, g, or t
  misc_feature (299)..(299): n is a, c, g, or t
  misc_feature (317)..(317): n is a, c, g, or t
  misc_feature (321)..(321): n is a, c, g, or t
  misc_feature (328)..(328): n is a, c, g, or t
  misc_feature (354)..(354): n is a, c, g, or t
  misc_feature (360)..(360): n is a, c, g, or t
  misc_feature (375)..(376): n is a, c, g, or t
  misc_feature (378)..(378): n is a, c, g, or t
  misc_feature (381)..(381): n is a, c, g, or t
  misc_feature (385)..(385): n is a, c, g, or t
  misc_feature (439)..(439): n is a, c, g, or t
cnggancggccanaaaaaggngctggaaaaagngaatttcntaaccagaagtcgcgaagccggagtatagccaanatgcaatcagcagactccgttacgcgttcctcgtattggtttggaaggaaccagcttgtttccaaaggagcgagctaagtgcccagaggacttttggatggcatgacgcagtttcgcaacnttgntcccaaaatacagggaagcttacttgaaagagtgttggccattngngcagaaagccttaaatgaacatcatgttaatgcaaccctggaccttatcgaangcagcatgactgtttttnctanaaagaanacttttgatccatatatcatcattanggccanacccccccccccccnntnaanaaanattttttcatttgaacaggcagttcgaattcttcaggatgatgttgcatgttanatcattaaaataggttctttagtaaggaataaagagagatttgtaaaacgaagacaacggcttattggtcccaaaggatctacattgaaggcattggaactcttaactaattgttacattatggttcagggaaacacagtttcagccattggaccttttagtggcttaaaagaggttaga

SEQ ID NO: 593519 - DNA, 384 bp, Homo sapiens
  misc_feature (202)..(202): n is a, c, g, or t
  misc_feature (356)..(356): n is a, c, g, or t
  misc_feature (383)..(383): n is a, c, g, or t
taaaaataatgagatatgttggggatgggaaccaagtctaaacacaaaattcattcgcttcatatacaccttataaacatagcctgaaggtagttttataaaacatttttaatactcatgtgcatgaaaaccaagttttgactgaaacctgtcacatgaggttcaagtgtgggaattttccacttgtgggtacggtcagtgncttcaaaaaggctttcaggttgtggggggcatttttgaggttagggaaatgctcttctaccctgtacttacttttccctatggctggaccacacacacacacacacacacacacacacacacacacacacacacacattttttggaggtggcantctcactctgttcgaccgccggggggnc

SEQ ID NO: 593520 - DNA, 171 bp, Homo sapiens
acaaacagcaatgcgaacgacccttccaccagacagaccaccaaagatctggatcttggaactagtctgacactgaccatggaatcaggtccccatgaagcctatctatgcctaccagacacgactgtatcaagatgagactggacgagcaaatctacccctatcaaggac

SEQ ID NO: 593521 - DNA, 187 bp, Homo sapiens
ttttttttttttaaaaaaaaaaaaaggcgggggccttggggtccccccgtttttccccccccttttttttccccagggggggggtttcccttggggggggggttttggcccccccccccccccctgggggacccccctttctgttttccccccccttttcttttattttttttttttgccccgggga

SEQ ID NO: 593522 - DNA, 328 bp, Homo sapiens
  misc_feature (177)..(177): n is a, c, g, or t
ggtctgtctggggagtgtggtggtggatctcggctcactgcaacctttgtctcctgggttcaagcagttctctgcctcagcctcccaagtagctggaattgcaggagcatgccaccacacccagctactttctgtatttttagtagagatgaggttttgccatgttgcccaggctgntcttgaactcttggcctcaagtgatccgcctgtctgggcctcccaaggtgctgggattacaggcatgagccaccatgcctggccttacttttttttttttttttaaagagggagtctaactgttgtaacctaggagtgagtgccgggttgt

SEQ ID NO: 593523 - DNA, 677 bp, Homo sapiens
  misc_feature (39)..(39): n is a, c, g, or t
  misc_feature (67)..(67): n is a, c, g, or t
  misc_feature (106)..(106): n is a, c, g, or t
  misc_feature (117)..(117): n is a, c, g, or t
  misc_feature (128)..(128): n is a, c, g, or t
  misc_feature (140)..(140): n is a, c, g, or t
  misc_feature (143)..(143): n is a, c, g, or t
  misc_feature (200)..(200): n is a, c, g, or t
  misc_feature (202)..(202): n is a, c, g, or t
  misc_feature (205)..(205): n is a, c, g, or t
  misc_feature (216)..(216): n is a, c, g, or t
  misc_feature (220)..(220): n is a, c, g, or t
  misc_feature (222)..(222): n is a, c, g, or t
  misc_feature (224)..(224): n is a, c, g, or t
  misc_feature (234)..(234): n is a, c, g, or t
  misc_feature (239)..(239): n is a, c, g, or t
  misc_feature (251)..(251): n is a, c, g, or t
  misc_feature (263)..(263): n is a, c, g, or t
  misc_feature (272)..(272): n is a, c, g, or t
  misc_feature (300)..(300): n is a, c, g, or t
  misc_feature (327)..(327): n is a, c, g, or t
  misc_feature (355)..(355): n is a, c, g, or t
  misc_feature (359)..(359): n is a, c, g, or t
  misc_feature (362)..(362): n is a, c, g, or t
  misc_feature (364)..(364): n is a, c, g, or t
  misc_feature (370)..(370): n is a, c, g, or t
  misc_feature (380)..(380): n is a, c, g, or t
  misc_feature (384)..(384): n is a, c, g, or t
  misc_feature (391)..(391): n is a, c, g, or t
  misc_feature (398)..(398): n is a, c, g, or t
  misc_feature (400)..(400): n is a, c, g, or t
  misc_feature (402)..(402): n is a, c, g, or t
  misc_feature (475)..(475): n is a, c, g, or t
  misc_feature (521)..(521): n is a, c, g, or t
  misc_feature (560)..(561): n is a, c, g, or t
  misc_feature (665)..(665): n is a, c, g, or t
ggggttttcggggcttgccctagatggaaaggtttgggncactccaatggggggtcaaagttggggntccagcttcccctcatcctagaagggggtgggggggggncctcagggggntttgggggggnggggggggaggnggnggggtttgggtgtgggtgggggggggtggggcaggggccaaggggggcccatctgtngnctncgagtggtggnaggntntntggggggggngggcngggggggggggngggggggcggcngtgtgggcngggggagggggggggggggagtttaggngggaggaagctggagtgtttgcttgtntttttaagatttttgatttttttttccntttnttnanttaacntggttatttntttnttttttnttttttnanantttcatggaataagggtagggtggggggttcggtggcctggcttcctggcatcactcgctcatcaaagttctnactcaggaggaagttggcagccaagttctcatttttttcacacgcnaaacaggcctggatgaccaggctctctgggaagcccagnnccttcaacctctctatagcttctttctcctgcggcgtcacctggatgtagttcatctgcggggcctcctctcctatggcgcccacctccccctccacatctganatgtccgccagc

SEQ ID NO: 593524 - DNA, 1100 bp, Homo sapiens
ccatcgcgtccggccgacggcagatgctgcatgatcactagtgcctgggaatcaatgacggagtcgaggatattgactatcctggtccagagcatactctttagcactacaattgacagtgtgcctatgtgtctactccggctgtccagagcaatgcaagcagggtagtgaaatgacccgctcgatgtgacacccactccaggcaacgctgcgagattgcccaacctgggagaaaggaagacctcgactactgcttcctggtgcaggccctgtgcagtacgggatacgaccgggtccatgcggattgatcgaagccccgcgtgtcctgccccaggcatgttagagtggagtgtatgcaactagctctaaggcatgtgatatggcgtagatttgcccgtcgcaccatagtcatagttttctacgggcaatcatgcccccacttgagtggtggcgtgttctggaatgtattctgaaatccgaggtacgtcaccagcctctgtacttcctccgaacctagaatatctgaagtgggcgagggtgtaggccacatgatgaattggtactagatgagcgtaatagtggaccccttggggtattactacatgcctgtatcagggctcgcttccctcgtgcatgcgccggtctatcacacatcaaaggcaccccgctctctgtgacgagttggagacttggtcaggacgtataagttcgccattgggtaggcaaactattaaattcgtgtgcaccctcattgcagaacttgagtgatgagtaaagaaagcatgaggtgatctggttccattccacctgaattccatgccttaaacttccctgcaagagaaatgccccctttgttggaagccccagggtccgggcgttggctccccaactaagcgctaatccagcccggttcactggactcccttgattgccccatatactgattacttaattccctgcagattcataacttatatgggttggcccacttgactttaggctcatgacgaatcaccaactcacaaagaaatatacctcagaaacttacgagggttgaaacacatatgttctgcatacaagcgtacctcacttaataaaca

SEQ ID NO: 593525 - DNA, 1007 bp, Homo sapiens
tgtaactaatactactgtgtgtgcattgaccctggtttataatttgaaggcttattctactttacatatattatgttaattcaacatatctcaaatgttgactttgagtggctaaaatattctaaaggaaactagaaaataaacagctcactatatctttcataaaataaacaaaaagtatttagaaaataaacagctcactatatctttcataaaataaacaaaaagtatttagaaattgatgtgctgcctgaacttaaatcacacatgactcacttcatttgaatagaagatggtggtttacattgtttgaaggacccacactctgagggaatttcccaacatccatcctggaagggatgaaagagttctctaaattccattattttcattccccccgggcaacaattagattctctggtatccagatgattgacaccttaggcggattttatagacacccatacccataaggcagagaccaaccacgatggccccaatcacaggaagcacaattgtgtagtcagacgagcactcatccacatttccaaagtggtcatcttcaaaatcaaaggcttgaagttggacatcggtttgttttcacctgcaggtgggctgacaactggaggctctgttcactcacgcacttgaaggaatgcccgactgctgtctggaacatcaccaccgcatgtttgattccttggtaaactgtctctggatctgagacggtcaaataggctcccacttcactgatatatatgattcttcatccttggtaactgtgagattcaccaatccgcctgaaaaattcaccggagggttggattttcgggtgccacagttccaagagcttgcgttgcgtgggggtccatgttgaagtattttccgaggctgaaaaaaccgaattcttgtctgaacaatcagtgttccccatcttggtgttatcagagctggtccgttaaaaccgataattccagctgaactgaccaggggggtgcagggtggcg

SEQ ID NO: 593526 - DNA, 134 bp, Homo sapiens
acacttagtcaaagagacaacagagggttgtgacaatggtccagtgagcctggcccagaactcccttcaactagtctcttgcatcttcccattgtcgaattagtctccagcctctaaataatgcccagtcttct

SEQ ID NO: 593527 - DNA, 404 bp, Homo sapiens
tgtgtagcgtcgggcatatcgtagggtagatactagccgctcgccgcgtctagattgtccagcacgaaaggggttcttctccatccaggcatgattgaccggactccgtggatacgtggcgtctggcgaaaggtagcgttcagggatgggcaagttattgttggggaccccgttggggacccatttcctctcctcagctccccagagcacagagttgagatccgggagatcttcaaagatgtcacagccctcctcagtccacagtcccagcgcccagttcccaaactctgagcccatctgcgctgccacctcgtagccatcaaggttcagtgaggggcccaggtggatgcgtgtgtcctgcaccatgctgcgcacacgttggttcccatcgcggtactctcggg

SEQ ID NO: 593528 - DNA, 176 bp, Homo sapiens
agttgctatgatggcgcagttgaggcggcgcatatgcatcctaggctatatatccggagtatacgtagcggtaatgtaacaacggtactctagaatatagctagcatggcaaattaaagcgctgatatcgatcgcgcgcagatctgtcatgatgatcattgcaattggatccatat

SEQ ID NO: 593529 - DNA, 338 bp, Homo sapiens
ggcgacattcagagctctctgtctgaggaaatataagaagagccttgggagctcctcactgagcctcctgtgtgtcacgacatatccttgcagtctgccactgaagcagcctcgccaaagcaaagattccctgctatggaagcgatggtgggcaagataaagtcccccaaagtagttacagatttttctttttctggagtaaaactcacttgctcagcgttgtcacacatctgtttaaagtctttaatgcttttaattctcaggtggttttgagggaaggagaagaacctgtgattttccttctgtgtatctttttagtgcttagaaattacgtgcca

SEQ ID NO: 593530 - DNA, 159 bp, Homo sapiens
gggggggggggggggggggggaccccccccgccccttcccagggtgggtggggttattttaaaaattttttaaatgggttcccggaccccccccccgggggtttttccccaaattggtttttgggtttttaaaaaattttaaaccggggttttgaatta

SEQ ID NO: 593531 - DNA, 286 bp, Homo sapiens
tgcgtcagcatctcatcgcttcctgaagccccagctgcctggagtggggccccttttgggtgtggctcttcaggagcaaggcaaattgacgcacagagaacttgacggatgtgtaaatggaacagcttcccggaggtacctcgaggagggcaagggtaatgaaatgaatgaaatgaacccctgcacagcgagggagcacttacaccctgacaccctcctgcagggagaaggaagatgacaaggatctctctgttgaccttttcatagtgcaaacaagctactgata

SEQ ID NO: 593532 - DNA, 290 bp, Homo sapiens
  misc_feature (64)..(64): n is a, c, g, or t
  misc_feature (221)..(221): n is a, c, g, or t
tcgcagcttcctgaccgtttttcagcatttccatcactattacccttgttcgtgacttgcattnatctttccgctagacaatataatagactctttcatagatgtccctgcctctgatagtctgtgccctacactggaggccgaaaaattcttggtaacacctaaatccggtggtcacattttcttcttcaaggtcagaagcctcccattagggtcccggngtcactcagagtcaaaagcaaggtcctccgggctgaggacagtgaggtcacgccctgttaatcctaagc

SEQ ID NO: 593533 - DNA, 497 bp, Homo sapiens
tctacgagccaacaaacagaatagttctagaaagaaaaaaaccagaaaattgagtagaggaaattatcacggtggtcacagaggataattcccctgaactgaagaacttaagtcttcgtcctgaacaaacctgctgtcaagtctcagcaaaatactttacagacagaaatccagatagaaattttagaatcccaaagagataaagaacaattgaacaaaaaatgaaaaactttcagagcaagagaaaaggcaacttacaaagaactgagttctatatggagataacctagcaaatataaaggcagacaatacgccatttacagaaataaaagggttccaatttacatttcaaggtgtcttttcttataaaattacttgagaatgtactccatcaaaactaaggagtaaattacgagaaaaaatcaaaatacttaacaaaacgggggggggcagggcacgagccaagaaacagtgggtccaactaaagaaagtggtac

SEQ ID NO: 593534 - DNA, 156 bp, Homo sapiens
gggggggttaatctaaaacactctttacgccggcttctattgacttggggttaatcgtgtgaccgcggtggctggacacgaaattgacccacccctgggggttagtatagcttagttaaacctctcgtttattgctaaaggtaaatcactgctgtt

SEQ ID NO: 593535 - DNA, 106 bp, Homo sapiens
aatagcgacgcacgctctgctgccaggggattgagaatgagtgtgaggcgtttataccatagccgagccttctttgtgctatccctattaggctctttttacaacc

SEQ ID NO: 593536 - DNA, 459 bp, Homo sapiens
tgatcttgaggatcccgcctacctggaactgacgaagacgcatagtagaggcctgagactagttcggactccccctctcgatcaggacaagagtagacggttggtctctgctagtgtggagataattcatattatggccaaaggtcatgatggcaggagtaatcagaggtgttcttgtgtagtgataaaggtgtagaggtaaaaggagccacttattactcatgttgactgtacaatgactggctatggtgactccatatgaaattgtttgctctactgctctgctgagcgccgatcaggggcgtagtttgagtttgatgctcaccctgatcagaggattgagtaaacggctaggctagaggtggctagaataaataggaggcctaggttgaggttgaccagggggtcgggtatggggaggggggttcatagtagaagagcgatggtgagagctaaggt

SEQ ID NO: 593537 - DNA, 1019 bp, Homo sapiens
aggcatcacgctggctttgcctggggttctcaggaggggagagtgggagaggcttgctgctgaggaaatttatttggtagattgaaggtttgaacgagagctacagaaacgaaagaaaaagtctgtataagccaatggtgttcgggaagaaaataaccccattgccttgagttgtaggtgccactactactctggaaaaatggcagatgacgaagactatgaggaggtggtggagtactacacagaagaagtggtttacgaagaggtgccgggagagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccaaataaatacaaggagaagtttgagaaaacaaaaggacagccatacgccagcacaacagatactccagaacttcgcagaatcaaaaaagtacaagatcaactcagtgaggttaagtatcgaatggatggtgatgtgctaagactatatgtcacgtagatgaaaaagcaaggattttgacctgcaagaaagtgtcgcagcaggtcagtaaggtttatacaagcagaactgggaagacccaggataagtactgttcctcctgatgcccctgaacttgtccaggccgttaagaacaccgccatgttcagcaagaaactgtacactgaagactgggaagcagacaaaagtttgttttacccctataatgatagcccggaactgaggagagttgcccaggcccagaaagctctcagtgatgttgcctacaaaaaaggtctcgctgaacagcaagctcaattcacgcctctggccgatcctccagatatagaatttgccaagaaagtaaccaatcaagtgagcaagcaaaaat

SEQ ID NO: 593538 - DNA, 4045 bp, Homo sapiens
  misc_feature (72)..(72): n is a, c, g, or t
  misc_feature (271)..(271): n is a, c, g, or t
  misc_feature (1678)..(1678): n is a, c, g, or t
  misc_feature (1680)..(1680): n is a, c, g, or t
  misc_feature (1682)..(1682): n is a, c, g, or t
ctgaactacaaggtagagggagagaaactgaagcacaagtatactattgacgccatgagtcttgagcatacnaggaatgtcaatcaaattcagagtgataatgtgtataaagacgagtataacagcttcttgaagggcatcggatggatccctattggttccctggaggtggagaaggtcaagaaagcaggcgatgcattaaatgagaggaagtatcgacagcacccagataccgtcaagttcacaagtgtgcctgattccatgggcatgntgttggctcagcataacacaaagcagctaagtgatttgaactacaaggtagagggagagaaactgaagcacaagtatactattgaccctgaattgcctcagtttattcaagccaaagtcaacgccctcaacatgagtgatgctcattataaagcagattggaagaaaaccattgccaagggctatgatttgagaccagatgccatcccaattgttgctgcaaaaagttcaaggaatattgctagtgattgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgataatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttacgccatggacacaatggaacaggcacttaacaagagtaacaaactgaacatggacaagaggctctacactgaaaaatggaacaaggacaagaccaccattcatgtcatgcctgacacaccggatattttactctccagagtaaaccaaatcaccatgagtgataaactgtacaaagctggctgggaagaggaaaagaagaaaggatatgacctgaggcctgatgccattgcaataaaggctgcaagagcctctagagacattgccagtgattacaaatacaagaaagcctatgaacaagccaaagggaaacacattggcttccggagcctggaagatgaccccaagctggtgcacttcatgcaagtggccaagatgcagtcagaccgggaatacaagaagggatatgagaaatccaagacctccttccacaccccggtggacatgctcagtgtggtggcagccaagaagtctcaggaagtggccaccaatgccaactacaggaacgtgatccatacctacaacatgcttcctgatgccatgagctttgaattggccaaaaatatgatgcagattcaaagtgataatcagtacaaggctgactatgctgacttcatgaagggcattggatggctccctctgggctccctggaagcagagaaaaacaagaaagccatggagattattagtgaaaagcccnantnccgccagcacccagacactttgaagtattccacactcatggactcgatgaacatggttttggcccagaataatgcaaaaattatgaacgaacatctctacaaacaagcatgggaggctgacaaaaccaaagtccacatcatgcctgatatcccccagattattttggcaaaggcaaatgcaattaatatgagtgataaactctacaaactttccttggaagagtctaaaaagaaaggctatgatctcagacctgatgcaattcctatcaaagctgccaaggcttccagagatattgcaagtgattataaatacaagtacaattatgaaaaagggaaggggaaaatggttggtttccgcagtctcgaggatgatcccaaattagtccattccatgcaagtggctaagatgcaatctgatcgggagtacaagaaaaactatgagaacacaaagaccagctaccacacccctgccgacatgctcagtgtcacggctgcaaaggatgcccaagccaacatcaccaacactaactacaagcacctgattcacaagtacatcctccttccagatgcaatgaacattgagctgaccaggaatatgaatcgcatacagagtgataatgaatataagcaagattacaatgaatggtacaaagggcttggctggagtccagcaggttctctggaagtggagaaggccaagaaagcaactgaatatgccagtgatcagaaataccgccagcacccgagcaacttccagtttaagaagctgactgattccatggacatggtgcttgccaagcagaatgcacataccatgaacaagcatttatacaccattgattggaataaagataagaccaagattcatgtgatgcctgatacaccagatattttacaagccaagcagaatcaaacactgtatagtcagaaactctataaacttggatgggaagaagctttgaagaaaggctatgatctcccagttgatgcaatttctgtacagctagctaaagcttcaagagacattgctagtgattataaatacaaacaaggctaccgaaagcaacttggccaccatgttggattccggagtctgcaagatgacccaaaacttgtgttgtccatgaatgtagccaaaatgcagagtgaaagagaatacaagaaggactttgagaagtggaaaactaagttctccagcccagtggacatgttgggagtggtactggccaagaagtgtcaggagttggttagtgacgtggactacaagaactacctgcatcagtggacatgtctgcctgatcagaacgatgttgtgcaagctaagaaagtttatgaactgcaaagtgagaatctatataaatctgaccttgagtggctgagaggcataggatggagtcccttgggttctttagaggcagaaaagaacaagcgggcttcggaaatcatcagtgagaagaaatatcgtcagcctccagacagaaacaagttcaccagcattcctgatgccatggatatagttctggcaaagacaaatgccaaaaataggagtgatagactttatagagaagcttgggacaaagacaagactcagatccacatcatgcctgatacacctgacattgttctggctaaagcaaacttaatcaacacaagtgataaactctaccgaatgggttatgaggagctgaagagaaaaggttacgatcttcctgttgatgccataccaatcaaagcagcaaaagcctcccgggaaattgccagtgaatacaagtacaaggaaggctttcgcaagcagctcggccaccacattggtgcccggaacattgaagatgaccccaagatgatgtggtccatgcatgtggccaagatccagagtgacagggagtacaagaaggactttgagaagtggaagaccaagttcagcagcccagtggacatgctgggggtggtgttggccaagaagtgccagaccttagtcagcgacgtggactacaagaactacctgcaccagtggacatgcctgcccgaccagagcgatgtcatccatgctcggcaggcctatgacctccagagcgataatttgtacaagtcagaccttcagtggctaaaaggcattggctggatgactagtggttctctcgaggatgagaaaaataaacgagccacccagattttgagtgaccatgtttaccgtcagcacccagatcaatttaagttttccagccttatggattccataccaatggttttggcaaaaaacaatgctattaccatgaatcatcgcctctatacagaagcttgggataaagataaaaccactgtccacattatgccagatacccctgaagttttattagctaaac

SEQ ID NO: 593539 - DNA, 387 bp, Homo sapiens
  misc_feature (29)..(29): n is a, c, g, or t
  misc_feature (214)..(214): n is a, c, g, or t
  misc_feature (381)..(381): n is a, c, g, or t
  misc_feature (387)..(387): n is a, c, g, or t
aggaacaggaaaatgaaggtttggattgnttaaagggggtccaacatttgtggtgtcaagaaagtggcagtagtgtcaagtgataagtaacctcaggggtaagagtggaggctcccatagctgtgggcaacatgcacagggcacctgtggctagaagaggcctcatacattgccagtctgaactccgcagctcttcctctggacctcagtctgnccaagccccacgcttggcacctgggcatacagtggtatgcaagtgattcacgtgctctagcttccaggagcttccaatccatggggaacatagaaggaattgatcactagtgaatgtttgttttttgttttgagacagtctcgctctatcgcccagactggagtacnagctgn

SEQ ID NO: 593540 - DNA, 155 bp, Homo sapiens
acgcctgactccggaccccacgaactcactttgccgcccgacacacgaccctgacctcgactatacttagacttactttagcgacgtgacacggacacttcgactggcgactgacgactgactacggtgaccttaccgacggcttactttacttt

SEQ ID NO: 593541 - DNA, 400 bp, Homo sapiens
  misc_feature (368)..(369): n is a, c, g, or t
  misc_feature (373)..(373): n is a, c, g, or t
gacatttctgcttatttttaatttatcatgcaaggaaatataaaaaggataaaagtttagggaagaaatggttgaagttcaacatgctattggttaaataccaatattcaagcaaatattgaagtggaaaagttacagaaaatttacaaatgaaatggaagttacagaatgttaaacacacacttaggattcttgggaagttccagtttcttctcataatttaatttttcctcttttgcagaatcagtacaaggctgactatgctgacttcatgaagggcattggatggctccctctgggctccctgagaaaactcccacgtctgttctgtagcttctgacatacagaaccctggtgttttgcaattnncttnccaaaaagaaaggtcttgcctggcaaa

SEQ ID NO: 593542 - DNA, 353 bp, Homo sapiens
  misc_feature (296)..(296): n is a, c, g, or t
gacatttctgcttatttttaatttatcatgcaaggaaatataaaaaggataaaagtttagggaagaaatggttgaagttcaacatgctattggttaaataccaatattcaagcaaatattgaagtggaaaagttacagaaaatttacaaatgaaatggaagttacagaatgttaaacacacacttaggattcttgggaagttccagtttcttctcataatttaatttttcctcttttgcagaatcagtacaaggctgactatgctgacttcatgaagggcataggatggctgcctncttggcaaccagcgttttcttttctttttgtattagtcggtctatctgtcgactcgt

SEQ ID NO: 593543 - DNA, 481 bp, Homo sapiens
tgccatggggataatagtacgcgagggaaccgtaagctaccacgtcaggtggctgcctctccagcggccaataaagaggtgtagaacttggtatgatggtcgatagaagtgtgtggcatgaatgtgcctatgacgccaccgagatgccatatgtaagtctatcagtgcgaggtgcctctagagtgctctctgtagaagcaatatgagtgagtgaagagagaggcctttggctgtggccgggatataggggtgctcttctacctgtaattgggtgttggaaaaactctggcttaattggtattccattaaggttcttttccatttaaagtacgtcttaaaatcaaagtatccaatatataaaacgccacaaaagtagattaccataattagcagagatttcagtcagtaaaatgttagaaatcaaactataagaccattcaagtcctttatatagtgtcttaggtatatgccattattttaa

SEQ ID NO: 593544 - DNA, 8435 bp, Homo sapiens
  misc_feature (4462)..(4462): n is a, c, g, or t
  misc_feature (4661)..(4661): n is a, c, g, or t
  misc_feature (6068)..(6068): n is a, c, g, or t
  misc_feature (6070)..(6070): n is a, c, g, or t
  misc_feature (6072)..(6072): n is a, c, g, or t
aggcatcacgctggctttgcctggggttctcaggaggggagagtgggagaggcttgctgctgaggaaatttatttggtagattgaaggtttgaacgagagctacagaaacgaaagaaaaagtctgtataagccaatggtgttcgggaagaaaataaccccattgccttgagttgtaggtgccactactactctggaaaaatggcagatgacgaagactatgaggaggtggtggagtactacacagaagaagtggtttacgaagaggtgccgggagagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccaaataaatacaaggagaagtttgagaaaacaaaaggacagccatacgccagcacaacagatactccagaacttcgcagaatcaaaaaagtacaagatcaactcagtgaggttaagtatcgaatggatggtgatgtgctaagactatatgtcacgtagatgaaaaagcaaggattttgacctgcaagaaagtgtcgcagcaggtcagtaaggtttatacaagcagaactgggaagacccaggataagtactgttcctcctgatgcccctgaacttgtccaggccgttaagaacaccgccatgttcagcaagaaactgtacactgaagactgggaagcagacaaaagtttgttttacccctataatgatagcccggaactgaggagagttgcccaggcccagaaagctctcagtgatgttgcctacaaaaaaggtctcgctgaacagcaagctcaattcacgcctctggccgatcctccagatatagaatttgccaagaaagtaaccaatcaagtgagcaagcaaaaatacaaagaagactatgaaaataaaatcaaaggcaaatggagtgagacaccttgctttgaagttgcaaatgccagaatgaatgctgataacattagcacaaggaaataccaggaagattttgaaaacatgaaagaccagatctacttcatgcagaccgaaacaccagagtataaaatgaataaaaaagctggtgtggcagctagcaaggtaaaatacaaagaagactatgaaaagaataaaggaaaagcagattataatgtgcttcctgcttcagagaacccacagcttaggcagctgaaggcagcaggagatgccctaagtgacaaactatacaaggaaaactatgaaaagacaaaagcaaagagcataaattactgcgagacccccaaattcaagctcgatactgttctgcagaacttcagtagtgataaaaaatataaagattcctacttaaaagatattttgggacattatgtaggcagcttcgaggatccataccattcacactgcatgaaagtcacagctcaaaacagtgataaaaactacaaagcagaatacgaagaagacagaggcaaaggcttcttccctcagaccataactcaagaatatgaagcaattaagaaactagatcagtgtaaagaccacacctacaaagtccatccagataagacaaaattcacccaagttacagactctcctgttctgctacaagcccaagtcaattccaaacaactgagtgacttaaattacaaagcaaaacatgaaagtgaaaagttcaagtgccatatcccccctgatactcctgcttttatccagcacaaagtcaatgcctataacttgagtgataatctttataagcaagactgggagaagagcaaagccaaaaagtttgacattaaagtggatgccattcccctgctggcagccaaagccaacaccaagaacaccagcgatgtgatgtacaagaaagactatgaaaaaaacaaagggaaaatgattggagtcctcagcattaatgacgatcccaagatgctgcactccttgaaggtggccaaaaaccagagtgatagattatacaaggaaaactatgagaagacaaaggcaaagagtatgaattactgtgagaccccaaaatatcaacttgatactcagctgaagaacttcagtgaggctagatataaagacttatatgtaaaggatgttttgggacattatgtaggcagcatggaggacccatatcacacacactgcatgaaagttgcagctcaaaacagtgataaaagttacaaagcagaatatgaagaagataaaggaaaatgctatttccctcagacaataacacaagaatatgaagcaatcaagaagctggaccagtgtaaagatcatacctacaaagttcatccagataagaccaaattcacggcagtcactgattctcctgtactgttgcaagcccagctcaacacgaaacagcttagtgatctgaattacaaagcaaaacatgaaggtgagaagttcaagtgccatataccagcagatgctccacagtttatccaacacagagtcaatgcctataatctgagtgataatgtttataagcaagactgggagaagagcaaagccaagaagtttgacattaaagtggacgccattcccctgttggcagccaaagccaacaccaagaacaccagcgatgtgatgtacaagaaagactatgaaaagagcaaagggaaaatgattggagccctcagcattaatgacgatccaaagatgctgcactccttgaagacagccaaaaaccagagtgatcgcgaatatcgaaaagattatgaaaagtcaaaaactatctacacggcacctcttgatatgctccaagtcactcaagctaagaaatctcaggcaattgccagcgacgttgattataagcacatcttacacagttacagctacccccctgatagcatcaatgtggaccttgccaagaaggcatatgcgctgcagagcgatgttgaatacaaagctgactacaatagctggatgaaaggttgtggctgggtgccttttgggtccttagaaatggaaaaggcaaagcgagcttcagacatcctcaatgagaaaaaatatcgccaacatccagacaccctcaagtttacctcgattgaagatgctccaattacagtacagtctaaaattaaccaggcccagaggagtgatatcgcttacaaagccaaaggagaggaaattattcacaaatacaacctgccaccagacctgccccagttcatccaggctaaagttaatgcctacaatatcagtgagaatatgtacaaagcagacttgaaagacttgagcaagaagggatatgacctgagaactgatgcgattcccatcagagctgccaaagctgccaggcaggcggcgagtgacgttcagtacaaaaaagactatgaaaaggctaaagggaaaatggttggcttccaaagtcttcaagatgaccctaaactggttcattatatgaacgtggccaagatacaatcagatcgggagtataaaaaagactatgagaagacaaagtccaaatacaacacgccccatgatatgttcaatgtcgtggcggctaagaaagcccaggatgtggtcagcaatgtcaactataagcattctctccatcattacacctacttgcctgacgccatggacctggagctgtctaagaacatgatgcagatacagagtgataacgtctacaaggaagactacaacaactggatgaaaggcattggctggattcctattggcagtctcgacgtcgaaaaagttaaaaaggccggtgatgctctgaatgaaaagaagtacaggcaacatccagacaccctcaaatttaccagcattgtggactccccagttatggtccaggcaaaacagaacacgaagcaagtcagtgatatcttatacaaggctaaaggagaagatgtgaaacataaatacaccatgagtcctgatcttcctcagtttctccaggccaagtgcaatgcttacaatataagtgacgtctgttataaacgggattggcatgacttaatagccaagggcaacaatgtgctgggcgatgctattcccatcactgcagccaaggcatcgagaaacattgccagtgattataaatacaaggaagcttatgagaagtcaaagggaaagcatgtgggtttcagaagcctccaggatgatcccaagctggtccactatatgaatgtggcaaagctgcagtctgatcgtgaatacaagaagaactatgagaacaccaaaaccagctaccatacccctggggacatggttagcatcacagctgcaaagatggcccaggatgtcgctaccaatgtcaactacaaacagccattgcatcattacacatacctacctgacgccatgagtcttgagcatacnaggaatgtcaatcaaattcagagtgataatgtgtataaagacgagtataacagcttcttgaagggcatcggatggatccctattggttccctggaggtggagaaggtcaagaaagcaggcgatgcattaaatgagaggaagtatcgacagcacccagataccgtcaagttcacaagtgtgcctgattccatgggcatgntgttggctcagcataacacaaagcagctaagtgatttgaactacaaggtagagggagagaaactgaagcacaagtatactattgaccctgaattgcctcagtttattcaagccaaagtcaacgccctcaacatgagtgatgctcattataaagcagattggaagaaaaccattgccaagggctatgatttgagaccagatgccatcccaattgttgctgcaaaaagttcaaggaatattgctagtgattgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgataatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttacgccatggacacaatggaacaggcacttaacaagagtaacaaactgaacatggacaagaggctctacactgaaaaatggaacaaggacaagaccaccattcatgtcatgcctgacacaccggatattttactctccagagtaaaccaaatcaccatgagtgataaactgtacaaagctggctgggaagaggaaaagaagaaaggatatgacctgaggcctgatgccattgcaataaaggctgcaagagcctctagagacattgccagtgattacaaatacaagaaagcctatgaacaagccaaagggaaacacattggcttccggagcctggaagatgaccccaagctggtgcacttcatgcaagtggccaagatgcagtcagaccgggaatacaagaagggatatgagaaatccaagacctccttccacaccccggtggacatgctcagtgtggtggcagccaagaagtctcaggaagtggccaccaatgccaactacaggaacgtgatccatacctacaacatgcttcctgatgccatgagctttgaattggccaaaaatatgatgcagattcaaagtgataatcagtacaaggctgactatgctgacttcatgaagggcattggatggctccctctgggctccctggaagcagagaaaaacaagaaagccatggagattattagtgaaaagcccnantnccgccagcacccagacactttgaagtattccacactcatggactcgatgaacatggttttggcccagaataatgcaaaaattatgaacgaacatctctacaaacaagcatgggaggctgacaaaaccaaagtccacatcatgcctgatatcccccagattattttggcaaaggcaaatgcaattaatatgagtgataaactctacaaactttccttggaagagtctaaaaagaaaggctatgatctcagacctgatgcaattcctatcaaagctgccaaggcttccagagatattgcaagtgattataaatacaagtacaattatgaaaaagggaaggggaaaatggttggtttccgcagtctcgaggatgatcccaaattagtccattccatgcaagtggctaagatgcaatctgatcgggagtacaagaaaaactatgagaacacaaagaccagctaccacacccctgccgacatgctcagtgtcacggctgcaaaggatgcccaagccaacatcaccaacactaactacaagcacctgattcacaagtacatcctccttccagatgcaatgaacattgagctgaccaggaatatgaatcgcatacagagtgataatgaatataagcaagattacaatgaatggtacaaagggcttggctggagtccagcaggttctctggaagtggagaaggccaagaaagcaactgaatatgccagtgatcagaaataccgccagcacccgagcaacttccagtttaagaagctgactgattccatggacatggtgcttgccaagcagaatgcacataccatgaacaagcatttatacaccattgattggaataaagataagaccaagattcatgtgatgcctgatacaccagatattttacaagccaagcagaatcaaacactgtatagtcagaaactctataaacttggatgggaagaagctttgaagaaaggctatgatctcccagttgatgcaatttctgtacagctagctaaagcttcaagagacattgctagtgattataaatacaaacaaggctaccgaaagcaacttggccaccatgttggattccggagtctgcaagatgacccaaaacttgtgttgtccatgaatgtagccaaaatgcagagtgaaagagaatacaagaaggactttgagaagtggaaaactaagttctccagcccagtggacatgttgggagtggtactggccaagaagtgtcaggagttggttagtgacgtggactacaagaactacctgcatcagtggacatgtctgcctgatcagaacgatgttgtgcaagctaagaaagtttatgaactgcaaagtgagaatctatataaatctgaccttgagtggctgagaggcataggatggagtcccttgggttctttagaggcagaaaagaacaagcgggcttcggaaatcatcagtgagaagaaatatcgtcagcctccagacagaaacaagttcaccagcattcctgatgccatggatatagttctggcaaagacaaatgccaaaaataggagtgatagactttatagagaagcttgggacaaagacaagactcagatccacatcatgcctgatacacctgacattgttctggctaaagcaaacttaatcaacacaagtgataaactctaccgaatgggttatgaggagctgaagagaaaaggttacgatcttcctgttgatgccataccaatcaaagcagcaaaagcctcccgggaaattgccagtgaatacaagtacaaggaaggctttcgcaagcagctcggccaccacattggtgcccggaacattgaagatgaccccaagatgatgtggtccatgcatgtggccaagatccagagtgacagggagtacaagaaggactttgagaagtggaagaccaagttcagcagcccagtggacatgctgggggtggtgttggccaagaagtgccagaccttagtcagcgacgtggactacaagaactacctgcaccagtggacatgcctgcccgaccagagcgatgtcatccatgctcggcaggcctatgacctccagagcgataatttgtacaagtcagaccttcagtggctaaaaggcattggctggatgactagtggttctctcgaggatgagaaaaataaacgagccacccagattttgagtgaccatgtttaccgtcagcacccagatcaatttaagttttccagccttatggattccataccaatggttttggcaaaaaacaatgctattaccatgaatcatcgcctctatacagaagcttgggataaagataaaaccactgtccacattatgccagatacccctgaagttttattagctaaac

SEQ ID NO: 593545 - DNA, 774 bp, Homo sapiens
caatcattttagatgaattgcaaacaaaattcaatgactttctgcctgaaagaaacttaaatttaagtatggaaagacttttgtttctgataattaccagaagttttttttaaacaaaaaaaaaaactatgctaacttatgttttaataaactaaatgactaaccttaaaatatctatggagcaactaggaaactagcgaacaaagatttcataaaagaaggaggaaagacccaaattagaacttctaaagaagaacaaatacactagcaaagctaaacaatttacattgaaccttgttctgacaacacggttggacttagccaaagagagatctcattgatttcgaagatagatcagaagcttcttcagaatgatcctagaaaagccaaagggtcggaaataccgcaagggaacttaagagcataagaacaatacggtgcaaaagatctaacatatgttggacttagagtccagagaggacgaacgtggcgccagaggcaataacttacacgcagatcttgactggggatttcccagaaattgcttaaagacttgattttccagcatttaacgagcgtccagctgaaatcccaaacagaattacttaacactgatttccaccagttagacttaccagaagctgaacctggttgaaaaccaaaagacggcagacaccttttaaaagcagctcggacgaaaggaccgattactccctagggaatttcaggttagaactaattagctggacttctctgtggacatattgttaggca

SEQ ID NO: 593546 - DNA, 152 bp, Homo sapiens
atcgtgccattgcactccagcctgggcaacaagagtgaaactccgtctcaaaaaagagaaaaagaaaagaaaagaaaaagaaacagaaggaaaagaaagaaagagaaaagaaaagaaaagcacttcaaacagtgcctggcatgtaatgagtc

SEQ ID NO: 593547 - DNA, 5826 bp, Homo sapiens
  misc_feature (4462)..(4462): n is a, c, g, or t
  misc_feature (4661)..(4661): n is a, c, g, or t
aggcatcacgctggctttgcctggggttctcaggaggggagagtgggagaggcttgctgctgaggaaatttatttggtagattgaaggtttgaacgagagctacagaaacgaaagaaaaagtctgtataagccaatggtgttcgggaagaaaataaccccattgccttgagttgtaggtgccactactactctggaaaaatggcagatgacgaagactatgaggaggtggtggagtactacacagaagaagtggtttacgaagaggtgccgggagagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccaaataaatacaaggagaagtttgagaaaacaaaaggacagccatacgccagcacaacagatactccagaacttcgcagaatcaaaaaagtacaagatcaactcagtgaggttaagtatcgaatggatggtgatgtgctaagactatatgtcacgtagatgaaaaagcaaggattttgacctgcaagaaagtgtcgcagcaggtcagtaaggtttatacaagcagaactgggaagacccaggataagtactgttcctcctgatgcccctgaacttgtccaggccgttaagaacaccgccatgttcagcaagaaactgtacactgaagactgggaagcagacaaaagtttgttttacccctataatgatagcccggaactgaggagagttgcccaggcccagaaagctctcagtgatgttgcctacaaaaaaggtctcgctgaacagcaagctcaattcacgcctctggccgatcctccagatatagaatttgccaagaaagtaaccaatcaagtgagcaagcaaaaatacaaagaagactatgaaaataaaatcaaaggcaaatggagtgagacaccttgctttgaagttgcaaatgccagaatgaatgctgataacattagcacaaggaaataccaggaagattttgaaaacatgaaagaccagatctacttcatgcagaccgaaacaccagagtataaaatgaataaaaaagctggtgtggcagctagcaaggtaaaatacaaagaagactatgaaaagaataaaggaaaagcagattataatgtgcttcctgcttcagagaacccacagcttaggcagctgaaggcagcaggagatgccctaagtgacaaactatacaaggaaaactatgaaaagacaaaagcaaagagcataaattactgcgagacccccaaattcaagctcgatactgttctgcagaacttcagtagtgataaaaaatataaagattcctacttaaaagatattttgggacattatgtaggcagcttcgaggatccataccattcacactgcatgaaagtcacagctcaaaacagtgataaaaactacaaagcagaatacgaagaagacagaggcaaaggcttcttccctcagaccataactcaagaatatgaagcaattaagaaactagatcagtgtaaagaccacacctacaaagtccatccagataagacaaaattcacccaagttacagactctcctgttctgctacaagcccaagtcaattccaaacaactgagtgacttaaattacaaagcaaaacatgaaagtgaaaagttcaagtgccatatcccccctgatactcctgcttttatccagcacaaagtcaatgcctataacttgagtgataatctttataagcaagactgggagaagagcaaagccaaaaagtttgacattaaagtggatgccattcccctgctggcagccaaagccaacaccaagaacaccagcgatgtgatgtacaagaaagactatgaaaaaaacaaagggaaaatgattggagtcctcagcattaatgacgatcccaagatgctgcactccttgaaggtggccaaaaaccagagtgatagattatacaaggaaaactatgagaagacaaaggcaaagagtatgaattactgtgagaccccaaaatatcaacttgatactcagctgaagaacttcagtgaggctagatataaagacttatatgtaaaggatgttttgggacattatgtaggcagcatggaggacccatatcacacacactgcatgaaagttgcagctcaaaacagtgataaaagttacaaagcagaatatgaagaagataaaggaaaatgctatttccctcagacaataacacaagaatatgaagcaatcaagaagctggaccagtgtaaagatcatacctacaaagttcatccagataagaccaaattcacggcagtcactgattctcctgtactgttgcaagcccagctcaacacgaaacagcttagtgatctgaattacaaagcaaaacatgaaggtgagaagttcaagtgccatataccagcagatgctccacagtttatccaacacagagtcaatgcctataatctgagtgataatgtttataagcaagactgggagaagagcaaagccaagaagtttgacattaaagtggacgccattcccctgttggcagccaaagccaacaccaagaacaccagcgatgtgatgtacaagaaagactatgaaaagagcaaagggaaaatgattggagccctcagcattaatgacgatccaaagatgctgcactccttgaagacagccaaaaaccagagtgatcgcgaatatcgaaaagattatgaaaagtcaaaaactatctacacggcacctcttgatatgctccaagtcactcaagctaagaaatctcaggcaattgccagcgacgttgattataagcacatcttacacagttacagctacccccctgatagcatcaatgtggaccttgccaagaaggcatatgcgctgcagagcgatgttgaatacaaagctgactacaatagctggatgaaaggttgtggctgggtgccttttgggtccttagaaatggaaaaggcaaagcgagcttcagacatcctcaatgagaaaaaatatcgccaacatccagacaccctcaagtttacctcgattgaagatgctccaattacagtacagtctaaaattaaccaggcccagaggagtgatatcgcttacaaagccaaaggagaggaaattattcacaaatacaacctgccaccagacctgccccagttcatccaggctaaagttaatgcctacaatatcagtgagaatatgtacaaagcagacttgaaagacttgagcaagaagggatatgacctgagaactgatgcgattcccatcagagctgccaaagctgccaggcaggcggcgagtgacgttcagtacaaaaaagactatgaaaaggctaaagggaaaatggttggcttccaaagtcttcaagatgaccctaaactggttcattatatgaacgtggccaagatacaatcagatcgggagtataaaaaagactatgagaagacaaagtccaaatacaacacgccccatgatatgttcaatgtcgtggcggctaagaaagcccaggatgtggtcagcaatgtcaactataagcattctctccatcattacacctacttgcctgacgccatggacctggagctgtctaagaacatgatgcagatacagagtgataacgtctacaaggaagactacaacaactggatgaaaggcattggctggattcctattggcagtctcgacgtcgaaaaagttaaaaaggccggtgatgctctgaatgaaaagaagtacaggcaacatccagacaccctcaaatttaccagcattgtggactccccagttatggtccaggcaaaacagaacacgaagcaagtcagtgatatcttatacaaggctaaaggagaagatgtgaaacataaatacaccatgagtcctgatcttcctcagtttctccaggccaagtgcaatgcttacaatataagtgacgtctgttataaacgggattggcatgacttaatagccaagggcaacaatgtgctgggcgatgctattcccatcactgcagccaaggcatcgagaaacattgccagtgattataaatacaaggaagcttatgagaagtcaaagggaaagcatgtgggtttcagaagcctccaggatgatcccaagctggtccactatatgaatgtggcaaagctgcagtctgatcgtgaatacaagaagaactatgagaacaccaaaaccagctaccatacccctggggacatggttagcatcacagctgcaaagatggcccaggatgtcgctaccaatgtcaactacaaacagccattgcatcattacacatacctacctgacgccatgagtcttgagcatacnaggaatgtcaatcaaattcagagtgataatgtgtataaagacgagtataacagcttcttgaagggcatcggatggatccctattggttccctggaggtggagaaggtcaagaaagcaggcgatgcattaaatgagaggaagtatcgacagcacccagataccgtcaagttcacaagtgtgcctgattccatgggcatgntgttggctcagcataacacaaagcagctaagtgatttgaactacaaggtagagggagagaaactgaagcacaagtatactattgaccctgaattgcctcagtttattcaagccaaagtcaacgccctcaacatgagtgatgctcattataaagcagattggaagaaaaccattgccaagggctatgatttgagaccagatgccatcccaattgttgctgcaaaaagttcaaggaatattgctagtgattgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgataatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttacgccatggacacaatggaacaggcacttaacaagagtaacaaactgaacatggacaagaggctctacactgaaaaatggaacaaggacaagaccaccattcatgtcatgcctgacacaccggatattttactctccagagtaaaccaaatcaccatgagtgataaactgtacaaagctggctgggaagaggaaaagaagaaaggatatgacctgaggcctgatgccattgcaataaaggctgcaagagcctctagagacattgccagtgattacaaatacaagaaagcctatgaacaagccaaaagcaaagagcataaattactgcgagacccccaaattcaagctcgatactgttctgcagaacttcagtagtgataaaaaatataaagattcctacttaaaagatattttgggacattatgtaggcagcttctgatccataccattcacctgca

SEQ ID NO: 593548 - DNA, 415 bp, Homo sapiens
cgcggaagctgaagtctgttatcccagctctctggcaggcctagccgggaggagcaccacaggagcagattaagaccatcctgtttaagacaacgataactggtcttttctatacacaatcttaattctgcgaggtggcgggcgcttgttagacgagctactcttgtgggtgttgacggcgaaaggtgcaatccctggaaggtgcctcctgtgttgagcacaatttgtcttacctgactgcaggccgggcgacagcaagagtatctatcttagtggagagttacatcgcttggtcactgaataaccctgaccatttctgatgctgttggcgcgactagaagcctcttctctggcagctgtgggcctgagatttggtaggcccagcaggctccgggtgccatgggctcttgcgccc

SEQ ID NO: 593549 - DNA, 478 bp, Homo sapiens
taaaagactttatacaccatcactcttttttttaaaaagcatgggggaactggggttaaatacccaaagcaccccaagaccttcgggtagtatatagtcagttgtacaaagacagaatgggttttcgtggaccagagaggcttaatttttcaaaatttttcagaaagcatgcagacgcgagggatcaggcttgccttccttcaacggccaaaaacgacatgggctatgtccataccggaggggatgtcaggccacatccaagcggcactatcctaagtctttttacaggggggactgtttcaaggggatgactccgatacctttatgaatgcccattttgggagcatccccttggcctcaatatgactgaaagtcttgacagaaaccggagatgtcccagttgttgaacttaaggcacttcttgggaccacctcggagctcatgccacaactggtggagagaattgctcgtaacgatt

SEQ ID NO: 593550 - DNA, 1423 bp, Homo sapiens
gggaatgagcttcattacagtgtgactgccgacataacaagttacaaagacaaattgtgactttgtatgccgcttcacgagatgtgcacatgatattgtcgtcactcttgaacgacatatctacacgatactgccgtcttgattatgtgcaacgggatataacgatctagtagaagtccttgattattcgatactagcttaaatctatgttagctcttctgcttgggaggacatggccactgttctatcagtcatttaaccagtacctggcagcaatccaaagtcatcgtgtttatgaagacaacaggatcgaagtggctcacgaagtggtatctagcaactctcgaggcaggagaccagttccagtgcctggaatcttgtagacttaacctgagtgcatcgtagagatgggttgcttcggccatgattcgttccttgcagtgaccttttgcttgcagtgcgctagaagagagctccggggctagagcacggatcagaatagcaacacgtagactcatccgttcatagcacacatagtgcccagaacgccttattcgaataatctctcgcgatgttgtcatccgcacatctctcaaatcggtaggcatcgcatgcgcgggttcgaacacaaaagatctccgatactgcgcggctttgctgaattagctcttagtccaagtccatttggagaccaggcgaacgttccattcacgtgagggttgacccacttctcactccctcgctaaccacttattttccctttaaagaacccgtggcagagaattgcgagatccgcatttggcgtaaaaacatgtggtcgcaatgtggggcgcctgatcttgccacgagcgcaaacatccgctccccttttcttccatggcaattgtgtcacactccttgcggcgaacgtctactcccttgcggtccgttgggggaccgtttgctaaggtgcgcctctataggtgacgagcgaacttcgccacaatactcttctcacagcacaatgccacacgttactacacggcattatcggatttggaccctaatgtgggtgggagcccaaatacatgtggccgctatctattgaccaattacacagaatttccaccccacaatctggcttttatcagccgccttggtaaagatcaaataggggatacaatcagctcataggcccttcaaagaaaaccgccccaaagtacttctcaattacagagagcccgttactcccgcactgagttatcaccacgccaattccacaaaccttacaaactggctcggaagcgtcgttaccacacccttcggtcatacgccggcgcccactccaccagtatcagacacaaaaaaatacagccaatacacccaggatgaacgataccagttacatgcttcgagttactgtaacatacacgcctaccgccgt

SEQ ID NO: 593551 - DNA, 519 bp, Homo sapiens
acattctaccattttcatcataacctttttttattcctactcaccctttacatctcccaccacgagggctttgggagacccaatcttgtctctccacctaacaccctttaacttaataccacccacactcatgcccttaaagagactccataatgcaagtgcaagtatacccttcccaagaccaaagcgtaaaagaaatataattccatcttcccttttcaaggctcaattctttctcctcctcgaaacctgaacataatgtctcacctctagataaacataattctgaagaagtggcaaacctcatacctcttttaatgtgcctctgacctctaatgaaagttaacacaatttccaataacagcccaaaaattcgtgtaaacgccccaacctccaaaagaggttaaacttacatgccggctctctattttattaccgtactcgattaccttcgctataaccgtgtttctgacacaggtcaaatcctcccaaatccagtccccgtacttcaccaattcg

SEQ ID NO: 593552 - DNA, 269 bp, Homo sapiens
tgggtactttgccgtcaatggggacaacttgactttccggattggccaagttcattcttggctcccttgggttttcccattcggctttccatggggggtttttattagttccttccccttgccctgcagagaagagaacccttccaggggggaaggccacccaccatcctgacccagggaggttccaacttttcccaatttacctggggtgaaatataccaaattttgcatttcccggggaaaataagaaataaagatgaattgttgca

SEQ ID NO: 593553 - DNA, 203 bp, Homo sapiens
gaattcccccccccccccccccccctattggggaatctctattatttggggatttaaagatatttttaaaactatgataactttatctaagttttatggtttactttaactggtaaaaaacacagaaaaatttagaattaaaaaaaaaatttttttttggggtggagatggagtctcactgtgtctcctgtgctggagtaaag

SEQ ID NO: 593554 - DNA, 397 bp, Homo sapiens
  misc_feature (74)..(75): n is a, c, g, or t
  misc_feature (97)..(98): n is a, c, g, or t
gtgatgggagagagcatccttgtcttgtgccagttttcaaggggaatgcttccagcttttgcccattcagtatnntgttggctgtgggcttgtcaannctttcttgcttttctttttttctttctctttttttttgagacagagtttcgctcttgttgcccaggctctggagtgcacggcacaatctggctcactgcaacctccgcctccaggttcaagcagttctcctgcctcggcctcctgagtagctgggatacaggcacgcgcacaatgcccagctaattttgtattagtagagacagcgattcttcatgttggacaggctggtctcaactcctgacctcaggcatctgccacctcggtctcccgagagctgggatacagatatgagcaccgt

SEQ ID NO: 593555 - DNA, 303 bp, Homo sapiens
accccgtcgttggaagtggggcctggtgggaagcgactggatcttgagggtggatttatatgaacagctcagcgctatccccttggtgctgttctcacgatagtgagtgagttctcgtgagatccggtggcacacctcccacctcgcgctcttgcccccgctctcgccgtgtgagacacctgctcccccttcaccttctgccatgactggaagcttcccgaggcctccccagaagcagatgcctccatacttcctgtacggcttgcagcaccgtgaccaataaaccccgtttattttgaaaaa

SEQ ID NO: 593556 - DNA, 820 bp, Homo sapiens
taaaaccccggtcctggggggggtgggggtataatactaagtggaaatgatatcatttacgggggaaggcccttggtgaagtaggccttatttctctgtgtccttccgtacagggaggaatttgaattaaataaaaaccgacctggattactcccggtctgaactcagatcacgtaggactttaatccgttgaacaaacgaacctttaatagcggctgcaccatcgggatgtcctgatcccaacatcgaggtcgtaaaccctatggttgattatggactctaaaataggatggcgctgtaatccctagggtaactggtcccgtgggccacagttatgggatcactggagtatagtagtccgcttggactggggtgaagtcttagcatgtactgggctcggaggtggggtctctggccccgaggtcgccccaaccgaaattttaatggcaggttgggagttaggaccttgggggttggtaggtacggttggcatattaaatcaaagctccatagggtctctcgtctggctgtgtcatgcccgctcttcacgggaaggtcaatcttcagtggtcaaaagtaaagagacagttggaccccttcgtggaagacattccatacgcggtccccaaattaggcacacagtgattatggctacctttgccgggttagggtacccgcgccggtaacattgtttccctgggcaggcgcgggcgcaaaatcgggatgcaaagcgagatgttcggcaccagccgcggcaaaattgccagatccttaacttttaaaccttcctataacatccggtcttggtgacagaggacaa

SEQ ID NO: 593557 - DNA, 204 bp, Homo sapiens
aagctaagtagccctgcattttggtttgttgaacaacgatctacttttacctcaagattttgaccgtctaaaaccggactggtttagaaaaccctcggggttatctcgaatatgtgagtccaacattggtcctccatagcccgggggctcaatgataaacctgactcctacataccacatccacacctgaacaccagaagcccg

SEQ ID NO: 593558 - DNA, 250 bp, Homo sapiens
acacacacacacatatttttttgtgtagagactgagtttggcatgttgcccaggctggtctcgaactcctgacctcaagccgtccttccgcctcggctcctgaagcacaggggccacaggtgcacgccaccactcccggctaatttttgtatttttttatagagatggggtctcgccttgttgcccaggctggtcaacgagagagaaaagtatttcagagacttaaaaaaagaaccatcggtggtctcca

SEQ ID NO: 593559 - DNA, 698 bp, Homo sapiens
  misc_feature (4)..(4): n is a, c, g, or t
  misc_feature (70)..(70): n is a, c, g, or t
  misc_feature (156)..(156): n is a, c, g, or t
  misc_feature (161)..(161): n is a, c, g, or t
  misc_feature (177)..(179): n is a, c, g, or t
  misc_feature (191)..(191): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (209)..(209): n is a, c, g, or t
  misc_feature (217)..(218): n is a, c, g, or t
  misc_feature (220)..(220): n is a, c, g, or t
  misc_feature (302)..(302): n is a, c, g, or t
  misc_feature (304)..(304): n is a, c, g, or t
  misc_feature (356)..(356): n is a, c, g, or t
  misc_feature (359)..(359): n is a, c, g, or t
  misc_feature (378)..(378): n is a, c, g, or t
  misc_feature (390)..(390): n is a, c, g, or t
  misc_feature (459)..(459): n is a, c, g, or t
  misc_feature (522)..(522): n is a, c, g, or t
  misc_feature (556)..(556): n is a, c, g, or t
  misc_feature (575)..(575): n is a, c, g, or t
  misc_feature (580)..(580): n is a, c, g, or t
  misc_feature (685)..(685): n is a, c, g, or t
cggnttttttgttgcgaacccttcatctatcactgctgatttcctttgacatgaaatatgactttttganaattttcctaaacctcactctggctgcacctgagtggttcctattcctacggttttttttttttttttttggtttttttttttttnttttnttttttgggttatttnnnttttttttttcnatttctntgcnattngtntggttttnncnttcagctgattgacaaactttgctgctagctccagatcaccatgctcaatgcaataggaagcatattttatttttttttttntnttttttttttttgggcagagctctgggggcggcttcagttgctgaggtgggnttnggtgtagggattgttggtnggtgaggaagtnctggtacaagctatttctggtttcttcaatcattgctacccttcgggccagtttttgaacagcataganacgggctctaagggtctcttcactgtacaccccacgggtcagggactctggagggatagctgnggttaaaacttgggtgaattcattatcagaacanttggctttgatggcctcanccgcnctacccagcgggatagtaggtgtttctgcagatgaggtcttcatgctgtactttaatgcctccactgaaagccagaagttggtgggcttttctggcttcctcttnagcaactgcatgg

SEQ ID NO: 593560 - DNA, 495 bp, Homo sapiens
tcttccggtatgtgcatacaattcgtcagtccagtaaacgggctgggcactccagctccagccgataggacaggttctcagggtgcacacgcagttctccaccgtcttgtgtcgtaatcggatgtgttcacacacgtgtggatcacatacaacagtgagtctaccagaccctcgcaggaccgcatttgcttccgagcttcttcccccggggagctgaggttccttaggcaacctgtcgggttacgcagaactagtgaagtctgacatttcattttatgatcatcatcaaaagcagagttattccatccagaatgtggaacaatcacagtgttggttagggttgagagagcatctcgaatgatggtcatttttacagcatcacatgaggatacattccaaagaactcctgtaacaagctcccttacttctgcatcaatagattttctcaacagtcgcaaccacaggatggacaaacccggaaggggtaccgagctc

SEQ ID NO: 593561 - DNA, 748 bp, Homo sapiens
ggaagcggccgcgatgtcctttgtgtcctacaagcagccggcggcgccgccgagtgaggggacgcggcgcggtggggcggcgcggccgaggaggcggcggaggaggggccgcccgcggcccccggctcactccggcactccgggccgctcggcccccatgcctgcccgaccgcgctgccggagccccaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgctcccaggccacaaaggaagaggaggatggggagggggctgggcctgggcgagcagggcggtggggaagcttggtgctcgggtccctgcgcaagcgcgtctggctggtctgtggggacgtggctccgggtgccactattggtgtggcatcctgtgaggtcctgaaggcctttcttcaagaggaccctccagggggagcatcgagtacagcgtgtccgggctccaacgagtgtggagatcaccaagggggagaccgcaatgcctggcagggctggcggttcaacaaagtgctgcggggtgggcatgcctccacggagggagtgcgcctggaacgcggcgggggggggggcagaatacacagcgggggcggaaggggacccactgccttccggggcccttaccggttgggcc

SEQ ID NO: 593562 - DNA, 87 bp, Homo sapiens
gcggccggctactactactactgctcgaattcaagcttctaacgatgtacggggacatgtcccatttcagacagagtaaccattaac

SEQ ID NO: 593563 - DNA, 436 bp, Homo sapiens
  misc_feature (199)..(199): n is a, c, g, or t
  misc_feature (217)..(217): n is a, c, g, or t
  misc_feature (431)..(431): n is a, c, g, or t
caaatatctagagagaaaagaaaaaaaagtttattttaaactgggcaattttgacttcagttgtgcctgaaatgaataatagtaagtagaatttatgagctatcattatatctttccttagccatattttatgactttccaaagtaagctaaagcatatcttacaaactttgacaaccacacaaacataaagatttacnacttaggtgagtaaaggnctgactctgtaataaaataatttgactgtaaaagaatgcttgccttttagtggacattagtcatgttgtctgattggcaacctctcgatgtttggggggaaattattgttttatgagtttcacatcatcaacacagaatgagcaaatttgattttgcagcctcccttgcagctcaaacccagaccatttacacgttttaacgagttccactggntcggg

SEQ ID NO: 593564 - DNA, 486 bp, Homo sapiens
  misc_feature (197)..(197): n is a, c, g, or t
ggtgcggtcgcgctgcccttctacaaccaggaccatgagaagctttgtgagctcatcctcatggaggagatccgcttcccgcgcacgcttggtcccgaggccaagtcgcttgctttcagggctgctcaagaaggaccccaagcagaggcttggcgggggctccgaggagcgccaaggagatcatgcaggcgaatcgncgtatcgtatgtggcacgggtaatcggtgatggacagtcacgtgtacgagaacgaacggcgtcagcccacccttcaagcgcccaggtcacgtcggagactgacaccaggtattttgatgaggagttcacggcccagatgatcaccatcacaccaccatgacctaaggatgacagcatggagtgtcgtggacagcgagcgcaggccccgacttcccccagttctcctactcggccagcggtacgggctgaggcggcggtggactgcgctggacgatagcttggagggatg

SEQ ID NO: 593565 - DNA, 989 bp, Homo sapiens
ctcttcgaaaacacactaatgcccaccttggctatcatcacccgatgaggcaaacagccagaacgcctgaacgcaggcacatacttcctattctagcacacctagtaggctcccttcccctactcagtcgtcgcctaatttactactctacgatacgacccataggctcgactaaaatcattcatacgtcactctacgtctccactcgtcccaagagactatcgtaagactccgtagagccgagacaactgtaaattatagactttacgctgtaacgacaaatgacgcttgtataataagtgaaatgatcaccttgctttacgggactccaactttatggagcttctcccttaaatgcccatggtctgaagaccaccactattcgctggggttctagatcatgatgactatagccctgcagcgtgcgatcttttgcacaacatacgagctggcatcatgtggatataaatactcgccgtcgaccaccggtcgaatttcatcaagactcgcctcgtgaacaaaaatacactaatatgctcatagttcccatgttaccatttgtttggctaattcctcttattgtaaggcaattacaatttattaaaccataggtcgtacccaattcatagcctataccggacaagaaaccaagacccttaagaaatcaggcatacatatgacatacttcctctcaagtcaggctgcatcatttagtccccctacagtagataaacagtccatttactaacatacgctaaaaacaccctcttgagagactattcaccctgggttagtcaatgtccaattgctgctagttaagatccgccgcaagcgggatctttaacatttcactcaattcactgattgctgtcgcctaagccataactacaataatctacggaaatcggcaacttcgacagcgtgcgcattcctattaaattccttcttcttcataggaactttccaaatatattcgtacttccccacta

SEQ ID NO: 593566 - DNA, 393 bp, Homo sapiens
agacctctctgtaggcgaccaataatttcaacttgtgcatcaaactagtttcctatgcttaaacacgcatacacgtatttggtttagaacaattaaacatatgagatgacatcatatatactgattcgcacgtggtaaaactcccccgtcatgcaactagtatttggaccactcatttcatatcagcacagtctgagagcaacctcaattttggtctccacatggttgcacaagatttacaattgcctggagtgtatcaaacttatttaaccagggaacatttcacgatctagaactttcagctgtgaaacaactgctggggaaacaaaaaaaccccttctatatgtgtcactgggcacatcagcaagagtactcttaaatacacctagaata

SEQ ID NO: 593567 - DNA, 345 bp, Homo sapiens
ctgccggtgacttactcgaagcctcggattggccacattttggcactacgccaaggttgagctggttcccccaacccctgctgaaatccctacagctattcagagtgtgaaaaaaatcattcaaagtgctaaaactggtagcttcaaacaccttacagttaaggaagctgtgctgaatggtttggtggccactgaggtgtggatgtggttttatatcggagagatcataggcaaacgtggcattgttggctatgatgtttgaagaccaatctttaacttctgatttgagttcttatttgaatgttcttggaccatgtgtaacaggactgctatctgaataaaata

SEQ ID NO: 593568 - DNA, 159 bp, Homo sapiens
cagactgcaactgcaagcacttctgctttctaaccccagttccttaaatattagaaatcttgtacaatattgtgaaattccagtatgttttgcttacggtgttaataaaattagtttagcatcgtgatagtcattcgagtgacggggagctcgacaggg

SEQ ID NO: 593569 - DNA, 144 bp, Homo sapiens
tgaataacacactgtctcatgagatgagcactttggattggccagccgagaggtctgcacatgaggtggacccaacatacattgttgtggccctgtttccctccacaacatgagacagacgtcagtaaccagtaatcattaatg

SEQ ID NO: 593570 - DNA, 1386 bp, Homo sapiens
  misc_feature (605)..(605): n is a, c, g, or t
tatggtggtttgtgggtgtgttgtgtgtagtttgttggtgtgtcgcgatttcttagcttagatttcgtgttgttgtgatgctgtttatgtgcgttggtggggtatggttagtgggttgtatggtataagtatatagttacataatagaaatcaaaagaactgtgagagacagtagaaacaggttcggcatctttttagtatggcgtgggtgtgtagcacggcgccactgttggggggaagaacgccttagtggcgttaatgagcacgccagagagtggtcctcctttctttcctgaagaggtgtgtgtgtgtgtgcgccgaccgtcccgtgtctctctataagattgttgtgggggacgcctgtcttttcttgcggccgcttaggtggagtcctctcgtattcattgttggtgtattaggcagaggttcgtggtttgtgaggtagtggtgttttcgttgtgtttgtgccggacagcgtgagttggtggggccgggctctttgttttggtgatactatgctgctgtttggtagttctggtagggtgtggtctgcgtcgtggttgggtgtcgtgtcggggtgagtagttttgtcttcctgcgacggnggtgtgttttgtctcgcgccgccacatgagattgttggttttcttcgcgtggggggttctttgtggttgtgcctgattcttggttggtgtggttgtccgtgttgtgtgttgtgttgctgctggtcgctcggggtggtgttggtctgatgtgtgtgtgtgtggtggtgttggtgttggtggaggtggtttttttgttttattgattgtcacactcccctcttgttctatattcatggtggggagcgcgactctctcttttgtgtgtgtaggcccgcgccctcgcggtcgtgtgtcctccaccctctccgcgcaggaggagaagagtgagggtgaagtctactactcgcccgtcggaggaggaggatgcgcttcacgtattttcttataagttaataaggtggcgtattgactggtgttggttcgctgcccgcgcgccgcgcgggtgaataaattaaattaataagtaagagtggtctcccctcgttactttgtttttctctctctctcctcgacatctttttgtttgttatgcattaaaaatatataatgatcgagaagatcccaccgctcagttgtattggttgagtgagttgcatgctcgtggctgttgttcgttgtggtagcagtgtttgctttttgtttgatgatccacccgcggagggagggcacgacgacggaagaatacttagtagagagcaggggaggaggaggcccccccccccccctcccttttttttgcccccctccatcttttggggcaaaaaaaaaactttttttttta

SEQ ID NO: 593571 - DNA, 438 bp, Homo sapiens
  misc_feature (352)..(352): n is a, c, g, or t
ccaacatggtaaggccctatgtctataaaaaataaacataaaaaagcacttctcagcttcatacttagaactggatcattgacaaaattatattcattattaacaataaatagattgtgaattctaggaagggcaagcttcaccccaattcctcaaagcagagagatgccctccactctctggctttctcagcactcagctgagaacctcggctaacaacacactgcacggggttggccacatgcccattggcctttcccagtgggccgtgaacttcttgacttctcaggaagggggtcgttcatcttggttccacagcctggagtggagtaagggttccactcatatttgnggtctgagtgagcacacccagtctgtttatccttttcatgttcactttcattcttccagacccggtgacttccccagtgctgaaca

SEQ ID NO: 593572 - DNA, 565 bp, Homo sapiens
  misc_feature (150)..(150): n is a, c, g, or t
ttgccccacgggcagttcccccagagcctgggttttccctgtttggggagccccgtttcctatttcccccccccgggggggggtggtttggggcccccccccaaccttaaaaattgtttttaaaagggccggtttttccccttttaaagnggccccttttaggggggggggtttttcccccccacaaaaaaaaagccaagccaaccggcttttcccggggaatcccctggagggggttttttttttggaacccaaaacgggcccggggaaccccgggccccctaaattattgggccgtttttccccccccccccgcccccggggggccaaaaacccctttgggggggttccccccccccccgggccccccccaagggggttttttggcccaaaggggggtttccggcccaaccaacgggtttggggggggaaaaccccccccgggggccccgtttttccccccccccttttccccctgggggtggggcaaattttttcccccccttgccccctaaaaaaaagggggggtccttttttaagcccaaaaaaaaaattttttttttta

SEQ ID NO: 593573 - DNA, 474 bp, Homo sapiens
  misc_feature (20)..(20): n is a, c, g, or t
  misc_feature (27)..(27): n is a, c, g, or t
  misc_feature (68)..(68): n is a, c, g, or t
tttaaagggaaaaactaaanaaccaanccctctgtaaaaaagctgaaaaaagggaaaaaaaatacccnaaaacccctagtaaaaaattttttccctccccagtgccttaatccatccccttaatgattaatcctcagtgaagcaagtggatgcctaaagaaatacccctaatggggcccaggcgtggtggtttacccctgtaatccccaacattctgggaggccgaggtgggcagatcgtttgagctcaggagttcaagaccagcatgtgcaacatggcaaaaccccatctttacaaaaactacaaaagttagccaggcatggtggcatgcacccacagtcccagctacttgcagggctgaggcaggagaattgtttgagtccaggaggtcagggctgcagtgagctaagtaagatcgcaccactgcattccagcctgggtgacaaagtgagaccctgtctccaaaaaaaaaaa

SEQ ID NO: 593574 - DNA, 506 bp, Homo sapiens
  misc_feature (2)..(2): n is a, c, g, or t
  misc_feature (6)..(6): n is a, c, g, or t
cncttngggaaaaacccccgggagttttgggggaaatgacgcgggagggtaaagtatagcaaggggtttttgaccaggcgaaagatttgtggcctaagaggggacacagttagggagctggggtgagaatgagggatagaagccaaacctgcggggcgggaaacacagagcatatgcaggtaaagacgaggagtataggtaagaaaagagggcgacctgataaaagagcctcatggcgaaatgggtatgaagaggcgagaacgactgaagagccgggggaatagatgacggcctagacggcctgagacacggggacgcagaggcagatgaccagggcagcaagaggacgcacggccgaatgggatttccggaggaggaggagggagggggcgcacgatgaagacggggcagacggtaatggctaggagagcagagcgcgacttggaagatgacgggcggcatgggcggtaaatgatcgggaaagaatgcggaaggagttgccaggg

SEQ ID NO: 593575 - DNA, 142 bp, Homo sapiens
cctgcagaactgttcatgtacaacaccacttgtccccatatacactattgacataatacatgtagccacattgctgcatcagtactcaaaacaaagttcttcctgattttgtcgtaatgaacacgtcgagactcatttgcta

SEQ ID NO: 593576 - DNA, 857 bp, Homo sapiens
gaatgggaccgctgggttataagcgatcatgtttctccagtattacctcaacgagtcagggagatcgagtctatacagctgaagaattttgacccgatgggacaacagatctgctcagcccatcctgctcggttctccccgagatgacgaaatactcgttcgagacgaatcaacgatcaagaaacgcgttcgaaggtgctcatgacccaggatacgcgccctgtcctctgagggtcccttaaactgatgtcttttctgccgtcgtgttatccctcgcaggactccgtagtccaaactcttcggactgtgagccctgatgcctttttgccagccatactctttggcatccagtctctcggtggcgattgagtcatgcttgtgtgaggcaatcatggggcatctagcccataaagggaacacattctgacgttttttatctcatatgttaaagttactaccaagatgattaggataaaaatgatttgtacaaaatggcccataaaaaaaaaatgtgttggcgcgccaaaggccccgaaaacttttccacacacatccgtgtggcgcacgacggcgccagggggtgaggcacacggtgcaacagcgcgttcccaaggaaaacccgcgcccggagaacaggcggcgggatcccacgcaatgaaaaacgcgccggggaacagcgccggttggaaccaccccgaggggagtcccgggggcactatgggtccacaaggaggccaggcgagcggataataccacgacgtaggaccgtgtgcgaacaacatcaccgacaccagacagcacacacacaccaccacagacgtgaacagcagacgacgcacgccacaccgatgagtaga

SEQ ID NO: 593577 - DNA, 457 bp, Homo sapiens
ttatccggggagactttgaagattagaacttcatcctaaagcatacgggtctggcattttgtccatggcatatgctggacccaacacaaatgttcccagtttttcatctgcactgccaagcactgagttggttggattggcaagcatgttgtgttgtggcaagagtgaaacgaaggcatgacatattgtgtgaggccatgtgagcgctttgaggtccaggatactggcaatgaccagcatagaagatcaccagttgctgacgtgtggacaactcgagattagtttgacttggtgttttatcttgacccaccagaatcattccttactgttgctcatggagagcacccgctccacccccatttgctcgcagtatcctagaatctttgtgctctcgctgtagttccctttgggttccatgttttccttgttccctcccatgcctccccgggatacagga

SEQ ID NO: 593578 - DNA, 161 bp, Homo sapiens
aatccgagcagtgtgcatcatctaatacaaggttcatatactcatcaaaacatgatacagccttctatccgcatattcacttgctcatagagccacacctgaatccgcgatctatttgtaagtatctgaagatgaggttgatgggctgcaccataaccttc

SEQ ID NO: 593579 - DNA, 937 bp, Homo sapiens
  misc_feature (495)..(495): n is a, c, g, or t
aagaaagtggaagacgagaagaaggagcttgcagtgcggaggtgaacgatcttccacgaaagaatgagagcagtcggcctcatgttactacagatcccatggcccaggcaattcatggggcccatgtcgagaccgaaggtaaaggatcaaggaataataaaacatctaggcatggtgtcagccgcactcgctgctattcggtggatcctcgtaacgaattctattccgtctctgcggatgtcatctcactttgtctccacattctaccacgacctgagagaacctcgcgatctctttgaccgagtacatagcattaacacatgcaagttgatatttgtcctcttactagttagtcgagggggagagtagtagataggaatgtgtatttctcaacaccttcgtctattatatagacatgggtaagcatcaaagagactttagagctctctactaatataggcggttatacaccatcgagagtttggatcacgaaancgcataggtctatcgcgctcttagagtatgcgacatcccatgtttgggtcttatcctaggataggccaactcatttcccatacaacgccatacaaggcatacgagaaggtttccgtcataacggagacgaaccatggcgcttgcagtagattctcgttaccaggcaagccccctcgttggaaagaaacaatctctcgtcgcattgagacctcattgaatatcgatgaagcagttccgtacaatgagttcacaaaaatgtgtgtttgagaccattttagctgctttttgcgcctcactttccgtgggtgggtctgggtaacagggaccgtttaccgtttataagcccactatgttacgcaacatgaacaagtctcattcgatggtgcacccaaaaaaatggaccaccccaatttgtgcgagaacgcaacgcctgtcaataggt

SEQ ID NO: 593580 - DNA, 549 bp, Homo sapiens
agaagcgcaatcttacacttaaatctggtcatacaagctttggcttggaatcctagtctgtcttatgacacagctagaaagtagtgttatccagtgtaacccagtgttacatagtctcatctttgaactttactagcgtcagccttctctctttgggaatgctgcctgtttctagtactaacttatactccctgatatagatgtggcagtgaagtctgtgctagaagcccatctgctaggtacctccaaatgcacattatgcaaatgtattaggataagacagggagatgcccggaacgtgattatcctcctccctccctattggagccatacctcctaaaatatattagactagggtacccaaattgtatgagccctactacctactgctctacataggactagctcttggaatgccctagtgctaaggaacagagacctagcaggatgacaggcctcagagacaagtaagagcaaaaaaacataaatataatcgggaaaactccccttacccctttaggaagaatattaccacctcagctaatcgta

SEQ ID NO: 593581 - DNA, 121 bp, Homo sapiens
  misc_feature (34)..(34): n is a, c, g, or t
  misc_feature (42)..(42): n is a, c, g, or t
  misc_feature (44)..(44): n is a, c, g, or t
  misc_feature (47)..(47): n is a, c, g, or t
  misc_feature (52)..(52): n is a, c, g, or t
  misc_feature (67)..(67): n is a, c, g, or t
  misc_feature (84)..(84): n is a, c, g, or t
  misc_feature (88)..(88): n is a, c, g, or t
  misc_feature (102)..(102): n is a, c, g, or t
  misc_feature (105)..(105): n is a, c, g, or t
  misc_feature (115)..(115): n is a, c, g, or t
atgtggccctgatcagacatgttcatggctaacncagaattntncangcttncaggcttaaactgancagatgttaaagacttnctgnttagaattgttttncancttggtgatncatgtc

SEQ ID NO: 593582 - DNA, 129 bp, Homo sapiens
atgttatcgcccaacactatgcagggataaataagcattgcaggaaaacgttatttgtaaactagcttcctcaccataatactttgacttgtgcaatcaatactttctactttgtgttggggataaata

SEQ ID NO: 593583 - DNA, 1100 bp, Homo sapiens
gcatcctaatgaaaatcaagttgatatgttctgtttggaaagtagcgtggaagagttgtggggggtaattcctgcagtccatagtcactggctgaagctctcgaaacaagagtaaataaaagccgtgttcatgtagttgcttcctcttactcagacagaagaacattatgataccaatggtatatcattgcctctgtcattaagagaacagcttattctaaactgtgggcgggaacatgtccatagtacatgtactcagtcaaaacttgggttctcatgagcctaaggacctattctagatttagtgtacagttagtatggagtgtgtgtgtgtgtgtgtgtgctgtgtatacataaaagtgcagtatgtagagattccgacatgggtcgtaaggcgatacacccaaaaactgaaaaaaatcacgaggttagaccccatagttcacgaggacgcgcaatagtcccaagcaaacagtgagagatactccccttcgagccacacacggaaaatgtcacccgcaaaccgatacatccaacgcgcactcaacgcgacctccagcagagggaacccaccaaccggacaacaccagaggcgacgaataccagccacgggcaccactgggccaccaccaacgagggaccagcgtaccaccacggccaacagaacgggccccccccgagtcacacagaccaccagccgccagctcccccaccacctcacaaacactagccacgaccacacaaatcccccacgagccccccaacacgcggacccgtcgaaagcacaaaaagcaaacgaaactcaatacatcaaaacataaggaacgccacacacaccgagatcgcccagaccatacaaccagagtggtaagcagaaatcagtcgataaataaaaaccccaaccaccccgaaacacacacacagcacgactaacacatccaactaacacaaccactacaagcaaccaccgacaccagaccaaccacatcaccaacacacacgcaacacacaaccaacccaccgcacacaaccaaccaatatcaaaccacacaccacgccacccccccaacacacaacaccaccacaccacccaccacacc

SEQ ID NO: 593584 - DNA, 343 bp, Homo sapiens
gacagaaggcaggatagtgcttttgaattggcctatttccattttgaaagtagatttcaggctaggtgcggtggctcacacctgtaatctcagcactttgggaggccaaggcaggcagatcacttgaggtcaggagttcgagaccagcctgaccaacatggtgagaccctgtctctactaaaaatacaaaaattagctgggtgtggtggcggcgcctgtaatcccagctacttgggaggctaaggcatgagaattgcttgaacccaggaggtggaggctgcagtgagccgagatcgcgacactgcactccagctgtgtgacagaatgagaccatctccaaaaa

SEQ ID NO: 593585 - DNA, 788 bp, Homo sapiens
gtcagaaccagtcacacctgcatctcttgctgctttacagaagtgatgtgcagccagtgggccatgattatgtggaacgaggtacgaaatgatgaaggaaaagtaattcggttccattgtaaattatgcgagtgcagctttaatgatcccaatgctaaggagatgcacttaaaagggcgaagacacagacttcaatataaacaaaaaagtaaatccagatttgcaagtagaagtaacagcctagtattcgagcaagaaagattcaacgaagagaaaatgaggaagcaaatgcagaaggaggcagtacgtggcgcaagacgagaaggcaagaggcagcgctcgcgacgaactggaccacttgcagcacgctctactgacacgaggacatgtacctggcaggacgacactggacgcgaagaacaacatcattggcgactgcatcgccgccgaatgccagatggagcgttatcctcatggtcctccaggcccattaggccttctgggagtccgaccaggcatgcctccctcagcctcaggggcctgcacccttacgtcgtcctgactcatctgatgaccgttatgtaatgacaaaaacatgccaccatttatccaaactgaagaggagttacaggcagttcagaaaatcgtgctattactgaacgtgctttacacactcgctttcaggacagttcgtctgaacatgagaagaacaagaacaaagaagggagatgatcacgaacagacgcgaggtaacgaccgaacgccttcgaaaagcgagttctgccgat

SEQ ID NO: 593586 - DNA, 109 bp, Homo sapiens
gatggctggaagtagtgggacatcttcagcacctcaaatacatcatgagcttttagcctgcttcagtcttcaaacatgcaggcaccaaaaaataaatatgagagtggat

SEQ ID NO: 593587 - DNA, 247 bp, Homo sapiens
aaggataaggatcatcagacatcactgtctccacctccacaaggatttcttcctactggaaggtctatcagggagtagtaacaggtatagagctatcatactccagtgacaacacatagccttcttctaggaatacctacccgaaggagttgcctagaggctactattacacgttaactattttaaacaaaatacaataccatactactaagcgatagactagcatacataaactacatacaaccag

SEQ ID NO: 593588 - DNA, 1502 bp, Homo sapiens
taaaaaagcatttttccaccattttacttcttgttatactcaaaaatatagtttcaacttctttctttgcaaaaacaaaaacaaaactagctacatatacgtggacacattatcatctcacattttttcttctccatagtggcttttagccccaccccgcagccccgaccgaaaaacgaagaagaagagagaagaagagaaagaagaaagaagaagagaagagagagaagaaagagaagaagagagagagagggaggggaggacggagaagaagagggcagacagagagggaagagaagagaggagaacgcagcgagcgcggcgggcggacgagaaggagacacaaacacacaaaacaacacaacccgacagcaggagcggggcgggcggcgccgccgatgccacgtcttctcgggcgcgagcgggcgacgcgccgcctcgcgccgccacgacgcggcgcacccccacatgtgcacggacgagcgtgacgaggcggccacagagcgtcagagtgctgcggaggtgagcggcctcatccccgagctaccgcaacggcgcgctagggcgaggcagcaaatcaagagagcatcacgatcgacgcgagctacgcggcgcggtggtccggggacgaccacagcccagcaggaccacgcacagggcggacacagtaacctgcaagagcagacaagcaaataaagacgaggagagacacgccgcaacgtgtaaagagaggagaggggacggaagacagcacgatcaaccggacagcagcacccacacccccagggacaccgacacacggcgccacagccaccgcgagcgtgcgacagccgaccaaccatccagcagccaccgcacgcatggcgccgcgtacctcgcagaacgaccaccccacgacccctacgcgccccagcccgcaccccgcccccccccgcgcacgcagccgccagtcccagacgtgcacacattcaatcacaggcggaacgcgcgagcagcagagatccacgacccgcacagggcaagcagggagagaaggaaacaccacgctgcggcgacatggagccgtagcaccggcaccccgccaaggagcgccccaaccaaaggacgtaccacccgtccggcgcgcccctgatcaccaacaccagctcacccaccgggcactgccgggcgactgactcgtagcggcatgcaggagtgccacaccgaccaaaagcgcgacagagcggacggaagagcgagcggggacgctcgcagtcgaacgcacagcagggcggcgatgccacgcgcgcggcccaggcgcggaacaagagaagcacgggcgtggctggacgaagaacagagcgacagacagtcgagcggcaccgcgagcaaccacagaggaccccaccaccaggacgagcaccgccggcagccacaccactcccgccaacacgcacgtgcaaacagcgctcgccaagacccgaacaccagcacggcggagcaggcacacacgcatcgggaac

SEQ ID NO: 593589 - DNA, 326 bp, Homo sapiens
aaggacaattctcttcattggtgagagcccaggccattaacacctacccagtgttattgaaagaagagaggtgggggtggaggggaatcagtctgtcccagctagagtgagataaagggggctagctagttcttggcgcagctgcttttgaggagccaataggtagctttggacacgaggccgatcgaggaaattttcactgaacatagtaatggttaggtctttggcttggatttccagaaaagcctcttaattttatgctttctcatcgatgtaatgtaccctttttttctgaaactgattaaatactcattttatctttgaaa

SEQ ID NO: 593590 - DNA, 124 bp, Homo sapiens
tgcctccagagcgtgcttgcgcaaacggcatggcaacccgtgcgccataacaacaaccaatggagccatcaatgagctgccaatacccccatgctgatcacgttctgtgatgggtacctgagct

SEQ ID NO: 593591 - DNA, 910 bp, Homo sapiens
  misc_feature (413)..(413): n is a, c, g, or t
  misc_feature (500)..(500): n is a, c, g, or t
cgcaggccgcctatcccaccttcaggcagcctatggacgcagggccccatctgtcccctcggtcgccgtgtggccagagtgggtcccgtcgtccccaacactcgtgctcgctcagacactctggcaggatgtctggggcctcacccagcaggagcgcgtgcaagccgggcaggcggtccacctagacccacacctccctcgggagcaccccacccttgtgttcgacgtagctctctctccctcaccctgcaaggttccgttctgccatccgaaaaagaccactcccacctcttcctttcctcttttgtcaatccccgaagccggagctgctaaatttatcttggggaaacctcagaactggtctatttggtgtcgtggaacctcttcactgcttccctcacccgatcagtaancaactgttttgtatacttgttttcagttttcatttcgacaaacaagcactgtaattatagctattagaataaaatctcttaactatnaaaaaaaaaaagggaaaaaaaaaaaaaaaaaaaaaaaaaaaaaaaaaaaaaaccaaaaaaaaaaaaaaaaaaaaaaaaaaaaaacaggggggccgcctgggccaaggggactttagactggggcaggctaaggcagggggccgaaattggggctaactgggccaattggcccaaaggggggcggaataacaatcaacgggccggggtttaaaaacgtcgggacgggaaaaacccgggggtacccaaactaaatggcctggaagaaaatccccttttggcaagtgggggaaaaagcaaaagggcccgaacggatggcctttccaaaaagtggcgcacccggaagggcaaagggaaatggaaggcgtaaaaattgggtaaaaatccgggtaaaattttggtaaaacaagcca

SEQ ID NO: 593592 - DNA, 342 bp, Homo sapiens
  misc_feature (1)..(1): n is a, c, g, or t
  misc_feature (110)..(110): n is a, c, g, or t
  misc_feature (330)..(330): n is a, c, g, or t
nggccgggggaggacttggggggataagaagggaaggtgaatatattaaactcaaagtcattggacaggatagcagtgagattcacttcaaagtgaaaatgacaacacantctcaagaaactcaaagaatcatactgtcaaagacagggtggtccaaaggattccactcagtttcctttttggaggtccaaagaattggtggtattattcctccaaagaacctgggaattgggggaaaaaatttttttttaattttttttaaaaaacaaggggggggtttcaaacagtaaaaattttcttttattttttttttttccccccccttttttntttaaaaaaaat

SEQ ID NO: 593593 - DNA, 347 bp, Homo sapiens
ccgagttatctagaggatccttggggctcatgcatggcttagacagcttaataattagctggggaaccagcctatcgggcgctttttcccagttgcttgcagctctccttcccaccatccacgtggggttcttttgttcggatcaaaatcagctgaccaggggcgagagtgagcggctcggggccgggggcggtgtatgaggcaatagccggggcaattgcaggtttttttcctaaactcccggttttcccagcagttccagagccctctgaatctttaagcctcacatagtgggaagggaagactccgggctggtcgcccatggttccggtccaccagtcaccatc

SEQ ID NO: 593594 - DNA, 147 bp, Homo sapiens
cacctcactgttgcaattccttcattctgttgagggcactgacagctgctggaaccactcaatctgcgtctcgtctgaaggtgtggttcaggatggatggtctcctgtggtcccaggtgggagtgcttgactgatgctacttcagtg

SEQ ID NO: 593595 - DNA, 675 bp, Homo sapiens
tgaacttatacggtaacacataatatgggcgaatctgatgaatgccaaacctgttaggtgatctttgtatcactgacagggatgcgcattgatcccgcgagggacagaaaggctatgccatcattcagggcataggcgaggcactctaactatatggagcgcccaaagtgtctgagaccatgggctagatggcgaagacagggactctttgaggagccttgtattgacaataacaaggagcagagacatgctgtaatcccttcactctgacttacactagacccaggactataatatccatggcagctatcccaagatgacaagggtgcttgaacccacaagtgcataactcacgatgtgccaaatgttgactgctatgaacctccttctcacagagatatgatctattggttggatcgagaaagataaccaacaaaagttgttggacgtgcgcatcacaggattctagaattgcacagatgcagggctggtatcattgttagtggctttattatgtcccatttgtcctttttcgccgattactgtgacggggcccacatgtcgttgtggctgcgggtagactatcttctgcaccagggtttttattggcattccatgggtatcaaaaaaggtaaccacttttgcttaaggctttttggaatggaacacgattag

SEQ ID NO: 593596 - DNA, 162 bp, Homo sapiens
ttcagtaagagcggtctgcggtctcctgttacttatagccagtcaaaacacacctcccgacagacagacagacagacacacacacacacacacacaattttaaataaacagtctgattcctgtgatcagtcatttccaaagatcacattgtacacctatggg

SEQ ID NO: 593597 - DNA, 596 bp, Homo sapiens
  misc_feature (40)..(40): n is a, c, g, or t
  misc_feature (172)..(172): n is a, c, g, or t
cttgatcgggaagcgattcatctccggagggagggtgcgntgtttttcttggtcacaatgtcattccgcccaccagtgccacaatgggtcaggtgtacagagacacccttgaagaagacttctttttttacattgcctacagtgacaaaggtgtctccggtctgtaaagctnctgcccctgggtggagggggggtttcattttacaaagagagaggtggccccccttttttgacctcctcctccttgaaggtcaaaccccacctcccttattcaggggcggccctttttaatgtttgtggctttttttccagccttttttaggaggggtaatggtggggttggcattttgtaactttcctttttccttttttcccctttttttggccgcctttcccatcctgctgtagactttttgattgtcagtttgtgtcccatccagtgattgttttggtttttgttccctttttggctgcccaaggggttcagaaccccagcattcccttcctttcactacctttttttttgggggtggttggaagggattgaaattttggggggaaggttgggggcccttcatttaaggggaaccccccca

SEQ ID NO: 593598 - DNA, 209 bp, Homo sapiens
  misc_feature (9)..(9): n is a, c, g, or t
  misc_feature (20)..(20): n is a, c, g, or t
cctacttcnaggccagtttntaaggacttactgataatgagtaatttacaactagacactatttagtggacagcagggttaagtgcttttctctttcagagaaaaggttttattatctccttttttttttttgggggggggacagggtctcactctgttacccaggctggagtgttgtggcatggtgtcggctcactgcaacctccatc

SEQ ID NO: 593599 - DNA, 758 bp, Homo sapiens
gtggtgaaaccctttctctactgaaaatacaaaaatcagcggggtgtggtggtgcacttctgtaatctcagctacttgggagtctgaggcaggagaattgcttgaacccagaatgcggaggttgcagtgagccaagatcgtgccactgcactccaggcctaggtgatagacgttagggttagggttccgggttaggcaagacattggcagattgtagacaagaataacttttgcattttaggaatttgcactgctggtaaatggtattccaagttgctatagagattccttgccttctaaaaggtattctcgtaatcacaaggccaggtatccgtaggaacgtatggagtacagccgtaaggcaacaacatacataacaataaacacatcaaaatacaaaatatagatattactggagggaaacctcgagtccactctatgagagccctgtactcaaacgccgttccgaggaggacgaccgacgtgtcccaaatgggcagttgaccggcacaacgagagtgcgcacgaaaaatgggtcgagtcaccgcagagaaggagaaagctccacgggagagcccaacaacaaacaaacggggaataagagggaatacactacagcagccacgaaatgaaacagagcggccagcaccagggggggcacacacaccgagggaacggtctggcagacacaacacacccagacacacacgccggccaagcaaggaccggataaagaacaccacgaggcgacacaagac

SEQ ID NO: 593600 - DNA, 512 bp, Homo sapiens
ggcgtcctcccggagttacggcgcttccggggccccgtgcgtccccgtgaccatggctgctctccgtggctcttctctagctctcagctgtgctgcgaatgtctgtaaacctggtggccaagtgattgtaagtcagtgagactttccttcgtgtttcttgcctttgatgtgcaatgatgggtggagatttgtggctggctgattacatgaaaacatctgggaatgacaagtttgctgttttttatggtgaatcgcaggcttggaagagacatgaagcaattccatgaaataaatttggaaattgaagatttagaacaagtgtcagtgctaaaagtatttcctaaagttcagaaagaaagtgatttgccagggagaacatttaaaaatggggggcttgcgcaagaactaggcaaagggggccactggaagggggcgcgggaacttgaaatccatgataagagactattagctgaagagagacagagtggaggtgagggatgaatatgggtaaa

SEQ ID NO: 593601 - DNA, 237 bp, Homo sapiens
gctcgaccatggtgaaagcaagaacaagagagtaagtgggaggtgccacacacttggaaacaaccaaatctcatgagaactcattcacaattacaaggatagcaccagtcaatgaggaatccacatctatgatctaatcacctttcaccaggccccacctccaacattaggaattacattttaatatgagattggggggacaaatatccaacctatatcagatggtttataatatgc

SEQ ID NO: 593602 - DNA, 339 bp, Homo sapiens
ttccccgggtttttttcaaaaaaaaaaaaaaaacccctgggtttggggccggcccccccccgaaatttaattaaaaagaaaaatttaaaccccccccccggggcccggggttttttttggaccccgttgttttttaaaatgtttacccccttggaccccctttttttttgatttgggcaggtttttatttttggaaaaaaatggggtttgggttccccccccccccccaaacccaaaaaaaaaaagttaatccccccccccccccggggccgaaaaaatttttggctttacccctttttttgccccccggcttaaaaaagggctttttttttgggtcca

SEQ ID NO: 593603 - DNA, 113 bp, Homo sapiens
gatcgggaggatacctgtggcagagcgataggaggtggagcttgtagagagccaaggatggcgcctactgcgactccaggcctgggatgacagtcgcgagactccatctcaat

SEQ ID NO: 593604 - DNA, 172 bp, Homo sapiens
tgcttatcctcctgggcgatacctcctcctcctactccttctcagttcacgcatctctcctgccagtgcatttccacgatttaatatttgttacaaactccaaatatacaacaccctgaaaacacatttctatttgtttttttttttttttttggggaaaagggagtttcgc

SEQ ID NO: 593605 - DNA, 201 bp, Homo sapiens
  misc_feature (71)..(71): n is a, c, g, or t
caatacaggtagtctctccagcagccgcgcgagctcatgcgggccagcagtgacatatattcagcctaacngcttccccgaggcgtaacatcgttcgccacccaacccgccagagtcagtccggcgtgttgtattacctgtgcagtcaacatcgcgtgattaatacagccgagtttcacaccactaccagtatcaccggca

SEQ ID NO: 593606 - DNA, 649 bp, Homo sapiens
  misc_feature (644)..(644): n is a, c, g, or t
tcggccgagcgaagggttgtttttcccttcaagctggaaacaagagcgcgagcgtatttatcaggagaattcctggtcaggcagagtgttcagagaaaaagagtcgagcacagcctgaaaatcagcaacttgcagggcttttctgatctggcggcccaagagcataggtggaagctgacaagttgctctgcagcatctggtctctgtacgtacgtggtatacatgaagtcccgtaggctatcctatccaaagctgtgtagactcgggtgcacaccaaacgcttgtctcagggcatgcagctgacaggtagtcccaaacatcctggaacccaagcatatgagagctaccctgtcgggtcgggacttacattggtgcaaatagaggttgaaaagtctcgcctttctgcttattataagccgctccactttctacacgcgggatttcattaaatcagccactatcttaagactcctgagtgtcgcatcatgcacaacaacaactgctaagccacatccatttcatttatttctgagaaggtgccttatgatcccctcccattggagcgtgacttaagctgatctttttttgaatccacgcttgggtgaaacagggcacctcttttatctgctcctttggggcctctncctcc

SEQ ID NO: 593607 - DNA, 1246 bp, Homo sapiens
  misc_feature (909)..(909): n is a, c, g, or t
  misc_feature (923)..(923): n is a, c, g, or t
  misc_feature (929)..(929): n is a, c, g, or t
  misc_feature (941)..(941): n is a, c, g, or t
  misc_feature (949)..(949): n is a, c, g, or t
  misc_feature (957)..(957): n is a, c, g, or t
  misc_feature (1030)..(1030): n is a, c, g, or t
  misc_feature (1116)..(1116): n is a, c, g, or t
  misc_feature (1126)..(1127): n is a, c, g, or t
  misc_feature (1139)..(1140): n is a, c, g, or t
  misc_feature (1174)..(1174): n is a, c, g, or t
ctgtcttctgcgcttggtagtgtgtactgttttgcttttcgtgtcttgcgtcgttatcgttctttgggtggccacttccttgttttggagcgtgacaagtgttgcgctgagtgtgctctcccatccctggcgcacacttgaccatggttttgttgccacttggccctcctttggtgctgccctttaccttgcaactggcccccggattgggcttgtcctttgagcccaagggcccctattggattccatgtcccccgctctttgggcgccatggccccacacacattttggacggaatggcccttggagcccatgggccccaacaacccttggagcgcatggcccttgagccccattgggtcccaccagcctttggcgcaatgggccccccccatgggccccggcccttggcaacatgcacatttagcggcatgggcctcggccacattgggttgcccgcttgccgggtgccccaacattttggaccggtgcccaatctgaagatgtgagacctggccaacattctggagggaacttttctcccagagattccctttggtgggagccctgggaggcccatagctccctggggggtgcgccccgagaaggccccttcccgaaaatattttgtgtgtgagaaaatttctgccccatttctggagtttccaccatgggaaagaattggcttaagagcaccacaattccacgcgagttgcgcggcccacgcgtgtcgtgttacagccggaccactcccagaatgggagacaatgtggggaagattcccagaggggtttgtgtgtgtggttaagatttcggaattcgcccagagaggtggggcctcgcagaagaagccctcgcccgcggatgtgatagtgaatggcgctctgtaagactcgtgagatggcccgngagagagagttganacgctntcgagaattgantagagaancgccttanagcccgcttgcctctttttaaaacactcgatatcgagagcctctctgaaatttgtaatttttttcttgttaanccactctttaaatttgttgggctggaatgtataaagaatgtttaaaaaaattcacgttgctttttggggtaaatttgaaatacttntttaaatganntggggttccacnnttgagctgtttgcacttgagattgccaatgtgcnccaattttttttgtagttgtggcattttgttgacatcgaatatgactttgataataaataccggttcctgta

SEQ ID NO: 593608 - DNA, 1067 bp, Homo sapiens
  misc_feature (765)..(765): n is a, c, g, or t
ccccccttgtgtgccccacaccggaggtgtgtaaaaaggtagtggtggacctttggggtttttttttcccgacatgggtctttctgtgtttaatcttataagggacccttttttggggggaggggaacacacccacggcctttaatgccccaccttgagccccccgctggatgggaggatattgccctcttcacaccggaggcccctctgtgtcgtggtggcccccccacttgagcgccgcgagagttttctgttgaccctctctgacgtgtttgtgtagcacgcacagttcacggtgtacacactgacgcctataactgcaccctcgtagaggggtcttttttataggtccacatgtcccacacagcgtgggagaagagacgcagaattggtgatacaccctcgcgcgcgtggggtgtagaaatagtgtggagaacacacaccgtgttgtgccctgcccccccgcgagacccctcaccgaggggatattctcggctttctcttaagagtttttggcgagagtactcacactactccctccgagatattgtgtcgctgttatagtgtgcggtgtgagatagtgtgagactctttgtgtagtttgtaacaacaaaagtgtagtataggtgatatagatatataaatatactccacgaacccaagtaagacccctttctggggtttttctctgttggccgcggttgaaaatatggtccccacacacatggtgggtcacatcacgagacaaatatagaccactttccntcactatcccaatatatatggagttcacggctccttgagcccttctgtaggggcacagactcgctttcctcggtgtgtggtgattagaattccctcttcctgcactcttgttttcatggcacgtggaaatagccttcttggtgcctcgtcacacacatggtgattcttttcacctgatatttctgaattcatgtttctagttggcttgaccctgccacatgggtcccgatgttcatccgagcataactgtacttaatcctttttcccaaatccagtataataaagggagtgatgtgccaatt

SEQ ID NO: 593609 - DNA, 156 bp, Homo sapiens
tcgcggccccggcctggtacactcccaggcgcttctgcaggtcatcggcatcgcggaggcaccgttacgcagttgcgcaggtgggaggcgagcgcacccgcagctcctcggtgtctgccgagcatggcctcactcgccgcggtatgcaccggggcc

SEQ ID NO: 593610 - DNA, 621 bp, Homo sapiens
  misc_feature (12)..(12): n is a, c, g, or t
tcagagaccacntggatcttgggaaggtgtcagctctacctgtggcacttggctgagtgggaaagggatggaaacatgaataaagtaagaattaggaaggaaaaggagaaatggatccagggtatgaagccaatagtttagttatctcaacaaatatgattgatttcatctttatgaatttgattatcctaatttaatacattcaatcaatgaagtaaaaaaaagtgcaaggacaatatgacatctgtcattctctgttgagatttgagaggtaataatacccaagaacgtgtggtgacctgggtcctcactgctactgtcttcctgtacctggacacttctagcaagagacttcaacttcagaacaaagaggatcccaacttgtagctgcattatacacaccccagcagcacacataagttgatttctaattattcctctttaagaaattgtttgtggaatatttatctatttataaatggaaaaatagaaaattaaaataacaaaaataagtaacaccatgtattgagtgtctactgcgtgctaggcactgtgctaagtgttctgcatatattgtcattgtgctgccaacgactgcaataaagatgttcccattcctaa

SEQ ID NO: 593611 - DNA, 182 bp, Homo sapiens
gaactagaggatccccgcgaaaaaagatgaaaacaatcacggggaagacgttttcatcccgctaatcttgggaataagaggaggaagcggtggcaactgaaggctggaacacttgctactggataatcgtagcttttaatgttgcgcctcttcagtgttcttaagcggatcagcgggtaccg

SEQ ID NO: 593612 - DNA, 797 bp, Homo sapiens
ctcccggaacaacagccacaacatcaggagcaggagcggcagcgggacggggatagaggctcccccacccgatccccacagtcatcgccccgtccctgggggcgggcggagggggcggggagcgatggagacggcggtggtggactaaactgggtcacctgcaaggtattttatgcaatggggttgtacatggaaggagacaactgtcgctactcgcatgacctctctgacagtccgtatagtgtagtgtgcaagtatttcagcgagggtactgtattatggagaccgctgcagatttgaacatagcagaccattgaaacaggaagaagcaggtgctacagagctaactacaaagtcatcccttgcgtgcttcctcaagtctctcatcgatagttggaccacttgttgaatgtgaatacagggcgaagctgagtcaagaacattcaaacttgtgcaactgtaggagcaggttcagaggactgggtgacatgctattgagttttgttcctgggcaaccctactgtgggcgtacgtgcgccttccgtgcagtgaagcaccccgtgagtgggcctcagttgaccaggggcaagagctccggaggaaggagcgaagcgccgtggagaccgaatgaagcagtgtgccctattgtgcagtgcgagagtgcgattcggggaggacctgtgtgttctccccggggattcttgtgcctgtgtgggcggcgggtcttgctcagtgtgtgtgcccgggattgggttacttgggtttggcctggaggatggctcttgcgggcccaggtt

SEQ ID NO: 593613 - DNA, 201 bp, Homo sapiens
ttgtcttgggtagatttaagcagagactcaaaagatgagcaaacttagggagaaattccaaagagaaatattacctgaagaaagaatatttctcaaaccaggaaagagctgtgtgtttgcagtaagaaccagatagagaagatttgctagaatagagagttaggaagacttatatgtaccatactaaagttaaggaagccc

SEQ ID NO: 593614 - DNA, 115 bp, Homo sapiens
gtgtgactcttagtgtcctctctgattgatcctgactaatcactagccccctgtgccccaatttcaacagtatgctggagtctaatctgaaccccaaactatgccctcttaagtg

SEQ ID NO: 593615 - DNA, 118 bp, Homo sapiens
ggatccccgaaccaacccgtcatcaaacccttcatcaaccctaaatctctcattgttttatcaaacccttcatcaaaccctgaaacccgtatacaagtagaccactacagccagggtt

SEQ ID NO: 593616 - DNA, 471 bp, Homo sapiens
ggccatgttctctactgaactcagcggttctgactcccccctcctcaggcggcacccctgacaggatggttcggtgtcgtcctgggctcccttccagtcaagaacctactcctccaacccttctgagagagcttctaagcacccagttccctagatgaaacccccaccctgcttaaaaagaccttgtttgggccaggcttggtggctggcatctgtaatcccagcactttgggaggcctaggcgggtggatcacttgatgccagatgtttgggaccagcctggccaacagggcgaaaccctgtctctactaaaaatataaaaattagctggacatggtggcacacaactgtaatcccaggtactcgggaggttgaggcaagaaaatcccttgaaccagggaggcgaggcttgcagtgaaccgagatcatgccattgcactgcagcctgggcgacagggcgagactccaact

SEQ ID NO: 593617 - DNA, 118 bp, Homo sapiens
gaaaaacatttgtgtcgttactccccacgccacatttaactcttagtccattaaatcccacctggctcatttcagcgaatatccctgaacacggggaggggggcggtttgctcagtgc

SEQ ID NO: 593618 - DNA, 2465 bp, Homo sapiens
agcggggaagtgcttgcggcctctgcccagcgagctgccccggggtctctctggtttcctaatcagggcaacgccgcgggagagaacctttaccttggctgcactaagttctcggtgccactccctggcagggcgggaccttgtttaggccctgtgatcgcgcggttcgtagtagcgcaaggcgcagagtggaccttgacccgcctagggcgggaagagtttggcccgccgggtcccaaagggcagaatggacgggctcctaaatcccagggaatcctctaaattcattgcagaaaacagtcgggatgtgtttattgacagcggaggcgtacggagggtggcagagctgctgctggccaaggcggcggggccagagctgcgcgtggaggggtggaaagcccttcatgagctgaaccccagggcggccgacgaggccgcggtcaactgggtgttcgtgacagacacgctcaacttctccttttggtcggagcaggacgagcacaagtgtgtggtgaggtacagagggaaaacatacagtgggtactggtccctgtgcgccgccgtcaacagagccctcgacgaagggataccaataactagtgcctcgtactacgcgacagtgaccctggatcaggttcggaatatacttcgttctgacacagacgtttccatgcctttagtagaagagaggcatcggattctcaatgaaaccgggaaaattctgctggagaagtttggaggctcttttctcaactgcgtccgagaaagtgagaatagtgcgcagaagttaatgcacctggtggttgaaagttttccttcttacagagatgtgactctgtttgaggggaaaagagtttctttttacaaacgagcccaaatccttgtagcagatacgtggagtgtattggaaggaaaaggagatggctgcttcaaggacatctccagtatcaccatgtttgctgattatagattacctcaggttcttgctcatcttggagccctgaaatactctgatgacctactgaagaagcttctcaaaggagaaatgctctcatatggagacaggcaagaggtggaaatcagagggtgctcgctttggtgtgttgagctgatccgggattgtcttctggagcttattgaacaaaagggtgaaaaacctaatggagagatcaattccattcttctggattattacttatgggactatgcccatgaccatagggaagatatgaaaggaattccgtttcatcgcatacgttgcatatattattgacctcaagtgtaaactgatccaaagaaaaccccctgcgttttatatcatatcatctgtacagttttgctttgatatttagagaacatgatcgaggttataggaaattgattgcccattctcacttgaaaaatacttcctaggccgggcacagtggtttatgcctgtaatcccagcactgtgggaggctgaggcgggtggatcatctgaggtcaggagtttgagaccacctggccaacatggtgaaaccccatctctactaaaaatacaaaattagctgggcgtggtggcacgtgcctgtaatcccagttacttgggaggctgaggcaagagaatcgcttgaactcagaaggtggaggttgcagtgaggcgagattaggccattgcactccagcctcagcaacaagagtgaaactttgtctcaaaaaacaacaacaacaacaacaacaacaacaaaacttcctaggccagatgtggtggctcatatgtataatcttagcactttgggaggccaaggcaggaggattgcttgaggcgaggagttcaagaccagcctaggcaacatagggagacccccatctctacaaaaatttaaaaattagcctagcatggtggcacgctctgtaatcccaaatacgcggtaggctgaggctgaggagggtggattgcttgagcccaggggtttgaggctgcagtgagccacagtcacgccactgcattctatcctgggcaacagatggagaccttgtctcacaaaaaaacaaattcctgacatcgctatgtattcccaactttatcatttggtctgcctgtatagattagacttatgtctagtttttctcccccctgtggaccattgtgttggaccggacatccgtgaagcgaccttctatcaatctatctccacactttccccaaaacatatacatgcgcctttattgtggactaatgtctctccagggacataatatcccccatccacccggcaataactccccagaaggcggggtggtcattaccgccgtaaacccctcaatcctttgggcaaatctacaacagaaacaatcgctgtgacaccactagaagtgcgtcgtcctgcatccaccacccctttggaacacatcatctccacacgctctacgggcaataaccgggagcgtagctgccatcacggtaactccacattagcacaccg

SEQ ID NO: 593619 - DNA, 2324 bp, Homo sapiens
agcgggaggacaaggagcccggatgcggggcgttgccgaaggcgtcttgctcaggctgcgggaaaggagaggggtgggagcggggtgggggcatcgcgacccagggcaaggcggcgagtcgccgtcttcgagtcccacctgtccgaagcgggaaaacagtcgggatgtgtttattgacagcggaggcgtacggagggtggcagagctgctgctggccaaggcggcggggccagagctgcgcgtggaggggtggaaagcccttcatgagctgaaccccagggcggccgacgaggccgcggtcaactgggtgttcgtgacagacacgctcaacttctccttttggtcggagcaggacgagcacaagtgtgtggtgaggtacagagggaaaacatacagtgggtactggtccctgtgcgccgccgtcaacagagccctcgacgaagggataccaataactagtgcctcgtactacgcgacagtgaccctggatcaggttcggaatatacttcgttctgacacagacgtttccatgcctttagtagaagagaggcatcggattctcaatgaaaccgggaaaattctgctggagaagtttggaggctcttttctcaactgcgtccgagaaagtgagaatagtgcgcagaagttaatgcacctggtggttgaaagttttccttcttacagagatgtgactctgtttgaggggaaaagagtttctttttacaaacgagcccaaatccttgtagcagatacgtggagtgtattggaaggaaaaggagatggctgcttcaaggacatctccagtatcaccatgtttgctgattatagattacctcaggttcttgctcatcttggagccctgaaatactctgatgacctactgaagaagcttctcaaaggagaaatgctctcatatggagacaggcaagaggtggaaatcagagggtgctcgctttggtgtgttgagctgatccgggattgtcttctggagcttattgaacaaaagggtgaaaaacctaatggagagatcaattccattcttctggattattacttatgggactatgcccatgaccatagggaagatatgaaaggaattccgtttcatcgcatacgttgcatatattattgacctcaagtgtaaactgatccaaagaaaaccccctgcgttttatatcatatcatctgtacagttttgctttgatatttagagaacatgatcgaggttataggaaattgattgcccattctcacttgaaaaatacttcctaggccgggcacagtggtttatgcctgtaatcccagcactgtgggaggctgaggcgggtggatcatctgaggtcaggagtttgagaccacctggccaacatggtgaaaccccatctctactaaaaatacaaaattagctgggcgtggtggcacgtgcctgtaatcccagttacttgggaggctgaggcaagagaatcgcttgaactcagaaggtggaggttgcagtgaggcgagattaggccattgcactccagcctcagcaacaagagtgaaactttgtctcaaaaaacaacaacaacaacaacaacaacaacaaaacttcctaggccagatgtggtggctcatatgtataatcttagcactttgggaggccaaggcaggaggattgcttgaggcgaggagttcaagaccagcctaggcaacatagggagacccccatctctacaaaaatttaaaaattagcctagcatggtggcacgctctgtaatcccaaatacgcggtaggctgaggctgaggagggtggattgcttgagcccaggggtttgaggctgcagtgagccacagtcacgccactgcattctatcctgggcaacagatggagaccttgtctcacaaaaaaacaaattcctgacatcgctatgtattcccaactttatcatttggtctgcctgtatagattagacttatgtctagtttttctcccccctgtggaccattgtgttggaccggacatccgtgaagcgaccttctatcaatctatctccacactttccccaaaacatatacatgcgcctttattgtggactaatgtctctccagggacataatatcccccatccacccggcaataactccccagaaggcggggtggtcattaccgccgtaaacccctcaatcctttgggcaaatctacaacagaaacaatcgctgtgacaccactagaagtgcgtcgtcctgcatccaccacccctttggaacacatcatctccacacgctctacgggcaataaccgggagcgtagctgccatcacggtaactccacattagcacaccg

SEQ ID NO: 593620 - DNA, 531 bp, Homo sapiens
  misc_feature (91)..(91): n is a, c, g, or t
actgcatccaacgccgctcggtgagcagggagcagcgttgatccccccgcctatcagcttcttctgtggagcctgttcctcactggaaatnggcctctgtgtgtgtgtgtgtgtgtgtgtgtgtgtgtgtgtgtatgtacatgtacacttgggtgtcaggctttgtgtgcatgtactaaaaagggagaaattataataatattagccgtcgtggggcgtgggatgcagtcgagtgtatccaacgccggtgggtgtgttctaggaagccagagagccagtgcagcgtggtcatcagggggtgtgagttgttctcagtcaagcggagcacactgtgtgtgaagtcagacgccatgatatagggcctgaaggatgctgtagacatagcatgtgtcgcccaggttgatgagaccaatcgcgcgcgtgtctgacgtggccacgagccggggatagaaacccgccagcgcgctcttgtgcgaagtccaggcatcgtgccccagcagctgctgcggcgttggatgcagacaggcggcg

SEQ ID NO: 593621 - DNA, 336 bp, Homo sapiens
aaggcctcgaagatcatgaacctcccccaattgctcctgtagataatattattattgtaaaaaccctaacatggggtgtttgagggtatttttcagaccctgccttctgatggatcagctggcacccaccccagaccagtaaactggctcatctggtcttctggcccccaccccaggaaccaactcagtgcaagaggatagcttcaactccttatgatttcatccccgacccaaccaatcagcattcccgcttcccgagccccctgcccgccaaactacctttaaaaaaccctagcctccaaattttcagggaggctgatttgagtaataataaaa

SEQ ID NO: 593622 - DNA, 102 bp, Homo sapiens
tgatgaatgacaagaccagagtgagataggcttattacccctgcagacagtagccttatcactccgtggaggcttttcatcagtgcctgctggatggacgag

SEQ ID NO: 593623 - DNA, 751 bp, Homo sapiens
  misc_feature (413)..(413): n is a, c, g, or t
  misc_feature (500)..(500): n is a, c, g, or t
tgaaggagccccgccccttataggaccagaagaggaagagagccccactccagagcccccctggattgtgcccttatagtgtttgacctctcctttaggagaagtctttcttaattgatattgagattgatctccacgtgagtgttttcgaaagattcttcatagttgaataatattttaggtggttaaaataaatttaagggtatagattaacctctacctgcaccacctgtcctaattatagttcccttctttttgggaagtgtccacccccaggttagttccatctggaattcatattttaaatttgaagggtatgaaatggttttcacaaatgttctcccggtcacattattggttaataattttctgaggagcctgccacactgccacgccacctgtgatatgaggcntggcggagtcccaagccaatgggcccactgagatcacttgtgaaggcccaggggaaatgtaatgtgcaccactctgttgttgtaacntgtttatgaatgaattgtcacgttgttaatttaattgaaaatgagtttcacacgtgtgtggtccacactttctgcatgttgaaactttatagaactataaatgttctaaatatcccctggaccttttatgtctttcttgtaaggcatactgccttgtttaatggtaattttaccatgtttctggcttagaaccaaaggggcttaattaattgatgttttcatagagaatattaaaattaagcccttataga

SEQ ID NO: 593624 - DNA, 609 bp, Homo sapiens
cccctaaaacccttgatggttattttagaaagaaaatgtggggtttcccccaagaacacccccaaaattagcggcgcggctgggtaaccgcggaataaaagtgcccacatcccatttggcggcaaaagggggccccctatgcttaaaatgaacataaaaagccgccctccctcttataaaaattatttcacaggcgggcaggaggaaaaacactttttttttcaaagaaagactgtgtttccccctcgcctcatagacattacccctcttgtgttccacccgcggaaaaatgcacccgttaaaaacttcttctctcttggtccgggtttggggtccttctggtttttggtagctccaccagtttccccaggggttgcccccaataagatatgcgcgtcccccagccaaagttgttaataatggggtgttattgttaacagtcaagtttacgttgtgagacgcaacggctgaagttggacaccaacagagccttcaaagactttggagtgcagagagtataaagacatttagaaagaccacctgccccgcactagtgagaagaagaaaaaaccaataggaacaaaataaaaaaaagaggagctataggac

SEQ ID NO: 593625 - DNA, 108 bp, Homo sapiens
caacacaaagaaacacacaggcgtactaagtgacgcgagagcgtatacccaactagggactatccgaggcaacttgaactcaaaacactaacagacggagacgccacc

SEQ ID NO: 593626 - DNA, 1402 bp, Homo sapiens
  misc_feature (127)..(127): n is a, c, g, or t
  misc_feature (188)..(188): n is a, c, g, or t
  misc_feature (242)..(242): n is a, c, g, or t
  misc_feature (245)..(246): n is a, c, g, or t
  misc_feature (265)..(265): n is a, c, g, or t
  misc_feature (268)..(268): n is a, c, g, or t
  misc_feature (305)..(305): n is a, c, g, or t
  misc_feature (320)..(320): n is a, c, g, or t
  misc_feature (624)..(624): n is a, c, g, or t
cgcgcagaagggtacatatgctgtcgaggctgttaattggccgagggcggacgcggcgctgcggggtgggccgttgctgttcggccctggatcgccgccactccgcgatcagaccgctctgtgccgngagccgcgtgagcactcggattcaagccggcgccaacgagtccgggggcatcgcccgcagnggcaagctcatggccggctgagcgggacgccgctccgcctcagcaccgcgcgcngcnnctcctcctcctcagccggnggnggcccgggcccagcaaccatggctgaagactactggnacgggcgcctgcggngaacaggaggagaaggaggtcgcgcgagctcatcccgggccgcctgcccatgcgccggcctcgccgtgccccccgggctctgaggttgctcgcgcgcccccgccgatcgccatgggatcggatgaagaagatcaaacggcagctgtcaatgacactcagctctgcaccagagattgtgcacgaggacttgaagatggggtctgatggggagagtgaccaggcttcagccacgtcctcggatgaggtgcagtctccagtgagagtcaacagcgctatactaccagtgacatcggctgcctgaggnctacctggagaagctgaccctcaatagccccatctttgacaagcccctcagccgccgcctccgtcgtgtcagcctatctgagattgggtttgggaaaccgtggaagatctattatttactgcgtgcaacatgcgggagcggatgagcctatgtatgcggtactcgctctggacaagggcaaagacgtcaacgctcacagtacaagccttgttggcgactcacggagatcagactggaacatgaagagggggcaccctgcaccgcatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaagtgaaactgttcctgttccagctgctccgtggctggctactgcaccggcagaaggtgctacaccgagacctcaagcccagaacctgctcatcaacgagaggggagagctccagctggtgactttggcctggccagagccaagtcaatcccaacgaagacatactccaatgagtgtgacctggggtaccggcccctgaaatctgcttgggtccagggattactcccttcagatgccatgtggggtttggggtgctctctatgagatgccacgcgcctcttcggccacgaggggcaaggaactcctcgtttagaccccgggatgcgcgtcgcccggcacatacaccgcgacgctg

SEQ ID NO: 593627 - DNA, 173 bp, Homo sapiens
tccccgattgagcctctacagcaccagacagatgggaacgtggtcatcgcctgccttggtacagggcttcttcccccaggagccattcagtgtgacctggagcgaatgcggacgagggtgtggaccgccagaaacttcccaaccagccatggatgcctccgggtacctgtacg

SEQ ID NO: 593628 - DNA, 1449 bp, Homo sapiens
  misc_feature (127)..(127): n is a, c, g, or t
  misc_feature (188)..(188): n is a, c, g, or t
  misc_feature (242)..(242): n is a, c, g, or t
  misc_feature (245)..(246): n is a, c, g, or t
  misc_feature (265)..(265): n is a, c, g, or t
  misc_feature (268)..(268): n is a, c, g, or t
  misc_feature (305)..(305): n is a, c, g, or t
  misc_feature (320)..(320): n is a, c, g, or t
  misc_feature (671)..(671): n is a, c, g, or t
cgcgcagaagggtacatatgctgtcgaggctgttaattggccgagggcggacgcggcgctgcggggtgggccgttgctgttcggccctggatcgccgccactccgcgatcagaccgctctgtgccgngagccgcgtgagcactcggattcaagccggcgccaacgagtccgggggcatcgcccgcagnggcaagctcatggccggctgagcgggacgccgctccgcctcagcaccgcgcgcngcnnctcctcctcctcagccggnggnggcccgggcccagcaaccatggctgaagactactggnacgggcgcctgcggngaacaggaggagaaggaggtcgcgcgagctcatcccgggccgcctgcccatgcgccggcctcgccgtgccccccgggctctgaggttgctcgcgcgcccccgccgatcgccatgggatcggatgaagaagatcaaacggcagctgtcaatgacactcagctctgcaccagagattgtgcacgaggacttgaagatggggtctgatggggagagtgaccaggcttcagccacgtcctcggatgaggtgcagtctccagtgagagtgcgtatgcgcaacatcccccacgcaaagattctccactgaggacattcaacagcgctatactaccagtgacatcggctgcctgaggnctacctggagaagctgaccctcaatagccccatctttgacaagcccctcagccgccgcctccgtcgtgtcagcctatctgagattgggtttgggaaaccgtggaagatctattatttactgcgtgcaacatgcgggagcggatgagcctatgtatgcggtactcgctctggacaagggcaaagacgtcaacgctcacagtacaagccttgttggcgactcacggagatcagactggaacatgaagagggggcaccctgcaccgcatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaagtgaaactgttcctgttccagctgctccgtggctggctactgcaccggcagaaggtgctacaccgagacctcaagcccagaacctgctcatcaacgagaggggagagctccagctggtgactttggcctggccagagccaagtcaatcccaacgaagacatactccaatgagtgtgacctggggtaccggcccctgaaatctgcttgggtccagggattactcccttcagatgccatgtggggtttggggtgctctctatgagatgccacgcgcctcttcggccacgaggggcaaggaactcctcgtttagaccccgggatgcgcgtcgcccggcacatacaccgcgacgctg

SEQ ID NO: 593629 - DNA, 258 bp, Homo sapiens
  misc_feature (65)..(65): n is a, c, g, or t
ccaaaaatatgtagcagcaaaaatttgacaatggacatgattaacagaattaccatttgactcangcaatcccattattggttatatacccaaaggaatctaaatcattctgtcataaagacatatatacacaaatgttcacggcagcgctatacacaatcgcaaagtcagggaatcaaactaaatgtccatcagtggtagaaaggataaagaaaatgtggtggcagggagtggtggctcatgtctgtaatcccagca

SEQ ID NO: 593630 - DNA, 158 bp, Homo sapiens
cggttgcagatatggtgcatttgccgcacgttgtagtgccggaatgggcgtattataaccgactatagaagtcaactattgagctaatgctatgatccgtataacagatactgcacaggaacactttgccaaactgctggcaaatcaagaagaaggca

SEQ ID NO: 593631 - DNA, 329 bp, Homo sapiens
ggggtggtttttgcccccgtcccaacaacttgtttccttaccccctcagggatggccccaaactgtccctgcctttggcaccccctttttttggttccatccatccccccaacagcctgccaattgaagcccgtccctgcatccaggatggtaccagttcccgcccctcgccccccccctccccaggtgccttaaagggccctcgtccccccaaggtggggggcaggggccccccctctccggccctggtgtgggggaaaaaattaggggttgggggatcgccagttgggaggggcgcttttaaattaaaaagttttcccttttaaata

SEQ ID NO: 593632 - DNA, 228 bp, Homo sapiens
  misc_feature (82)..(82): n is a, c, g, or t
tagaggatcccccctcccccacagtgagcattattattaaattgacaagttgtcgattcgataattacaatgacttgtacanaaaattcacatgcgcctgtagagggagccttatggttaggaactaggtgacacatgtgcctctccggacagaggaaggaagtcccaccccgccttccagcagcagcaagccctatatctggcattccctgttccgctgctcccacc

SEQ ID NO: 593633 - DNA, 835 bp, Homo sapiens
tgttaggtaagaaaagagaggatccaaggaggcagagaaaagatggtgaagccacagacggagccaggccccaggcccatcccggagcccatgcaggagtccaaggctgaggggaacaatcaggcccctggggaggaagaggaggaggaggaggaggccaccaacacacaccctcacagaccagacctccccagccagaaaatacccaggcccacagagccgagggggacagtgatggtgtgcctctctcagggtctggtggacagagagaagggcctgagatgccgagccagaggtggcagtgcaaagagagaagaggagagaggaggaggaggaggaggctgaagactgcagaggaagctgtcacccgcaggaaagaaggacccacatgtagatgctgaaccaaccacccgagaccttgagcatacaaggaagatccaggcaaaggcgagagatcggtcggaggctcatggctgttgggatggagctgggaagcactggaggactgaggaggctcagagacccccgacagggaagggagaacaaaggagcactcccagcagaaagaggaggaggcaggagatggcagatggtccccagaaaggacccttcttaccaggggctgggaacgaagcgccagaacctggcacgctcggagagcaggaagcagactctacccaaggcaatgggcggaccgacccaaacagctggatcacagaatggaccatgatgggcccacaggaagctgcatgtgctgaaaagcgctgcaagggcagaagagacggaggcacaacggacgaacataaagcttacatcggccagagcaaggcatagg

SEQ ID NO: 593634 - DNA, 377 bp, Homo sapiens
aagtagtccacatagtgaaactcatctctactacaaatcatacaaaaaaaaaaattagccagatgtagtggcacacgcctgaagtcccagctagaacctgggaggtggaggttgcattgagccaagatcgtgccactgcactccagcctaggcgacagagcaagactccatctcaaaaaaaaatgttatgtttacactatactgtagtctattaagtgtgtaataacattatgtctagtaaacaatgtacataccttaatcaaaaatactttatggctaaaacatgctaacaaccatcagacacttcagtgagttgtcatcttttcccaagacccaccagcagggtctggccttgatgtcgatggctgctaactgac

SEQ ID NO: 593635 - DNA, 602 bp, Homo sapiens
cgtctccactgatgggatcacgcggctctccacgagagggatcacctgagcaccacgagctacgtccatccgagctgcgactgttcgagcaatctgccacgaggaaaaccagctctgatggtacctggctcacccacgcccgcgagttactatactttttgccgttttaaaaggccctgggcaccctgttgatcacgagcctcccgtcatagctcagggaggcaaacagccacgggtcagccgaggaccagtccacggcatagacgctgtcctcgtgctcctcgtaggtggcgatcacgttgtcctgcaggggctccttgctcttctcttcagaacggtggtcctcctggtcactgatgtcatcgtcgtctaccaagtggccgaagggctccgacgagatggacaccatgttggaaaggatgactctgctgtcactgctgcccgtgaggaccagctggtcatgagagtggttgtagcggacgttccacacccagtgggagtgctcctccagggtcttcacgggttcggtgacatttcgggtgtcccagaacttcaccttacagtcgtctccgcagctggccaagtagtactgcttattggga

SEQ ID NO: 593636 - DNA, 124 bp, Homo sapiens
tggcagcagagctccctgtggggcagctagtgctgtgtgtgcatgtatgccctccagactggtcccagtgggagtatgcggggacagtgtgacagtccagtgcagccagtgttgacgtgaattg

SEQ ID NO: 593637 - DNA, 913 bp, Homo sapiens
atacagaggaacaaagaaagtagatagtcgctttgacatcacctgcacatagctcacaccgattgggtatctcctacgtcagccctaactatactgggattccgcttttcccgttatctcgccctcacccgtttacttcctttatattcggacacacccgcgaccttactctatattgtgcggccctacctcccattgtccggggaactaaaacatgggtttgtcgaccacgtgaacttctctttggttcctaaccctgtgtccgcctgtgacgaacgtctaatgacgaccccctctttcatattgggaatgagcccaacctcttgttgccactaaacacggagacaccattcttttataatactcacgcgccacttctggtttaaactacccatccatcaagaactccccgtgcatactagattctcgccccatcaagtagtgaaaattgtatttcgttgggtctaaatcccgtccctgctgaatgaatgtgaaatagttatccccccgggcactatatcaagatagtttctgcatgttatattcatgtcttgatatctacaaccaccaccgtttcccgagtttcactagttcacatctgatgaaaaagcacttctatgattaaattcagccacccaatatggcatttttaacaggataccacccgattgattcatcttatccactcgacctttttctccggtctattagttctaccgcaaatagtccttgtgaagttccctctgaacattaatagttaattacttttttatcgagtaggcgtgtttttttagaaatgatttgatagctaccaccgggaggttcacaccatttcttccacgcccaaactatcctctcacagataatctgcccttccttccagcccacatttacccagccccccaacatatac

SEQ ID NO: 593638 - DNA, 285 bp, Homo sapiens
tagcatcagtccttctctgtctccctttttcccctttcctaccccaatggattttagcctaacgaagaagagtcctgaatgactttgaccaggaaggtctaggagaagaggaaaacatgccagaggaagacagcgaagaggatgaagagaaagaggagggctcagaagcagaacaagcccaaggtggctctgtcctttcagctcagaacgctgggcaaagcctgcatcaggaaggtgaggactcagggtgggagagacatctcaagtggcatgccgaaccgcgca

SEQ ID NO: 593639 - DNA, 187 bp, Homo sapiens
ccttaaactttagtagacttttgcttatcatatccctcatttcttgcccgtgaaataaagatacacacaagcaaaaaaaaatgatagtgtcacatctcgttagttccctgtgccagaacaggaatattcttagttccactggccaggattttcctacatagtcagaacttaccttactcggtacaca

SEQ ID NO: 593640 - DNA, 395 bp, Homo sapiens
  misc_feature (395)..(395): n is a, c, g, or t
agtggacttcagctacatccactttggccaccatgttttcgttgtgtgtaagcagggaagggaactcacctgccttattaaacctacgccgagactcgtggaacctgctgtatcagagactctgaggccaaaaacgcatcatacttcttggccagcttcttgaccagttttatattcttgtggagtattattcagcgcctcgatatccatatgaggaatatccacggccttagcactcgtcacagtgctgctggtcccccaggacacacacagagacacttagggcgggaagtggacctaagcctaacggtgcccaagaagcgcttgtccttctggggatcatagttctacacgctgatctgcaactccaccgtctccaggaacttgcggcgttn

SEQ ID NO: 593641 - DNA, 218 bp, Homo sapiens
  misc_feature (9)..(9): n is a, c, g, or t
  misc_feature (19)..(19): n is a, c, g, or t
  misc_feature (45)..(45): n is a, c, g, or t
  misc_feature (49)..(49): n is a, c, g, or t
  misc_feature (54)..(54): n is a, c, g, or t
  misc_feature (162)..(162): n is a, c, g, or t
tcattcttngcaggttggnttctcatcgtctgctcctcctctgcnttgntggantggtatttttttctgaggcttgccctacggactcggtgaatccaagtttcctctgatggtcaaagttctagatgctgtccgaggcagtcctgccatcaatgtggccgngcaatgtgttcagaaaggctgctgatgacacctggggagccaatttgcctctggga

SEQ ID NO: 593642 - DNA, 413 bp, Homo sapiens
  misc_feature (401)..(401): n is a, c, g, or t
tgggcataaagttttatagttttgtattgagaaaaataatttaattaattagatgtatgccaccctataaggctattttccaaaatgactgactccaggttcatctgaagagctcagagtccttccactcaatgctgccaaagactgggacttcctgtctaagactttgctgttttagcctcactaaagtttcctcaagatgaaaagtccagtagactgctgcataaaaatttatttttctacgtgtgaagacactgaggatgctctactggttgtttccacttttatttcactgtgtgagttattgttgtagcagtagactccaacccctcaggcttctggaaccctgtttggtttgatatgttttctatggctaaaaatattggtgactattaaaaccngaaatgaaaaaa

SEQ ID NO: 593643 - DNA, 307 bp, Homo sapiens
ggtttggtttcttttgagaccgggtctggagtacaatggcacagtgccggaatcacgactcactgcagccttcaactccctggcccaagtgatcctcccacctcagcctccaagtagctgggactacaggtgtggaccaccatgcctggcttttttttttttagagagagacagggtcttgccatgttgcccaggctggtctcaaactcaggagtttgagaccagcctgggcaacatggggaaaccctatctttactaaaaatacgaaaaactagctgggcatagccccagctactcaggaggctga

SEQ ID NO: 593644 - DNA, 142 bp, Homo sapiens
cccataggccggaccggatagcgcccaagtactaggcgctgtggttaagggctgtactcgcattatgatgctgttgtgaactctgcttcctccggagtactttcagctggcttaaattcaggggtacttgtgggcgctcgtg

SEQ ID NO: 593645 - DNA, 449 bp, Homo sapiens
  misc_feature (353)..(353): n is a, c, g, or t
acatgcatccctttcttggttactctgcacagacgtcaggctctcatctctgcacttgatgtcaaatactagcctgcctcctacccaggatcacaaatccactagtgctcccctctctctagaatcctctatttgtccatcttaattggattttattttattttgttttgttttgatttgagacagggtcttgctctgtcacccaggctgaagagcagtggcatgatcatggctcactgcagcctcagcttcctggactcaagtgattttcccacctcagcctcccaaagtgctgggattacaagcataagccactgtacccccaagcctcttttaaaatataccatattatntatctcatttgagagaaacctgaaagtcagttaaaaaaaactgtatgattccacttatatgatgtacccagaggtagtcaaattatagagacagat

SEQ ID NO: 593646 - DNA, 329 bp, Homo sapiens
  misc_feature (163)..(163): n is a, c, g, or t
  misc_feature (205)..(205): n is a, c, g, or t
  misc_feature (258)..(262): n is a, c, g, or t
  misc_feature (266)..(266): n is a, c, g, or t
aggatcattagcacgaatgtatcgcgaaggccgatgaacctggcgcctacagcttcttcaatgcgttcaactacattccaccgatcattgggttttccagtgtcgggcgtaaagacagcctgaacaatatcgaacagactggagaattcgtctggaacctggncacccgcccgctggccgagcagatgaaccagagctgcgcggncgtatcgcccgaggtgaatgaattcgaactctccgggctgacgccggtggctnnnnnaatngttggcgtaccacgggtgggcgagagcccggatgaagacgagatgcaggagacgcagatcatc

SEQ ID NO: 593647 - DNA, 100 bp, Homo sapiens
gatgaatgacatagtctggcttacaaagtagtctcgctctttaattgtactctacagtgtttcgctcacgcgccgaaacttcaagttccctttttgccag

SEQ ID NO: 593648 - DNA, 199 bp, Homo sapiens
  misc_feature (36)..(37): n is a, c, g, or t
ccctgttatcgaggaccctgcttacctgtgatgtanngtagtccagcagaagccatcacctcagatggcagcttttaacaagattttatttttttctctcgatgacgcatgattccttttaacaacatgtttccagcaatactgcccagtgtcacgccagggtcaccgagtctctgaattacgtaaatctatggctcat

SEQ ID NO: 593649 - DNA, 117 bp, Homo sapiens
ctgattccgcgtagaaaaaaaagaaaaacctatctagtagctgatatgatggacaacggagagagctttccctgtgattataaaaaaggaagctagcatgctctacaggtcatctta

SEQ ID NO: 593650 - DNA, 926 bp, Homo sapiens
agcggggtgacggccggcaggccggtgcggtcggatgcgccgggcagccccgggccccggctcggaggctcccggcggagaggaggcggcgcgccgggcccgggacccgcgcgagtcggcgcccggccgaggggctgcgtaggccccgactcggccaggcccagtcgggcccttggacagagacagggcagggcattgttcagtgcacttgaccgacctcagcaagccccggcaatgacctcagggcaactggaaactctgccttccgagcagtcgccggcagtgcccacgcacaagaaactggtggcaacggcctcgtgccctgactggatgggggaaactctcacagacaacgaaagatactgcaccccaggggcgttcccttggccctgacgaacactttcccacagccataggattcactaaccagccaccaccttgacctccgggaccgcaatgggccgggaatgcccctaagtgtggccaccagaaaattcgcacacatgagcgcacgcggtgcatccccggtacactactcacacgtgctagagcactcctgtggccccagagccatgggaacttttgcccctagttaaggtttcacacggcggatacacgaagcgccgctttcattgatacaccaaaggcgcacttgcgaccgccagcggccagcaaacgggcacaacaacacaccgcaagcgcagactaggaaaaaccacacaacccggcgcgctggagcgcacaactaacaacccacacccaccaacgaaagcccggcaacgcacacaacgacctgcccaccacacccccccaacagacgacccaggccccaaccacccgaaccaacgcgcccggcacaggcaccgaccgccaccaggccaaacaagacacacatcgtacgtggcacaacccacccgataagacag

SEQ ID NO: 593651 - DNA, 408 bp, Homo sapiens
gctcgacaacaaaaaattatcggttgcctctacctgcatcgctgcaatttttgtattatccagcaatgttgtattgcaggctacaacaatggttgagtttccagcaccaatatccttgtgtgcaataacatccttgatcggtgtgactataactgcagctatccaattaattcaagatcacaaaattgaaaccggttggccacttgtgagcgttggaaacttggttggctattctctactggcaggtgctgtaagtggatcatgtctaagcttcaacaattgggccatgaaaaaaagagggccggtcttggtgtccacatttagccccgtcagtacagtctgcacaatcattttctctgtggtcaccttaggagaaaccgttaatattggaagcattgctggtatgtt

SEQ ID NO: 593652 - DNA, 222 bp, Homo sapiens
accccccatttttggggcctcatccctgtggaaaacggggataattaaaaaataattgggtgggaggcccgggaaagtttttgagtaaaaccaggggtgtgtataaaaggggggtacaaggtcccccctgggaaggggaccaaccttgtttggtggatgagaaggcgtatttatttttccctgtccagtatttaaaaagagaataaaaaaatccaaatggca

SEQ ID NO: 593653 - DNA, 472 bp, Homo sapiens
  misc_feature (311)..(311): n is a, c, g, or t
ctcagtagtcagaagtcgcacagcccggcagtcttcgtcgcgggaggtgcgggtctagctcaccaactcccagttcggtgtcttgagctgccagaagcttgggcagccctggaggatgctgagactccgcatgcttgttccttcagccacttacatcttcttgttgtgatgtgtgttccgtattttaagcaatctcaccaggattattattttatggccactttctctgccctccactctcttgtgtccgatcttctgtctgggattatgttgcaaacatatcctcgttcatttcctgcagtaaaggtctnctggtgaccacttcttcacttctggcgtgtctgaaaatacctttatttcatcctcattcttgaaggctcttttccacaggcgcatggcttcaggctgttgtttgttttctttatcccggtagatacgctgacccgctgtcctcagcctcttctatgtaagg

SEQ ID NO: 593654 - DNA, 247 bp, Homo sapiens
  misc_feature (10)..(10): n is a, c, g, or t
ctctagaggnccccttacaaccccacgatcacggggttggtgtacaataggttacaaccccacgatcactgggggttggtgtaaaataggcaggcaagagtccgaggaggttagattgtggctataaaaatcattaaggatactaatatgacagatcaggttcgtccttaattgttgtgtatggttttcatttgtttcgaggttagtttgattagtcattgttgggtggtgatcgtggggttcgtaa

SEQ ID NO: 593655 - DNA, 492 bp, Homo sapiens
ggacgcgtgggtcgacccacgcgtcgatattatactagcattgaccatctcacttctaggaatactagtatagtcgctcacacctcatatcctcgcctactatgcctagaaggaagtaatactatcgcgtgttcattatagctagtctacataagccgcgtcaacagccactcgcctcttaggccaatattgtgcctatgtccatatcgtagtcttacgccgtactgcggaaggcagccggtgggccgtagcgcctactagtctcgaaatctaccaacaacatatggcctgagatctaccggtatcaataaaccataagatgcttatctccatggtgccttaaaataccttacattcgtcgcactaacacaattcatatttaagctagccaactggatcactgaccttttccagatgaagcgaccataactttcggagatcagacagcaaatcacccatgaggctaattattagcatcatgcccctactatg

SEQ ID NO: 593656 - DNA, 1330 bp, Homo sapiens
gtgaactccaggtccatgttcatcgggcgccgtggaggagctgtgagtacgaactttggctgggccatagtcacaggcttgtcccatgaagagcaacgaggcatgatgactgtcaggctcactcaactcctaagacacagagacacctgtatgatctgagctccgttacgtggcagggcgggattcacagcttgcttatcgagcgagtaaggggttggtttacatgagcactctgctggaggagaatgaaaagctgtcctccgtgagcgtgggggcctgctttcggacgagaccaggacttatacgtgggcatagggccagacatagaggctgactatacttggaccagggtcctgtcgatgttaggtgtacaagggatgggtccccttgtcccatcgcaagatccggcccgtgagctagtaagagctgtgatcaggtatcgggtgcgaaggccttgatgcccgggcgcgaatgcacataggcgccatgctcagtctccctgtgacagagggagaacatgcacgtcgtcattgcgttctcgctgggcacagcgccgagtggttctgagaacaaggcgtagcgaagtgttccgtgaggagtggaagctctataggatgactaggtagttccccgttagttcatcgccacttggcgctggttatagcaggctctatgcatcgagacgtgaggatgatcgcgtccggttaccaactcctggatgactgagatcagaatctgcgccagcccctaaagtcccagtgggccaggactgaccctgttctggcaagctaaccccatggatgctggccaaaagttccgttagtgggataggggcaccccccccacaggcagatacccgaggcggcgcgaaaagaccagcatcccaccaacgagccccaacatccccagcaaagccgccatggagggaaactgagtgcaaccacatgcgcagaacccgcgagtcaccataggagtgtaacggacaacagcgccatcaccacaccacagcgccataaagcggcactcacacgaaaccacacaaggagcacacagcaacacaacaccgcacgagagtctgacaagagcaaagacgaataacgatacaacgggagaaaaccgaagacaaccaacacaaccacaccacgtagtgccagccgcggcagccccgccacgcatacaacagttcgacgcaccactacacaccagagtagagccccaccaaccgaagggtccctcgcacacaaccacacacgacgagaagcaacagatagacgacactacaagtgaaacagcacctagtgtacacaggcgtacagcagtaacctaccaa

SEQ ID NO: 593657 - DNA, 133 bp, Homo sapiens
taccccaagggtccttaagccacttaacaatttttttttttagacacagtcttgctctgtgctcaaactggagtgcagtggcgtgatcgtggctcactgcaacctccacctcacaggcttaagggacccttgg

SEQ ID NO: 593658 - DNA, 316 bp, Homo sapiens
  misc_feature (167)..(167): n is a, c, g, or t
  misc_feature (193)..(193): n is a, c, g, or t
  misc_feature (222)..(222): n is a, c, g, or t
  misc_feature (262)..(262): n is a, c, g, or t
cggttcacggtatttaataacgctcatgcgttcggcggcggcaaaggagcgttccaaatcgtcggcgaaatcttctgtaccgcgggccggggtgaaaactcccaatgccactgttgcgcagatagccaggtggggaatgctgaggtcgccgcggcgaacagcgtcanaccaacaagtacagtggtcacaactncgaaaaggcggaggccctcacagagactncgacggataccggagtgaggcggttcgcgaaagagcattnccaacctcttcggaaatacggtcagtttcggcgaggcgacgatccccatagccg

SEQ ID NO: 593659 - DNA, 824 bp, Homo sapiens
  misc_feature (546)..(546): n is a, c, g, or t
  misc_feature (592)..(592): n is a, c, g, or t
gagaagcttactagatcgattcgtttggcgctgcggagacccagtaggtgaagtgaacaatgtgtcatcagctgttatccgtaagagtagtatccatggctcatgacattatagtgctctgagaattcctcgatgctaatcaaataaacgctcctggtggagcgaacaggatacgcgggtcatcgaaacaaatatcattacggatggaagcttcatcggagagggttcactcctatcgtcggtaatctcagttcagagcaagtgaagctgcgcatatgtcggagacgtcagattagttcagcaatttatcggcctccgttcctcatgagctggaacgacgcacgggggaaacatatctaaaaagtgttccaatttcgactcgtgatcacacattgccgtgttgggcaagccccaaggggcttttgcttggtagagagtcaactgaacatgattgcgtcatgcggcctacttcacatagtattcgagagacatttctggggacacataaccgtagacgacctttagcacagcacagcagcactggcntgttacttgggctcctatgattcgggcagcgcacgactttggcctntatcagatttcaccgcatcgctctttcaatctcactttcacgatcgcttcacgcgtagtctcactctcgtctcgcgaccacacctcacacagcgtacactctctctgaccactcggcgacgttcacaacgcattgcgctatcaccatcgcgcactttctttcgacatactcgcgtcgccttcacgttctcctttgtcacgcgcctctgaatctctcgcttctgggtcgaacc

SEQ ID NO: 593660 - DNA, 474 bp, Homo sapiens
aaacacattgcgcggggatatcagcaaagctcaatggtagaagtggatttgagttgggcttgctggtggggagggcataggcgggggacttgttaacaaaagaatttcagatcatttaatggggcacagagtgagggagaggggcactactttaatatcatcagggaggcaactaggaggaggtaacatttaagctgaaacaaattatgagaagaaccaagaaattcaaagataaaaatatcacaagacctgtcttatcccagcaatgatcagaaaggtcagatcactcatggggtttggggcaaggaggtcccaagggcctcctacttattctgaagagagatgagggatcgaaatgttatccagtaggtaatggagaattatgaaagactcttcaacagaatagtgatctgactgggaagactactctggcattactggacaggatgggttagagaggaaaagagggtgaag

SEQ ID NO: 593661 - DNA, 114 bp, Homo sapiens
  misc_feature (83)..(83): n is a, c, g, or t
ggtcctcgcagccatggcggccgccgcgctcccagcatggctgtctctgcagtcgagggcaaggactctgagagcattcgtcnctgccgggtagtcggccactccggtcccgac

SEQ ID NO: 593662 - DNA, 746 bp, Homo sapiens
gtgtcctgacaatgtggagaaactctttccaggtttgagatagaaactgtgaaaggaacaacctcgaggatcctttttaataatgctgtaagagaaacgttgatgacagacagatagtgtaatgggctgcctttatcagggggctttggtactccagcgttggtttgtgccactctgttgaagcaggtgaagagaagccgaagtaacagtatcctctccagacatttgcaatgggttggaagaagcccgatttactggctgcctagaaaggtggcagatcatattggaggtgaacattatgaagtcctttttaactctgaggaaggcattcaggctctggatgacgtcatattttccttggaaacttatgacgattacgaacagttcgtgcttcagtaggtatgtatttaatttccaagtatattcggaagaacaagataggtggtgatcttctctggagaaggatccagatgaacttacgcagggttacatatattttcacaagggtcttctcctgaaaaagcgagggaggagagtgagaggttctgagggaaactctatcgtagatgttctccggcagatcgactatgctgccatggtcttgaactgagagtccatttctagatcatcgatttcttcctattacttgttctgccacagaaatgaggattccagaatgggttaaaaactttctgtaaaaaagttgaggtccattggtcccaaaggatctctggggcaaaaatcaa

SEQ ID NO: 593663 - DNA, 358 bp, Homo sapiens
  misc_feature (129)..(129): n is a, c, g, or t
  misc_feature (155)..(155): n is a, c, g, or t
  misc_feature (164)..(164): n is a, c, g, or t
ctctacaggatccatgctaagaaaaaggggacgaggtgttatatgaatactgatataaaggtataattacaggccaggtgtggtggtcatgctgtaatcccagcatttgggaggccgaggtgggcaganatcacctgaggtcaggagtttgagancagcctggncaacatggtgaaaacccaatctgtactaaaacatacagaaaatttgggcaggcatgtttggcaggttgcctgtaatccccagctactcagacaggctgaggccaggagaatctggcttgaaccctggtaggtaagagactgtagctgagccaaggatttgagccatttgcactccgggccggggtaccgaagct

SEQ ID NO: 593664 - DNA, 828 bp, Homo sapiens
gcctcttccggcctctttgggacttggaggtgggatctagccccttatccggctcaagtttctgggacgttggccgcccctgtttgcctgcaccctcgctcgtgcgcgctccctctcttctggggagccacttggtacacgaagatgggattctcccgacagcgctcttccacttgatgggactcgatcttgcacccctggtctgtccagataccctgtttctggagtccaccctccattggaggagggatttgggtaagaggacagaggcaagggtgcctgtggaccattggggtggagaagggaggtgccccagccactagtaaaggaggaatattgcttgctgtcccaccaggaaaaggaggaggtttctggggtgagggattagggagagagaatccaggccagataagttggaggccggggttggtccaggcccacctctgcctcttagtcccccaggcctctctctgcctgaaatgttacaccttaaccggattttccgtcaatgaagaggtggcttgtgtgtttgtcacagttctgttctcctgcgacctctgacctccccccggatgagctgggccttggttttttactgattaagaaaggaccgggccaaagaagtagttacttgagtagctgaagctgccaatgaggaaatccctgtacttttgggcccagagccagccccggagccattcctccctgttgcttttgttgttgtggttcttgtctttttcattgtctaataacagctttattgggatttagtttacatacctccttcctctgattttgaaaagattataaaatgaccactccctctga

SEQ ID NO: 593665 - DNA, 214 bp, Homo sapiens
acaaactgcaccactggatgggcttcctccccaggttagatgtcaggaagtgatctgagctcgttgcctctgacctgataccacatagctcgccgctatgcagggtctgtctcatcctatgcatcagccctggaggaaagccaggatcctgctctctggatcagagaactctcagtaggcagatcaggccctctgactgaagactagtgtatta

SEQ ID NO: 593666 - DNA, 1841 bp, Homo sapiens
  misc_feature (834)..(834): n is a, c, g, or t
  misc_feature (1090)..(1090): n is a, c, g, or t
  misc_feature (1092)..(1092): n is a, c, g, or t
  misc_feature (1518)..(1518): n is a, c, g, or t
tggttttttcgtgtgtgctctgtttggacgatgcgctcaggctgtctcgcgttgcgtgacatgatcgtctcggtagtgtgctcattactcctcctagtttgtctgtgttgtctctcctccctccatgtgggctgtcttgttgtgtctcctccagcgtcgtggtgtgtttcttcttctcccctcccccttccccttgttgtggtgggtggtagcgactcactcactgtgggtcttctccatacatacggggggtgctcgcccccaccaccgctcgtgttgtggttgggtagctgtccctccccctttcttggacgtggtgtgtttttgcagtagtgcagtcctgagtctggtgccagccagagttatggtgtgtgaccgcccgcggcggtgacacgccccactgtggttggcacccagcgacgtttgtctcacaaacgcttttgatggcctcttttgttgtctgctcccgcccttgttttcccgccgtgtgagatctattaagacgtgggttggttgtttgcaaccccgggcgcagagaagacaatggacccctttttgccacattgctcctggggggaaacactggtttgtttggttcccccacaaggctaccgcgtgatgcctgctgttgccccccgcgagagtggtgccccccacactatgcctgctggtgtgttgtaccccagcaggggttgggtgcctcttggggggatgcccgtcccccttttttgacctgttgtgtcccccctgcctgtggggttattcacagggccccctcttgtctcttgcgcccttttcccccccgccttggggggcgcaccacgggtgttcttngcgccccctaggctgtcctgtctactcggcgccaccaggggggcgcccccccacaagccgcccccctcgttttgtgagccccacacctcgtctggtgcgacgagcgtgtcagcacccacctcagccacacgctgtgaatgtgccccccacagagttgtgtttgtgggtgggtgccccccctggtgtggtgcacccactagccccccctctggggagagccccccttctgccgcacccactctctcaacagagaggngngtgtctcctcctgtgggctgtgaggaagagacgcccccctcgtggcgtgtgtcacacctcggggcgccccacaccactactggctttggcgtttgtgccctctggggcccaccaccctcatagcgcgctcttctcgttggccacactcgcgctatagagagcctctgagagccctcgtttggctctctcttctctcccgcgggagaggagaaatatagcggtgcgagagagagccgcgcgagaagaggtgtctctgtgctcccctctaagttggtgtgtcgtcgcgctcgttgggcctcttttttgtgccctcttctccccacacaagagacccacctcgccccagcgtgtcccccacaggttttcacgccgctcgtctctgtggctctttgtgtaagccacacagtgtgagagagaaccctctgngggtgttgtggaggcccacacctcatactctctctctctggcaccgcacatcacccactccccaactccccggcacaccactccacggcccacacgtccacccccaccccccaccacctgtccacgcagatgttggcacgaaagggctaaaatttgacccctccttgaactcggctggagacccctccaaaccccccgggagatgtcccccccgcaccccgggtgcccccgagccccctgccccctccccctcaaggggtgaggcccttccccggtttatgaagcccgagggttccctaaaaaagttaagaactcccaaaaaa

SEQ ID NO: 593667 - DNA, 261 bp, Homo sapiens
cccaggaactaccaggcaaatcctgagtacatggagcttggtgcagagagacattgtgagctcaaatcagaagaggttccatttccaagttgctgattcataagagctcccccaagtagagccggtgtcctattgaatcttgattcatctggaaggatctcggacatctcttaagaaacaagggactgatctatagccacattcttccatctccagctgaatcgtcagagccactgctatggttcagaaagaccattgaag

SEQ ID NO: 593668 - DNA, 273 bp, Homo sapiens
tttttttttggggggcccccggggggggggggggttttttcggggggcccccccccccttgggggggcccccccccggggttttttttggggtttccccaaagggggcggggggccccctggcccccggggggggccttttttgggggggtttttttttttttgggggggaaaaaacccccccccccccctgggggtttggcccaacccctttttgggcccgggggtgggggtccccccctttgggggaaaatccccctttttttttggggga

SEQ ID NO: 593669 - DNA, 521 bp, Homo sapiens
gccagcccccaggtaaactgatgcacactgaagttggagaacccctgggctataaggtgtcagactttcaaagccccactcaagctgtgtcatcaccatgtaactgtcacggcaatagcagcactggatgtgtgctggtcatcttctgtgcgttgccttgtccccagcatttgacctgtgttgtgtcatttgggcctcgtaacagcctgtgaggcagtcatgggcattactccatgtcacagatgggcaaactgaaacttgcccaggtcacacagcagacggtcgcagaccacgggctcacacccaggcactgggctcacaactcaaagcatgagctgccaggccaccctgaggttcagctggctgcggcgacacggccaaagccatggcccataagcccgctgtgaccttggatggccagctctgccattcacctggcactgcaactgaggacagatcacttcactggcctcagttttcccatctgtagaaaggaacaatagcacccaccacatgagatc

SEQ ID NO: 593670 - DNA, 696 bp, Homo sapiens
  misc_feature (195)..(195): n is a, c, g, or t
agtaggcaactgaatgtggctgtcctgtgtggtttatgctggaaatagtaaccccaacatcactgtcatctctctctaatgcggttgccatataccatggagcacctcagttgactggacaataatattcctggtaacaggcactcttattactggcagttgaagctggagcgatttgtgaatctgctactcacnttgccgtatggtacttttagtcgactattatcagactgagatggcagagagtcttaactgatagcaaccatgtgccgtttgctaactgacgtgtctcttctggttcacaaggtctctgtaatgcacaagtctctggacaaacatgccaaatgatgagcattggaaagccctgtcacgaaagagcaccagctttcgggtctatataatggctttgatatcaagagtgaagatatgttcaaagattctgaaacgccagtataccactagagaggattcagtttgatagctatatcacgttgtgtttcaggagctagtgtagatcttatatccaggcaatatgacaagttcctcactcatttgattttaactgaatgatgtgattgaccacatcgtggttttccagatcttgagtgacaaccgaaagtgaagatccgttggttggattagcatggaggtgcacaaagttctctcttctgggaatgcatggttaaccgagtgtgg

SEQ ID NO: 593671 - DNA, 153 bp, Homo sapiens
  misc_feature (1)..(1): n is a, c, g, or t
ncgaggggtgagggtgtgtccccaatcttcagcacacaacgccagttgggaaaggtcagcttcgtccttcgttgtactgggcacagtgctcagacagcccatccaacccttggtggtagtctcgcattgggtccctgccattgggacagcggg

SEQ ID NO: 593672 - DNA, 222 bp, Homo sapiens
ggagtgcagtggcttgatctcagctcactgtaacccccatctccctggttcaagttatttgcatgtcgtcagcctcttgagtagctcggattacaggcgcccggcctcattcttttatgtaatcatccagcctcctgagaagctgggaccgcaggcgttagcaatcattcccagccagctccatatgagttttggaatgagtttgtctattttcagcaaaaa

SEQ ID NO: 593673 - DNA, 142 bp, Homo sapiens
  misc_feature (40)..(40): n is a, c, g, or t
  misc_feature (66)..(66): n is a, c, g, or t
tctcagacacagtcagaaagcagtggagtagaacagagtngagtgtctgggaagccatgctggtanctagcatgagtgagagctgcattcctgtagaagattcgcagggaacccaatggagaggagactatttctcagacat

SEQ ID NO: 593674 - DNA, 1117 bp, Homo sapiens
  misc_feature (1117)..(1117): n is a, c, g, or t
gggcaaccgaggccggggatcgcgggatcggacgccatcgccgccgccgagtggactgggagcccgcggggtactggagcgggaggcgctgccgttggggccgtcgagccccaggatggtgcagagttcgtgacgaaagtgaggagccccgagagggtacctcaggaggcaacatgagtgagaatgaggaagaggcaatgtctcgagcgaagaaggcagtggggactatgacagtcgaagagatagcagtgtgggcattgaacgcccgagagccctgggtttgagccgacgaagagcccagagttggaagcccaaagcccgcagatttgagcctgaaagcccggggtttgagtcccgaagccctgggcttgtgcccgcaagccctgagttggcacccagaaggcctgaatcagattctcagagccctgagttcgaatcccagagccctaggtatgaacccaaaagccctggctatgaaccgtcggagccccgggtatgaaccccggagccctggctatgaatcgtgagagctctagatatgaatcccaggaacactgtagctcaaaacccagagcccagaacttggaagctcagaagttccaaattccaggcaaggtgcggagatgcttctgaaccccgaggcacacgagtcctttgaatatctccgtaggagtcagcccggtggactccttcactcagggagtcagcgagagcagacgacagggcactggcgcataggggcacctaagagatgcgacaaggagcgcgcatggatacaacgcagttgacagctacagaagccctgagctacacggagccaaagagccacgtcgcaggctagccagcgaccaggcgacggggagcgacaggggaaccaaagagtgaggccacgggcagaaacggatgcgaggggaacaccaggtagacgaccggactgacgggaggaaagacaaaaaggaagaaagcacgaccagccacaacgcaccaccaacgggccgcaggaaaggagccaacgagcagggagacagacaacgatacaagacagaaaggaagaaggagctaggaaacagagacgaagagcgccccacacgaccgggaccagcgaccaaacacgaan

SEQ ID NO: 593675 - DNA, 425 bp, Homo sapiens
tctagagtgatcccctccttatgcccgctgctattcgtgtgcattgtgaacacgactgtgcagttatgcattatcagttgtgttcccctttgcttggcgtagtgattgttgaaggagaatcacatccagcttcgtgatgcaggctgagtgttgaggaaatttccgcagttttaagccgtcgtgtctgtgattgcccctgcgtacatttgctggtgtattaataggataaatgcttttagttcatttctggtggtgggaggggactgaagcctttagtcttttccagatgcaaccttaaaatcagtgacaagaaacattccaaacaagcaacagtctacaagaaattaaactggcaagtggaaatgtttaaacagttcagtgatctttaatgcattgtttatgtgtgggtttctctctcccctccc

SEQ ID NO: 593676 - DNA, 86 bp, Homo sapiens
tttttttttagcttttaaaataaacaataaagcccgttatttattatctaaaagccagtaaatacatttacttctttggtacccat

SEQ ID NO: 593677 - DNA, 409 bp, Homo sapiens
  misc_feature (18)..(18): n is a, c, g, or t
gaggatcacgatgtccgnttagaatggtatgttttgcagggctggtacccgtgatccttttatgtgtaggcttttttcaggagttctgtaaggcagtcctggtggtgacaaaatctcagaattggcttctctaaatgattttatttcttcacttatgaagcttagtttggctggatatgaaattctgagttgaaaattctttttttacagaatgttgaatattggcccccactctcttctagcttgtagagtttctgcagagagatttgctgttagtctgatgggcttccctttgtgggtaagtcaaactttctctctggctgcccttaacattttttccttcatttcaaccttgctgaatctgacaattgtgtgtcttggagtcgcccttcaccattagcgtacggag

SEQ ID NO: 593678 - DNA, 234 bp, Homo sapiens
tactttgcatgttctcattgccaaaaatcaaacattcaggtataatacaaagttttttggaaaaatgttttcgatctaaaacatgtaatattccctcatttataaaaatatacgtacttttctttctttaaattgttggcttatgcagccttctaatggcacattaatagaaactaggtgtatgaactggaaagttttctgataaatgcctaaactcaaagctcttgttccatt

SEQ ID NO: 593679 - DNA, 179 bp, Homo sapiens
gtgttgtccctgcttaacacggttgtctcactttatctcgcccaggtgagtgcagtggattgattatagctcattgcctccttgaattcttggactcgagcaatcctcttgcttctgcgctcctgagcagctgagaccacaggcatgtcctgttagaacacccagctagtttttgaatg

SEQ ID NO: 593680 - DNA, 136 bp, Homo sapiens
ggcgaatctctaaggacaacggtattaaacatttttgcatatcttctttgccatctatagatcttctttggtgaaatctgttcaaatcatttgctcatttttaaaaataaaagattgaggccatagtgcggtggct

SEQ ID NO: 593681 - DNA, 499 bp, Homo sapiens
  misc_feature (12)..(12): n is a, c, g, or t
  misc_feature (58)..(58): n is a, c, g, or t
  misc_feature (78)..(78): n is a, c, g, or t
  misc_feature (128)..(128): n is a, c, g, or t
  misc_feature (178)..(178): n is a, c, g, or t
  misc_feature (186)..(186): n is a, c, g, or t
  misc_feature (205)..(205): n is a, c, g, or t
  misc_feature (214)..(214): n is a, c, g, or t
  misc_feature (226)..(226): n is a, c, g, or t
  misc_feature (238)..(238): n is a, c, g, or t
  misc_feature (240)..(240): n is a, c, g, or t
  misc_feature (316)..(316): n is a, c, g, or t
  misc_feature (320)..(320): n is a, c, g, or t
  misc_feature (323)..(323): n is a, c, g, or t
  misc_feature (330)..(330): n is a, c, g, or t
  misc_feature (436)..(437): n is a, c, g, or t
  misc_feature (442)..(442): n is a, c, g, or t
  misc_feature (485)..(485): n is a, c, g, or t
aaaacactttcnaaagaatccttctgccccagagtggctgggcttagaaccatctctncagccacagggcggaaactnttggtgtttgggtggtggggtatggtcccccatcccaactatcttggagncctcatcatggctttgggttggtccttgccctgcggggtgtcacacctgntgccctanttttacctcctttatttcnccgcgctgntggtgccccgtnaggcccgggatnancggcagtgccttcaaaagtacggcctggcctggcaggagtactgccggggtgtgccttaccgcatcatgccctacntttnttnaaggggntccccccccccaggtgggggcatgtgcccctttttcccccagcccccccagggccaggagccttgacccctttgggattcaagggcttgccccccccccagccctnnggatnaacaccctcaaaaaaaaggtggtttagagcaaggaaaaaaatnaaccccgtgcccca

SEQ ID NO: 593682 - DNA, 113 bp, Homo sapiens
tttttttttcacaggagtactgccaatcagaagacagtgaagcatttgttctgggtttatatcttattagatcacatccctttacccagaacaaatgcttcactgccaatcag

SEQ ID NO: 593683 - DNA, 780 bp, Homo sapiens
atcctgacctcctgccccttcagaagcgtccctgcagctcctgcctgcacctggcagggagcaccgctacagagtttgctgctgtaccggctcagaaacgggagttcccggcacagggccatcggcgagcctcccagctggagtgtgggcagaggcagacactggggctgcaggggagtggcccccagggtgtgaataggagggcatcctgcaggctccagacattgccatgcgtgttgctgtgattaacccccaaacccagctccatcattcattcactccttcatttgttcatcctattgtcccaggagctgggctataacagaaaggagacaggccacagacagacaggcaaggccatcccaggcagtgagaggcgacgtgaactctgtgaactgagatgatgaggaagagaggagaagggcggggccgctttagaaaggctgctggggatgtcctgtttgaggaggtgaccctgtcactggagccaagccaagagctggggaagagcatgtcaggccccgagaactgcaggtgcaaaggccctgaggcaggaccctagcaggaccctagcaggtgcaggtgcaggtgcaaaggtcctaaggcaggacctgagcaggtgcaggtgcaaaggccctgaggcaggactgagcagattgcaggtgcaaaggccctgaggcgggacctgagcaggtacgggtgcaaaggccctgaggcaggacccgagcaggcatgtctgaggggtcaaaggacgcctgtgtgcctggagcagagggtcaa

SEQ ID NO: 593684 - DNA, 674 bp, Homo sapiens
acctcctcggactcctgcctcactcatttacaccaacccacccaactatctataaacctagcgatggccatccccttatgagcgggcgcagctgattatagggctttcgctctaagattaaaaatgccctagcccactgtcttaccacaagggcacaccgtacaccccttatccccatactagttagttatcgaacaccagtcaggccgtacgtcattcaaccaagtagccctgggccgtacgcgctagagccgctgaacatctaggtgcaggcgcacctacgtcatgcacctgattcggaagcgccaccctagcaatatcaaccattaaccttcccgtctacagctgtatcatgcgttcatcaattgctgaattctagctgactatcctagaaatcgctgtcgccttaatccaagcctacgtttgtcacacgttctgagtaagcactctacgctgcacggactaacacgattaacacaagaaaaaacacaaaaaacccggaggggaccgaatcgcgcgggcgcggggataaaagaccgtagcgcaatcgggccacagaggccgataagcgtagtaccgagacccggtcttctggtcccacggggtcaatcccgccggccaccctgtcgggagccgtgaaagtagcccgaaaccgcgtcacctgttcaaaaagg

SEQ ID NO: 593685 - DNA, 119 bp, Homo sapiens
tcacctatcccggatctgggtatgactttcctattaatgataaagttagtacattctatggctactgtggtcactgggacctcggcacatcatctctattggccctgctacccaccaga

SEQ ID NO: 593686 - DNA, 597 bp, Homo sapiens
  misc_feature (313)..(313): n is a, c, g, or t
  misc_feature (454)..(454): n is a, c, g, or t
cacacaaggacaccattttgtgatgatgatggtgctttatgcagcttccaccatttacaagattttcctgtggtgtggaacctctcatgataaagcaaaggaactagaagcttattccagtcaagatttctgatttatcttgtggtaagcatttgggaaggacatatctgcacatgacctgagactaagtactatacactgaatcagatgaaaattgctcttaggaagcttacaattttccaaatagttaggacaaaaacaaactctccttctctcttcctatatgtacatactgacatcttatatcattacntgtcttccttaggggttatgattcctgtatggtttctttggggtgctgcattaggacctgagactctgattgaaaattcttccacgggctcgctaccattccaaaactttattctccaaatatgaatttcccaagatgccntcacaaggttctgagctccatttctgaaggcttttcccagtgctgtgtcagcattgcatacaggcttttataacaactctcgacctcctatgagtgtcgaagtaaaagtgtgtatctctgatttgcacaaaagaaaaaaaaaa

SEQ ID NO: 593687 - DNA, 358 bp, Homo sapiens
  misc_feature (75)..(75): n is a, c, g, or t
  misc_feature (236)..(236): n is a, c, g, or t
  misc_feature (316)..(316): n is a, c, g, or t
tgatgaggtcacagctggcttgcgccatctcagatggagtggtccttttcattgatgctgctgagggggtgatgnctgaacacagaacgccccgggccctttgggcaccttccaaaaaggccaaattgctggtgccaggaagagcgctggcagtcactgtgtgcataacagattgacggctgatcctggagctgaagcgtgcctccaactgatgcgttattacaagctgcgccacnattgtggcatgaaggtcacattggaaagttcctaaaacgtaaacgcccaattggtaatttccaacgtgatgagaacctgnatcctttccccactcctgggtacgttgcttctccagtcccag

SEQ ID NO: 593688 - DNA, 108 bp, Homo sapiens
gaattgtgtatattttaaataattataaataacatttatttttaaagaatatcaatccttaaaaataaaaaataggacaggtacagtttctcatcctgggagcaattt

SEQ ID NO: 593689 - DNA, 442 bp, Homo sapiens
cagctaccaccggaagctggaagagtcagaaagggtctccccaaaagcccccaaaggaagctggacctgcttgagcttcgacttccagactccagaactgtagagagcagcagctcctcttgcccggcgcggtggctcacgcctgtcatcccagcacttcgggaggctgaggcgggtggatcacttgaggtcaggagttcgagagcagcctaagcaacatggagaaaccctgtctctactaaaaaatacaaggactagccgggcgtggtgatgggcgcctgtaatcccagctccttgggaggctgagggaggagaatcgcttgaacctggcaggcggaggtggcagtgagccgagattgtgccactgcactccagcctgggcgacaagaggggaaactccgtctcaataaatacataaataaataaggtgaaacgccaaaaa

SEQ ID NO: 593690 - DNA, 765 bp, Homo sapiens
  misc_feature (1)..(1): n is a, c, g, or t
  misc_feature (17)..(17): n is a, c, g, or t
  misc_feature (211)..(211): n is a, c, g, or t
  misc_feature (222)..(222): n is a, c, g, or t
  misc_feature (243)..(243): n is a, c, g, or t
  misc_feature (249)..(249): n is a, c, g, or t
  misc_feature (270)..(270): n is a, c, g, or t
  misc_feature (282)..(282): n is a, c, g, or t
  misc_feature (290)..(290): n is a, c, g, or t
  misc_feature (311)..(311): n is a, c, g, or t
  misc_feature (320)..(320): n is a, c, g, or t
  misc_feature (330)..(330): n is a, c, g, or t
  misc_feature (333)..(333): n is a, c, g, or t
naaattttatattaatntaataagttataagagaagtgagatttcaagcccgcagcccgtgtcgccgccatggcttcgccgcagctctgccgcgcgctggtgtcggcgcaatgggtggcggaggcgctgcgggccccgcgcgctgggcagcctctgcagctgctggacgcctcctggtacctgcctgaagcttggggctgcgacgctgcgnacgcgagttcngaggagctgccacatcccggngcgccngctttcttcgacatcgaccangtgcagcgaccngcacctcngccctacgaccacatgctgcnccggggccngagcatttcngcnggagtactgcagtgccgcctggtgctgtgtggtgcagcggccacccaacgtcagtgatctacgacagccatgctgaccagggcctcatacatcctgacccgcagcgtctggtggatgttaccgcgaccttcggacaccacagccgatgtcactgacttgatgtgccggctccgacagctggctgcagccagaacctcccgacaacagcatccggcgaagagccaaactgctcccgacgagtatccgcgcatagctcgaccccgacatcatcaagacctacgaggacatcaaggagaacctggaatcccggagctcccaggtggtggaatcaccgagcacaggcaaggaccagggaccagacccgagccgacagaggatgaccaggcaaatccaggtccggaaaaccctcaaaaatcggagcagaggctgaaa

SEQ ID NO: 593691 - DNA, 961 bp, Homo sapiens
gacaggcggtcaagatggcggtgatagtagtataggccgtctcactcggaggaagtcggaggctgtcgtgcggctggttcgttgtccctccactcacgcgtgcctaggaaggtggtcgtacgcagtcgttggtggaattatgtggtaacgactacgatagatcaagcctgtgcaaacatcgctaatgatgggaatgagttgagcttattagaaattctagggattgagtccgtgctgaagaacaggtacgtgtcgtggaaaaatacaaaatagttgtggaagaattagggtcataatgggacttggttcgacttagcattctgtaaaatctaccttgtaattgtttagcacaaatagtgggtcctgatttgagatttatatgcagccccgttttgagagtccaaacccgtttttggcttggtgttgtcatatccctatcattgtgagttgctggggattcttgaccatttattacctcatataccggagtcagacgcatcttctcattcgtgcccgacccggaaaagatcctacaggaagtggctcctttgatgactcttcgttacagactgtcctccatgtcttactaaggttttgatgaacaatgtacacgcttgaaggctggatcttcatcaggctgggattatcacggaagaggctaaagtctgagttctaaatcgtccataggtacgtctttggtccaacagtggaagttggtcatgatggagtattgagctgaaatatcagggctcaatgatgccttgtaggataaaagaaacctagtgtggcatttaaagtagccgatgcggggattgtaaataacggaggggggggggcaaaagattagtggtcgaaacttgcaacacttttggcggatatgcaaggacagggccgtattagatccgttaagagagcctgggggataagtggcgggggaagcgaatatgggattaatgaagac

SEQ ID NO: 593692 - DNA, 888 bp, Homo sapiens
tcctggtgtcccctagtcttggcggaggagcctttagatgagccccgaaaggccgggcagggaggacaagctctttggggctaccaaaatagaagcagcaatgcctgtgtgtggccaacccttctggatctcagcagggatgagagtgcaaaacggaattcttcgaaaataggaattggaggcatatgctggagttatcagtgcacttcgggcacaagggggatctcaccaatggaaaagagagatcttctggaagaactatcagaaagttcttagcatctcaacagaacgccaccgtgctgaagtcggagagcagtaaaccgatgaacggttaacaaacgaagtatgcacataatatgtctggaccctaactagctcttcagcactggtccattgacggtcgctcgattgttaccacgtgatgccccgggtcgttccacaaaaccggcgttttactgtaacagctaaatgctgtggctaaatgcaggtatccagataatgcattcttccagtgcctgcgcgaacaggaagcaaggagggtgagtagaaaaatatgcgggtgttagagaatagtttcttaagaatcgtacaggaaaagttcaagaaacgggggatttatcattgtaattgagtatagtgttaaaggttatgaacaatgtaggaaatctattctgaatggactgcgagtttagcttagacaaatttgttcccttgtgagggtgattatgtaccatagaatgagactggaggattggaaaggggaggcaaagaatagggtaggggatagaaaaagaatagtatgaacaagatgagtgaaaaaagaagaaaatgatgaggagagaagaaagaataaagaaaaagaaaaaagaaagaataaactgactgaga

SEQ ID NO: 593693 - DNA, 947 bp, Homo sapiens
  misc_feature (1)..(1): n is a, c, g, or t
  misc_feature (17)..(17): n is a, c, g, or t
  misc_feature (211)..(211): n is a, c, g, or t
  misc_feature (222)..(222): n is a, c, g, or t
  misc_feature (243)..(243): n is a, c, g, or t
  misc_feature (249)..(249): n is a, c, g, or t
  misc_feature (270)..(270): n is a, c, g, or t
  misc_feature (282)..(282): n is a, c, g, or t
  misc_feature (290)..(290): n is a, c, g, or t
  misc_feature (311)..(311): n is a, c, g, or t
  misc_feature (320)..(320): n is a, c, g, or t
naaattttatattaatntaataagttataagagaagtgagatttcaagcccgcagcccgtgtcgccgccatggcttcgccgcagctctgccgcgcgctggtgtcggcgcaatgggtggcggaggcgctgcgggccccgcgcgctgggcagcctctgcagctgctggacgcctcctggtacctgcctgaagcttggggctgcgacgctgcgnacgcgagttcngaggagctgccacatcccggngcgccngctttcttcgacatcgaccangtgcagcgaccngcacctcngccctacgaccacatgctgcnccggggccngagcattttttggggacgcggggtgactgggcgtgggctggggcacggacggtgggtatcagcgaagccggggaccaatgccatctaaaacgtttcttgtgtgtctggtgtagtatgtgtcgccttcgacgtcttcgaggagtccgtggctcgccgaggtgcatccctcgctctcgcgctccttggcgtagatagtcacgcttgaggtcgctagagcgttagccattaggaagtggtgcatacagttagactactaatttacagagaccgtatgatgatatgtagagagaagagattgagcgctggatggaagagtgtggtgcgtaccgctcgtcagggtgtgtagggcgttggggcgtcttgggagtgtccgaggtacggagatagctagtgatgctgcctacgcggagagatagatagttccggcagatccgaattaagtagggctatgttgttagtggtaggcgcactctgccgcggttattatatcacgtcgcgcgtatgggccggcagtcacagagacctgatcagagagaggtgagagagagggcatgctggtcgtctcctcgtgcatccggcacggcaccaagagatatcgtttgctgtgtttgagcgggtggaataggt

SEQ ID NO: 593694 - DNA, 116 bp, Homo sapiens
tacatagtccctaacaaacacttactgcagcacctactatatgcaggcactataataggtgccaggaaacagcagtgaacaatggtgtaatgagtttctgcctttgccatggagca

SEQ ID NO: 593695 - DNA, 164 bp, Homo sapiens
tccattaaattttctagccataattcttggcattcccgaaatatccaggtttgttatatatagattttttaataaaataatatttcttggtagggtcgggatttcccccccttttttttggaaaaggttgcggccggttccctctcccggcccgccaccccata

SEQ ID NO: 593696 - DNA, 156 bp, Homo sapiens
  misc_feature (101)..(101): n is a, c, g, or t
agagcggatgactgggccgctgccgcccctccgtccgatctgaagccggtctggcacgactggttctaggcgccgcgccgcctggccccggtgcggcgtgntcgcgccgtccttgaaccgacttgaactgattgcgcgcccgaggcgccgccgcca

SEQ ID NO: 593697 - DNA, 484 bp, Homo sapiens
aagtatgacgctttggcatccagagtgctttgaactaaaggagactgaaggccccagaagccaagtttccctctgaccttctcctgccttcctgtcttccaccccctacttttcccctgaagtgagtcctggagcccagaattcgttttgcccaaagcaagccgtgacaccctggaaatatcactctagccttccttgcctttccgtgtggcagctgcccatgaagaaattctttgacctaccttgtttgatagcagatcacaagaccctggttccagagcggtcttgctttacgccgagggaaaggaatgtcatacagaaagcccaagaagagtctgaaaagatgtccaatcacctttgcacgtggctgcccattattcattgaacctaagcattaaaatagacaggttcccctgggtctttgggtcttcatttatgaagcctccatgtcatgtacaactttgattaaataaatggttcatga

SEQ ID NO: 593698 - DNA, 444 bp, Homo sapiens
gagggtaagacaggaagatcacttgagccaaggaggttgagaccagcctgggcaacatagtagacccatcttaaaagaaaaaaagattttttttttgagacagagtctcgttctgtcgcccaggctggagtgcaaaggtgcgatctcagctcactgcaacctccacctcctggcttcaagtgattcctgcctcagctttccgagtagccgggattacaggtggccacgacaaaacccagctaatttttgtatttttagtagagatgaggtttcaccacgttgataaggctggtctcaaactcctgacctcagggtaatccacctgtctcggctcccaaaagtgctgggattaggggggaacgcccataaccgggccaaaaaaaattttttagccaaagaattccttttaattttccaagggcggtttttttttttttttttttg

SEQ ID NO: 593699 - DNA, 235 bp, Homo sapiens
tttttttttgtgacaggatctcactgtgtcacccaggctggaatgcagtggcagtggcatgattatagctcattgcagcctcagtctcccgggctcaagtgatcatcctgcctcagcctcccaagtagttggaactataggctcatgccactgcgcacagctgatttttaattttttaattttatatttttttagtagaggcagggtcttgctctgttgcccaggctggtttcca

SEQ ID NO: 593700 - DNA, 667 bp, Homo sapiens
gcggccgccaactagctggcgggggcggaagatggcgacgcccctcgggtggtcgaaggcggggtcaggatctgtgtgtctcgctttagatcaactgcgggacgtgattgagtctcaggaggaactaatccaccagctgaggaacgtgatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagaggtagaggtgctatccaagcagctggagaaagagaagctggcctttgaaaaagcgctctccagtgtcaagagcaaagtccttcaggagtccagcaagaaggaccagctcatcaccaagtgcaatggtaggcgggaggcccgtgctctccaccacggttatataaacgggctctttcctaaccacccagtgcctgtgtcaaaggcagggtttcactctaacacctgtccccagctgaggatacaggcaggcccgggtgggccacaccttcgaaaaggccttaagggaccaggcaggccacggaaatgagggaagcagtcggtgtactatattcttcaccgccataaaggaatgggcttgctcccatttttcctgaaa

SEQ ID NO: 593701 - DNA, 906 bp, Homo sapiens
gcggccgccaactagctggcgggggcggaagatggcgacgcccctcgggtggtcgaaggcggggtcaggatctgtgtgtctcgctttagatcaactgcgggacgtgattgagtctcaggaggaactaatccaccagctgaggaacgtgatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagaggtagaggtgctatccaagcagctggagaaagagaagctggcctttgaaaaagcgctctccagtgtcaagagcaaagtccttcaggagtccagcaagaaggaccagctcatcaccaagtgcaatggtaggcgggaggcccgtgctctccaccacggttatataaacgggctctttcctaaccacccagtgcctgtgtcaaaggcagggtttcactctaacacctgtccccagctgaggatacaggcaggcccgggtgggccacaccttcgaaaaggccttaagggaccaggcaggccacggaaatgagggaagcagtcggtgtactatattcttcaccgccataaaggaatgggcttgctcccatttttcctgaaacataaaagacagaatagaacaaagtccgaggggaccaatggcagggggccgagacagcgggtatcgccgtggccatgggcatagcggtactgaccaggttcttggacagcgggtacattcgcggccccaaaaggggcgataattcgatagcaggtaccggtaggaaccggaaaccgaggacacaaagacaagccagctcgcaccaagacgcacaccaccgcgagaccagcggacagaaa

SEQ ID NO: 593702 - DNA, 195 bp, Homo sapiens
attgcaggggagaggctggcgcaattggacctttgggttttgaagaacagcccaagtctggcgcttgaaatcctgcagacccagagtatcatgcttgtgacttcaaggacttggagacacgcttctggtaaagttaggaagtgccattatctctgatccccctacagtgctaaaggctgcacgattaaactcttg

SEQ ID NO: 593703 - DNA, 111 bp, Homo sapiens
tgctgttggtgactctagatgatcccctcatgggctacattttctaccccagaaaactacgatagcccttatgaaacttaatgtggtctgaagtgtgggtgtacctgatgc

SEQ ID NO: 593704 - DNA, 782 bp, Homo sapiens
  misc_feature (701)..(701): n is a, c, g, or t
  misc_feature (704)..(704): n is a, c, g, or t
gcggccgccaactagctggcgggggcggaagatggcgacgcccctcgggtggtcgaaggcggggtcaggatctgtgtgtctcgctttagatcaactgcgggacgtgattgagtctcaggaggaactaatccaccagctgaggaacgtgatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagaggtagaggtgctatccaagcagctggagaaagagaagctggcctttgaaaaagcgctctccagtgtcaagagcaaagtccttcaggagtccagcaagaaggaccagctcatcaccaagtgcaatgagattgagtctcacattataaagcaagaagatatacttaatggcaaagagaatgagattaaagagttgcagcaagttatcagccagcagaaacagatcttcagcccaccaccagccggctccgttgcaggaatcacatgtctgacttccggatccagaagcagcaggaaagctacatggcccaggtgctggaccagaagcataagaaagcctcagggacacgtcaggcccgcagccaccagcatcccagggaaaaataaaatggccgccgctttcctgttcctgntgnaatccccagcctctgccttctctgctctgggagtccccagcctctagcccctgctacttccctccctcttggatagtg

SEQ ID NO: 593705 - DNA, 1150 bp, Homo sapiens
gcgctggccttgtttgccgtggcgcgggttggtgtgtgggcgggtcgtgggggcgctcgttccggtgtcttggtgtgtgtggggggcgcgcggtgttgtggtggttgtgtgtgtggtgggggggtgtgcgcgggtcgtgtggggcgtccatcggccctcgtcgggcggtgtggccctggggtgtcgggtggtgtggggggttgttgtggtgtgggtggggggtgtggtgtgtggggtgtgggcgctggtgggggcgggtcgggtgggggggggggggggggtggtgggtgggggttcatataagccgggtttcgttttaggggggcccgtgcgtgtttccccctggtgtgtgggccattggcgccggtgtgtttgagcgccgccgctagagatgacgcccgggggccgaggtgcacgcctttccggagctttctatgccttatgggccccggggggcgggagtaaccatgttgcggcgcccggggtacacggctattgacccctttgtgggcctcattttaaggggagcccgtattagggaaccagtgttggtggacccaagtaagggccggcgtggtgtatccgcgttccggggtatgtgtcccgcggagtaattcgtgtcgaggcccaccggcgttccgggctcggctcgccacggggcgcttgtagcggagcccttattctatgggaaaattgagagcctgagtggaaacgccctatgtttgagaccccacgttgtaagctccagagagaagttggaacttggaggttcacgagatacacgctacactttttctccacgccactttcccccaacaacactcctcggagaaggcttggttttgagggcctctttgtactcgctgagacttataatagagggtttttttaaaggtatttgggtcacgctaaccacgaggagactggaggttgtcacgccctggacacactttatgagaattcttttgaggcactatgaaagaaattctggggagttattaatgttaccacgttgtatgaaagaatgtgagcttctaggagcacgagttgttggctacggcacaactctgattatagaacataaattcatcccttcctgtgctaaggtatgtgctgcttataaataaaatggacagctgttttttagcca

SEQ ID NO: 593706 - DNA, 583 bp, Homo sapiens
  misc_feature (570)..(570): n is a, c, g, or t
gcggccgccaactagctggcgggggcggaagatggcgacgcccctcgggtggtcgaaggcggggtcaggatctgtgtgtctcgctttagatcaactgcgggacgtgattgagtctcaggaggaactaatccaccagctgaggaacgtgatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagaggtagaggtgctatccaagcagctggagaaagagaagctggcctttgaaaaagcgctctccagtgtcaagagcaaagtccttcaggagtccagcaagaaggaccagctcatcaccaagtgcaatgcctttgggcaggcctgcccacttctctccaaggaccttctcctgccctcatgtgggtcctctggtccagaatagacttgtgaagtcattgacaacaatcctcaaacactgcactcccccaagactgcataataaactcattcatactaaggtantagcagttcttca

SEQ ID NO: 593707 - DNA, 926 bp, Homo sapiens
  misc_feature (913)..(913): n is a, c, g, or t
cgcttggccctctgccccggtgtctcctcttgcgctttctgcctcttccccctcggctgcaggtgctccgcccctggattttggtcgtgattccgatgtgctctttttggtcgtgtacccctggcttccgtttagtcggtctgccagtatgctgtgtgacaccactatgtccccgggcttcttacggcccttaggtgataagccgtgggatatcccggggtcgcgtgtccttgggggccgctacagtcccgccacgggaggagatcaagatggaggtaagtatatgtatcctaggtaaaaatgttatagcacatataatgcacggaatgtttgggcatctgttgctcacgcctgttatcccagcattttgggagctgaggtgggtgcatcacctgaggtcagaaattcgagaacagcctggcccacatggtgaaaccccatctctactgtaaaatatccattattagctgggcgtggtgtgcaggcgcctgtaatcccagcgtatctcgggaggctgaggcaggagaattgcttgaactcaaggagggtggaggtttcaatgacccagatcaagccccgcactccagcctggcgacagaccagactcagtttccaaaaccaaaaaaaaaaaagagaaagcaggaagagggaacaggaagtactgggaaatgtaattttttgatgagggagagtttctccaaggaggcaacatctgtaaagacctgcaggagttgagggcaggcgccattcatcttccagcctttgggcaggcctgcccacttctctccaaggaccttctcctgccctcatgtgggtcctctggtccagaatagacttgtgaagtcattgacaacaatcctcaaacactgcactcccccaagactgcataataaactcattcatactaaggtantagcagttcttca

SEQ ID NO: 593708 - DNA, 151 bp, Homo sapiens
ggcctgtattgtatgggctgtcctaaatacagcactcgatagtttctctatttctcccaggtcctagctgtttctgttgttaaaatactaacagaccgcaactcaacagcaccttcttcgaccccgccggaggaggagaccccattctata

SEQ ID NO: 593709 - DNA, 756 bp, Homo sapiens
  misc_feature (675)..(675): n is a, c, g, or t
  misc_feature (678)..(678): n is a, c, g, or t
gcggccgccaactagctggcgggggcggaagatggcgacgcccctcgggtggtcgaaggcggggtcaggatctgtgtgtctcgctttagatcaactgcgggacgtgattgagtctcaggaggaactaatccaccagctgaggaacgtgatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagaggtagaggtgctatccaagcagctggagaaagagaagctggcctttgaaaaagcgctctccagtgtcaagagcaaagtccttcaggagtccagcaagaaggaccagctcatcaccaagtgcaatgagattgagtctcacattataaagcaagaagatatacttaatggcaaagagaatgagattaaagagttgcagcaagttatcagccagcagaaacagatcttcaggaatcacatgtctgacttccggatccagaagcagcaggaaagctacatggcccaggtgctggaccagaagcataagaaagcctcagggacacgtcaggcccgcagccaccagcatcccagggaaaaataaaatggccgccgctttcctgttcctgntgnaatccccagcctctgccttctctgctctgggagtccccagcctctagcccctgctacttccctccctcttggatagtg

SEQ ID NO: 593710 - DNA, 116 bp, Homo sapiens
ggatctcgagaagttgtgagacgagccttaagcaggcctaatgtggtgtgctgtggcctgttctttgagtccgagccagtctcggcttctatctccgcgatcttagcgtaaggtgc

SEQ ID NO: 593711 - DNA, 867 bp, Homo sapiens
  misc_feature (786)..(786): n is a, c, g, or t
  misc_feature (789)..(789): n is a, c, g, or t
gcggccgccaactagctggcgggggcggaagatggcgacgcccctcgggtggtcgaaggcggggtcaggatctgtgtgtctcgctttagatcaactgcgggacgtgattgagtctcaggaggaactaatccaccagctgaggaacgtgatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagaggtagaggtgctatccaagcagctggagaaagagaagctggcctttgaaaaagcgctctccagtgtcaagagcaaagtccttcaggagtccagcaagaaggaccagctcatcaccaagtgcaatgagattgagtctcacattataaagcaagaagatatacttaatggcaaagagaatgagattaaagagttgcagcaagttatcagccagcagaaacagatcttcaggtgaggggtctgggcccggctgggggttgttgatgacactggggagccagacctctggcccctacctacccttggctgtccacagcccaccaccagccggctccgttgcaggaatcacatgtctgacttccggatccagaagcagcaggaaagctacatggcccaggtgctggaccagaagcataagaaagcctcagggacacgtcaggcccgcagccaccagcatcccagggaaaaataaaatggccgccgctttcctgttcctgntgnaatccccagcctctgccttctctgctctgggagtccccagcctctagcccctgctacttccctccctcttggatagtg

SEQ ID NO: 593712 - DNA, 160 bp, Homo sapiens
gagttctatatctgtctcaagtcatgactcatctgctcttgatatggccgagctcagctgtctagcttatggctgcagcctcatggtggatgatgtccaggagctcattctcagcaatgactgtggtgtcctctgggtctaaccattctgttcccttcat

SEQ ID NO: 593713 - DNA, 770 bp, Homo sapiens
  misc_feature (581)..(581): n is a, c, g, or t
  misc_feature (594)..(594): n is a, c, g, or t
  misc_feature (678)..(679): n is a, c, g, or t
  misc_feature (689)..(690): n is a, c, g, or t
  misc_feature (694)..(694): n is a, c, g, or t
  misc_feature (699)..(699): n is a, c, g, or t
actctcttaataatcaccgctacagttgaaacgcggtgtctgggcgttgaaaaagggcagtaacagcagtgcggaaatcccggcggcgatagagataaccacaaaaaatccgctccagtgccaggtatcgagtactttcgccagcggccaaccagcaagcgacgcccccagataagcaaacaagccgacaaaccccgtcgccgcccctgccgcctctttgtgggaacactctgccgccgccataccgattaacatctgtgggccaaagacaaaaaaaccaatggtgaagaagcaggttgcctgcatcacgtagctggcaaatggcataagccacagggagccgactgaaagcaaaattccggcggcgaaaatcaaattcatcggccctcggttgccgttaaacaatttgtccgagccccaaccggctaccagcgcaccgataaatccgcccagttgaaacatcggcactgccgtattcgccgtgaccagatcgtatgagtttactaaggaaatataatagaagttttgggtctctgaaaccttgaacgagttgcattaaatttaacaaaacgacactaatnttcttattaattnttcttaaatgaaattaaactcccatgcttttaagccatttaaatacctgaggcactggatagctgctaaatattaacctggganngagggtgatnntttnaaaanaaacaacgaagtgagattgttctcgaacagaaccataacttgggaaaggcctaattctccacaccggaggg

SEQ ID NO: 593714 - DNA, 125 bp, Homo sapiens
tacttaagagaaggaacccgaaggcaaggagggttattcttggtgcaaggttaaaaaggttaccttaaaggttaaaaggccaaggaggggaagccccccttgagagcgcacacccttttctctct

SEQ ID NO: 593715 - DNA, 494 bp, Homo sapiens
cctttataagtacattcaattttatgatttacatttatcatgtaatttttaaaaagaatagcaaaagcagactttgtatcaacatatcctagatagatggatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcggatgatgcttctaaaacagcattgataggttaaagaagcttggtatttttaatttacttcaatgattagctcagttgcttaactggagttttaatcctgtgatatgtacattggattcatgactgtgcagcatttttag

SEQ ID NO: 593716 - DNA, 529 bp, Homo sapiens
  misc_feature (117)..(117): n is a, c, g, or t
  misc_feature (125)..(125): n is a, c, g, or t
  misc_feature (129)..(129): n is a, c, g, or t
  misc_feature (132)..(132): n is a, c, g, or t
gtttgcatgtctacagtttttttatagtagcagcaaaatatggtgtacactttataagatacacttcaatatttagtgatttacactcttatcgatgtaagtatttaaaaaaatccntctatctngganatnttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcggatgatgcttctaaaacagcattgataggttaaagaagcttggtatttttaatttacttcaatgattagctcagttgcttaactggagttttaatcctgtgatatgtacattggattcatgactgtgcagcatttttag

SEQ ID NO: 593717 - DNA, 207 bp, Homo sapiens
gggcaatcgtgcatggtgcttgtgtacatcctacagaaaactcatctctccttatccacactgaaatttaagagaacttactgaagttaacatataccattctgggaagtgaattataatgcgtaattattacaattaccacaactggaatgtaacagggttctaattcagagaacagaatttgtcagaaggagaaggaagaacaag

SEQ ID NO: 593718 - DNA, 1119 bp, Homo sapiens
ttttagcttccctaacttacctttcactgcacatatacagcaaacaaggagcagcttttagcttttaacttaattaacaacttaacacgcatgctgactgaggacttaaagtgaatcaaaagcacttaactttgtacgacttcttttacgagttactgagctaggtatagtttggggaacactcaacctggtgctggctgctcttaacaattcttgtaaatgaagataactttcctttctctagaggtacatattaggccttttatgaacactaacaacaatgcaggaaatgcttggctcatggggcaaagctatcacttaacaattgaacttcatccatttttcacaaaaacacttcatgcaaagcattctggtgtgaattgccattttctttcttactggcttctcaattttcttccttctctgcccctacctaaaacattctcctcggaaattacatggtgctgaccacaaagtttctggatgttccacttacacctcttggcccgtcgtttccagtccggcgcactttccccctcctaccttcactgggtcgatcacaggcggacgctgcagcgaccacgggtgccccattgcctagtcccaactgctcttctctcctggagtcggaatcttttcctccccaccatccttaggatcttctactacggtagcctggctcgaaacgggcaacacgtgattcacgcaatttgacgcggatcactggcgcgcatctgccccctgggtttaagcccttcccgcacctccggccccggctctggctcagccttaggccgggcgtgtggagcacacgtgcttatgtagtttcgccccggctatggcgccccccgctaaaagggtcttttcttggacacgcggtcatcactcagcgccggcgttttacgcctcctctgaggcacaaacgcctgctggtggggctcgcgacgaatcctcatcagttcgtgcagtcctcacaacaatcaattagagggctgttgacagtcgttctccgcgcacggcgggacgcaatacccaactcgttgggagtggcgataggcatcaccattcctctgtctcatcacgacgcgcgagtatgcgcgacttcttcaacaagaacgg

SEQ ID NO: 593719 - DNA, 823 bp, Homo sapiens
  misc_feature (143)..(144): n is a, c, g, or t
  misc_feature (180)..(180): n is a, c, g, or t
  misc_feature (189)..(189): n is a, c, g, or t
  misc_feature (218)..(219): n is a, c, g, or t
  misc_feature (221)..(222): n is a, c, g, or t
  misc_feature (225)..(226): n is a, c, g, or t
  misc_feature (239)..(239): n is a, c, g, or t
  misc_feature (242)..(243): n is a, c, g, or t
agcgggcggggcccttccagcatatccactttcgtcaggtactggagagggctgccggccggatgccagggcagaggggcagggcggacggctaggagttcaagaaacatcctggtctgagggaaaggctgcagcctgcaccnncatgaataagcttttcagcttctggaagaggaagantgagacccncagccagggctacaaccttcgagaaaagnntnnaanngaaacttcacagngcnncttcagccgggcatctgaagaagctgaaggaataccttcagatcaagaaatatgatgtaaatatgcaaggacaaaaaaataccagaaaacgttttgcacctagacttgtgctaatggaccatacagatgtagtacattaccctaatttgagcaacaatgcgaacatagatgtccggggatagtgaaaaagaaatccccattgattaaggcagtacagtggtcaaaatgaggatagtgctactattcttctaaacttgggtgcagacccagatctgagggatatccgtgataatacgtgttcttcactatgctgtcagtggtcaacgctcgacacgtcacgcggaaacaacctgctgcaatcacgaacgctgatcttcacaacgcgaacaaactacagcgatggcggtaatacgtcccaccataaacaaagcggccggacaactaacccactaactcccaacaacatgcgcacacgatgccatatcgggaaaaacagcggcccgcaccgtgaaatcgccacaagaaacacacaccaaagaaacacgcacgtacaaccggccggcaagagatgaaccacaca

SEQ ID NO: 593720 - DNA, 407 bp, Homo sapiens
acataaggccgggcacggtggttcacaccagtgatcccagagctttgggaggctgatgtgggaggatcgtctgcgctcaggagtacctgaccaggctgggcaacatggcggaactttgtctcttccaggaatacaaaaagttggctgggcgtggtggttcatgccggtggccccagctgctggggaggctgacgtgggaggatcccttgggcctgggaggcaaaggttgcagtgacctgagattgtgcctctgaactccaacctgggtgacatagtgtgatctcgtttcaaaaaaaacacacacaccatatttatatatggctgtctgcctgtcaggcatggggactcatacctgttaatcccgggagcgcttttgcgagcttagggggtagattcctctgattttt

SEQ ID NO: 593721 - DNA, 587 bp, Homo sapiens
ttgaggatacccgacctatgcctgcacaattgcctattaaatattctccatctactgtttttcatttctattatttaaactacctgataggtaaaaataggatactttactctaaaaacccaactagctctttccagccagcgccgagcaatgggcatctctcgggagaactgacacaagcaccgcaagaccgggggcaagagaaagccctaccacaagaagcggaagtatgagcaggggtgcccagctgccaacaccaacattggcccctgccacgtccacacagtccatgtttgaggaggtaacaagaaataccgtgccctaaggctgcatgtagggaatttctcctggggctcagcgttgtatttgcaaaacaaggatcatcgatgttgtctacaatgcgtttaataacgagctggtccataacaagaccctggtgaagaattgcttcatgctcattgacagcacaccatactcatcgacagcacaccgtatgggcagtggtacgagtcccactatgcgctacccctgggcaacaagaaaagagacaagctgactcctgaggaagaagagattttaaacaaaaa

SEQ ID NO: 593722 - DNA, 428 bp, Homo sapiens
gggggcacaggcactagcccattggtactctcaactgtgctctctaaattgatgatagacattctacctaccttgctgcacactttctcaaagcgaattgcatcttacagtataaactggacttaacaatcttaagaactatctcgagactccacgcaatctggccattgcaactgtacagccgcttatacccggctccactaccactgccttctatcggtaaccaacatgcttaactctcggagggtcacactgccagagatgggacttccatatagccctatacactatgtcctgtaaccgttaatcaaccagtaaggctgatccgacgccacaatctactataaatcctttatttcaaactagtaggccaacttctcaaggggactatagattaaagcgctgcaatcttcatgtcgcatctcgtt

SEQ ID NO: 593723 - DNA, 169 bp, Homo sapiens
gaaggttagtgcacatttggtacactgcagtttcagcagcatgttagagttcaaagcctgatcccagagaggtgagcagtgaatgggaataagaagagggagacagaacagaaacgaatattctttcaaggtgtgcaaaggaaggaggaataaaaaaagggcggcctct

SEQ ID NO: 593724 - DNA, 102 bp, Homo sapiens
gaaaggctgtactttaaaaaataataattcttacattcgttggaaggtttttttagggtgtgtttttgagacagcctgggcgactgagcgagactccgtctc

SEQ ID NO: 593725 - DNA, 412 bp, Homo sapiens
gtgcaagggtatggaacaggagagaaagagtacgaagggccaaacaaaaaaacccggattttaagaattgtgactaatttaggctttcattccagtttggtttggtttcttttggtttagaataccaaatccttttaaattccttggcagtttcaggtaagaaagcctaatcctattcttactggactggttaggcaggcttctaattggaccctacatatttggtaaactgggtctggttctggggcagggtaaacattactggttactggcaggtggttctggaaaccagggagaacttcttctctacatttccctattctctacttctcgctctataattctgactatcactatatataatcttaccgctgggtactatagtggtctccgctctcaaggtctctacatg

SEQ ID NO: 593726 - DNA, 730 bp, Homo sapiens
ggtggtgccgtccaggttgcgggggtgtcaagaatggatgtggccgcgtgtggcgcccccttttccccttttcttggccgacttttgggggcggtgtccgccccccccccctgtgcgccggggggcacacccaagccgttgtgccccccacccagaaacgtgtgtttgtgtcggcaaaacccggtgagggacccccgacacgggggccgtggctacagcggacgccccccgggttgtttgcgcctcccccgcgttctctgatcccagagcaggttgtgctgcaggcgctcccccccttctccgctggtgtgtttgaatcacaggggggggaccccctcccccccccttctctcctgtctcctcccacccttttcttcgcgccagcgggccctctttgggccatctacctggtgcccaccgccgtcgtgtgtgttgtgctccgccactcaggtcgtggtcttggtgagccgctagtgttgcacacgaggaagaccaccattctcctgctggtttgtggtatgaaaacagccaccgctgcttgtcagacgacgctggtggttttgtttctatgatgcggggacacacgaatttttgtttacaccctttgaaaattttcccccaacccccgggcttttggtgttttttttttcccccggggcccgggggggttgcccccttccccttcccccccccctttttggaaagggattattttggtttttgttccaga

SEQ ID NO: 593727 - DNA, 1138 bp, Homo sapiens
agcggacggggtcacagggtacggtaatatagcaaactggacttacgtcgaccatgctgtaccgggtgggacttgccgacgccgcacggaggccccctctctaaagaatgcagtctctccgtagggtccagggggtagtagcgcagggcaagtgatggatctctatcctacagggtcaggcgagagcgtgggtatcctgtaacacaggccgtcggttcactgagatagcgggcgggaaagagttcgcgatggatcttgataccgtgaggaatgcttccagattcttcatgcctacgaactggtgtagcacggaatccgctattgttggcttcgggacgacatgggctggagtcttggttaccgtctcccactccggaggaccagtgactatgtgcatgagacgtccagaggatcgctcttctgcgtgggcgcataatccagggtagcatgacgggtgatcaaatggggtacgtaatgggagaattattggccaactggtgggtcccagtttggtctatgcaaggagctattggtcgtgtgatgtgagacatccaaggtgagggcagtagacaacgtatagctctcgacacgctaaggacaatgcagggcggaaaggcagagagcgttgtgcccacttcgaagggaaagcgagttcccaagagagttgcaaagtcttggagtagccgtgacgaaaacgtcaagttgcccgttgggccgacctctaggtttacacggaaatggcggccattgtcgacgcactgttttggggcactggttgcgtcggacaagggacagttaaaaacccctcacgagcgccattcgggtcctatttcgtggcacaggtgattaggtgcaaaaccgggggaaaacagagacgggtgaataagccacgtgatactacagtgcggaccccgtccacaggacactccagccgtggggccctgaatccagtaatgaaactcggtgaccggaccaccagtgcacttgtggtcccgcatacagtgcaaccaaggaaaacgggggtttgacacagaatttggtgggctggggggatagcggcgcatttgtggtagcagaaaggcttgcttgcccaacgaatcgcgagggaaaatgggcaagatcgcacttgggccctgaa

SEQ ID NO: 593728 - DNA, 294 bp, Homo sapiens
  misc_feature (28)..(28): n is a, c, g, or t
  misc_feature (65)..(65): n is a, c, g, or t
gctggaaggaggttcctttttgttgggngagtccgcaagtaaatttcactgatgttgagaatcantgtgggtagattaaatacggacccagccccgtttccttttaatttggagctaaggccagctgcgtgtctagttttgagcgcagtaaaatagaagcagcaaaccactcttatttttcaccctttcccggtattttttgggatgatactgtgggagcagtgacaccaactcttcctggaaacgcctttcgctggaaaatgatgtatgtgaaaaaatttctaaaaaattaag

SEQ ID NO: 593729 - DNA, 695 bp, Homo sapiens
cacgaagtacctgcctgcggtagtaagcttgcaaaggatgctgtcctgtgctgcgttgctgcaggccagtggtcctgcgcccttcctcggcgggccggagctggtctccagaaatgcttctgggttcatctttcattgcttgcacgggagacttccatgcctctaacactcatcttcgaagagatgactggtgacttgctgagatgtccgtctattcttgaagagcggtattcttggagctgatacctctgttgatcttgaagaaagttgggcgtgtctataagttatttggtgatggtatttgccctgcgatacatggtgctgaggaatgttcaatgcagaagaaatggtagagttttcttcagtgcttaaagggtatgtccttgaacttggaacctgacaatgttggtgtagtcgtgtatggaaatgataaactaattaagtgaaggagatatagtgaagaggacaggagccattgttggacgttccagtttggtgaggagctgtagggtcgtgtaggttgatgcccttggtaatgctatttgatggaaagggtccaattggttccaaagacgcgtaggcgagttggtctgaaagcgcccggtatcattcctcggaattacaggttgcgggaacaactgcagactggcattaaggctgtggatagcttgggtgcacattgtgcgtgggcagcg

SEQ ID NO: 593730 - DNA, 137 bp, Homo sapiens
cactccacctatcctaaggctccagatttaccctaaactgtacccttcgatatatggagagagaatcagcgaggactcgataacgtacgaatcgagaacgcacgacttgagccattctccagcacctcgatattaat

SEQ ID NO: 593731 - DNA, 194 bp, Homo sapiens
ggtcgacataggagatggaggagatcctgggttcaacgataacactcctctcaggttggggcacgcaaagaaagctcgtctatgtactgcaacaaggcacagtcgttacttggcacggtataggccatgaggtctgaggccaatgtttctctaaagattgtgggagagaacggggcatgctggtttgcgcctct

SEQ ID NO: 593732 - DNA, 356 bp, Homo sapiens
taccctgatttctccgttataaactacactaaaagtccaagtaaccaatgatatatcttaaccagtcatttgctttatcccataaaatcaacacaaaagccttagaataacaataacaacataacaagcataatacgattactctaacagttgaggattcatcacttttggcgacgcttaatcctttcaggttataatctcattagggcccatattatcgcaaaatcttcacatttgcaacatcagtgcctcatctgtaatggttcatgtacagcccaatttgagcagcagagcaacaacagcagcagcagaaaaacacatgcaattagcacatccacctgtcatcgtatcacatc

SEQ ID NO: 593733 - DNA, 647 bp, Homo sapiens
ccggttgttatttcagtaccgggctggcgctttcgttgttcattactgtgcctggctccaattacagcgctgtgctggcttctacaccacgatttgctgagtgggtgctgcccctgttgattgagaaagtggattctagagttctgagtgccaagattggatatctctacagcactctagaatagcttgctagtgctgtagtatggacagaaggaactgaaggacttcctaccccagcctttgggcttctatccgcagagaggtgttaccagacggcaagtgagcagggtggagagcagagggcctggcggccctaccacatccctagactaggcgtagtatatagtactacgactactagtcgctagaagggctagatagctagaggacctaccttagactaccttaccttaagcaacattactaacaggactgcaggcaccacctagtagtgaaccggacatgaaactaggtagtggcctagtgccaagctgttgcaggcagactgcaggtgcatctgcccgggcctgtgactctgtcaccagccaatgtactagcctttactgctggaacagatccacaagcacagacagagcagccagcggcggacactccttagaaatgctcctgggtttcttgaagctgca

SEQ ID NO: 593734 - DNA, 774 bp, Homo sapiens
  misc_feature (288)..(288): n is a, c, g, or t
agctacggctaggtacgaggccgcggtgtaggatcaagtaaggcagaacgcacctgactgcaccccgccaacctgccgctcgggcctccgtcgctgacgcgatcgctttctacgctcctatggatcgcacatcctcccagatgcatgcgcctgggacgaccccgccgctgctgcatgagccggtcttctgtggccgtagctgtgctccatggacccctcctgtgtgcccacccctctgtgtgctgtcagactgcctgtctctgtgcatgcctgcctgcatagccatcnagcctgtgctaccctgtgtgtgtatgtgctgtgatgtgtgtgtgatccctgctgtgtggtgctgccctgtgtgcctctgccctgccactgcatgcctgccacctgctgctgccgccctcggccacgggtcccgacgcgacagtgggctgggccagcgccgacccctgctgctagcccccctacggccacagcctcggtcaagatggagccagagaacaagttacctgcccgaactcatggccgagaaggactcgctcgacccgtccttcactcactgccatgcagctgcttgacggcagcacactctgcgacgattccagaaaggagactcaaaaaaggatgatgaggagaattacttggattatacctcataagaacatgaaactgaaagagctgagtgctgatacctgtcaagcagtatcccaagtcaattctgtggggcaagattcttggaccaccatggaataccatcaacgactgctgaag

SEQ ID NO: 593735 - DNA, 315 bp, Homo sapiens
  misc_feature (163)..(163): n is a, c, g, or t
cggtacagtgactgcccatgcaaggtctgtgatagactgatcgtgtgtgcagttgagagaagctcctgcctgcctacactggccttgggcttctgaatacttccccatcctggtcagtccacttgcccgtccacttccccatctcctcggtataaatcatgtntataagttatggaagaaccgggacattttacagaaaaaaaacaaaaagcaacaaaaaatataggtggggaaaaaaaaaagatacaccatgcttatctagggctttaagtacttcctgtcatagttgcatatatgccggatggaggggcacag

SEQ ID NO: 593736 - DNA, 877 bp, Homo sapiens
gggcggggattggtctgtggtcctctcttcggctcctcgcggatcgcggaggacgatggttcctgtggacacctgcttgcttggacccgtccggcggactcagggcttctctgctgcgctcccggttcgctggaccgggaagaagggctgggccagtcccgtacccgtccccatcggaaccccaagtcgcgccgtgacccgtcgcagggcgagcatgagcgcggacgcagcggacggggcgcccctgccccggctcctgctgccatggagaagggtccgcacggctacggctatccacctgcacggggagaagggcaagtgggccagtaacatccggctaggtggagcccggctcgccggccgagaaggcggggcttagcagcgcgggggaccggacaggtaggacggtgaacgggtgaacaacgtggcagaaggagacccaccagcgaggtggtgagcacgataccgcgccgcacacaaacgccgtgcgacctagcatggtaggtaacgaaccccgaggacggacgagccagactgcgagacaggctacggagccacacggtcccgagaggaagctgatgcgcgccccagggaaggcagcctgggggcaaggccgacgccacgaccgggccggccagcacgcaggatgacagggggggggcgtgggcacaacgaaaaaatgaacccatcaggaaggctggacaaggagctccacccggggagacaacacgacgatgactgtacgaccactcgcggctcctggtaaccagtgaaaaggaaagagggcacccagggggcaatagggcatccaaccctggcacagaggaggacgtcacacgcagggcagtccactcgggacagaggacccacgaccccc

SEQ ID NO: 593737 - DNA, 397 bp, Homo sapiens
ctgatccgcttagtaagcacagaaagaaaaaatcacttcatggaaattgcagtaagaaacccaaacttctaaataatcgcttgcagatgagctaaataataaacaaaaaaaaaaggcatcaaattacccttttctttagagttagaaagtagggaaaatgtgttatttttacgttattaccaaagaaaaacttaaggagacttatctggcatttccaatgaattcttccatgtgctattccttacccgtgacatatcttaccttaatggcaggcaatatacaaagatgggctcactaccccataggttattggaattcccgggttgagaaactacctggttaggtatcccaaaatttggctgaaatcttgtaaaaaatgacttcccctttaacggga

SEQ ID NO: 593738 - DNA, 567 bp, Homo sapiens
  misc_feature (367)..(367): n is a, c, g, or t
  misc_feature (488)..(488): n is a, c, g, or t
  misc_feature (498)..(498): n is a, c, g, or t
ttcaaaaaaaaaaaaagaaaaaagaaaaaaaccataagagcaacatttgcattatagaaattcttcaaaaataggaaaaaagaaaaaacccgcaaattacccaagcatagccacagttactttggcatccttctaatctattttcaggcctattttagaacattttttaaaaattgtagaactaatgctgttatagttgcaatgaggaaaacaaaagcactagaaaagtatataatcacctctaacccaaacgtccaaagatttagttttagttgttaatgttttagttttagttgttaatgtttcatagtaacatatatttttaaaaagttttaagtaatgatactacctcaagaatataagcganaagttatacatactcacagacgatacacgtcatctcatgatatccaagtgggggcataggcatcagagggaggaacgggaaccgagaacgttagggacccgaggcgcctgtgtgctgtctncactgcgggnctgatcagtctctagcagacagctgtttgtttccagaacatggagaggcgcccgtactccatcagggcc

SEQ ID NO: 593739 - DNA, 212 bp, Homo sapiens
ttgctatcttgcacaagcttggcagcctggtggacgaacaacgaacgggtgtttgaccacgagcagggcacctacgggggccacttctctgagaccagaatgacggctaccgcataaacgagggctacatgcgctgcggtggctaccgccagtcgcagtctcagacggcctactgagctctccactctgtctcccgccttggccattcgacg

SEQ ID NO: 593740 - DNA, 358 bp, Homo sapiens
atatctggaacacactactagtgcaccaatttatcaccctatagaagaactaatgtttagtataagtaatcgtgaacagattctcctccgcttaagcctgcgtcagattcatgacactgaactgacaattatcagcccaatatctacaatcaaccaacaagtcattattaccctcactgtcaacccaacacaggcatgctcataaggaaaggttaaaaaaagtaagaggaactcggcaaatcttaccccgcctgtttaccatatacatcacctctatgcatcaccagtattagaggcaccgcctgccctgtgacacatgtttaacggtcgcggtaccctgaccgtgcccggaatcgtg

SEQ ID NO: 593741 - DNA, 292 bp, Homo sapiens
tcctcctcctcacctgcacatttagtcagatctatgaatatgaccttatttggaaatagcagtattgttgatctatccagatgaacgtcatactggattagggtgggccctaaatccaactgctgctgtacttagaagaacagggcaatttggccgggcgcggtggctcacttttaaaatacaaatttattatatgtctaaggacattatccataaagtgaaaacacaacccacagaatgggaagaaaatatttggcataacatgtatctgaaaccgcggaggaggcattcg

SEQ ID NO: 593742 - DNA, 270 bp, Homo sapiens
gtacctttattgcacttttatgacattggaaactatttcacaaaactttgtaaagagtgaacccacaggtgtgcacaggcaggcctgtaagatgcacttggaccaaccggtcacaggcaagttccaggtgggtgctgtaagccaacgggcggacttgcaagacacctgtgcattgggtccttccttcttccgtgctcagacaagaaccttcagaccttcaagagcccagggcccacgaaggagaaagggtttttacttgaattaaggccc

SEQ ID NO: 593743 - DNA, 115 bp, Homo sapiens
cacacgctacaggtgacatccctaagcaggttaaagtgaaaaaactgaagaatctatagactctggatccaacacctggcagttatacttcatatcagccatatttaaatagaga

SEQ ID NO: 593744 - DNA, 324 bp, Homo sapiens
agtgcgggtgatctagaggatccgggatgaggaagtactggacaatggttgatagatgatgtgataggatgggatgtgatgtactaatgatggggcacatcttaagcatgatggatggttgatcatcagattggcaagtgatggtggaactgttcaagcctcaggatgatgaaattggagatggaaccacaggagtggttgtcctggctgggtgcttgttagaagaagcggagcaattgctagaccgaggcattacccaatcagaatagccgatggctatgagcaggctgctcgcgttgctattgaacacctggacaagatcag

SEQ ID NO: 593745 - DNA, 1108 bp, Homo sapiens
tgtggagccccgcgccaaaggcgtacttctggagaccctttgtccaccaggtcggggggcactcatgcgtgctccgcattcaagtgagacaaccctgtgcaagccccgtggtcccaagggaacatcagttctacgagaccctccctgcatgagatgcgcaagattcactcccacagtacaaaggggacatcagcagccaccagcatggtggggtctttgtagagggagtgggggagtcttttgtaaatcaagacaaagccaaaggccccttgattagctggccatcccatgccccattttttacccctggtcctttcccctgatggcacacaggagaagtgtggcctgaataccccaacccggcatccatctgcacccagagcatgggggccacactcagaagtgtcatctactcatctgagcacagcaattccccgtgcagacagtcgaggactgagcagatatgagatgatgctggggcagagaggcctgggaggaaaggtgtcagccagatcgtacgtaaggcgctcgatcggcacctgctgaaaccgcccccagctgacagccccatcctcaaagactgtcttaattactcatggacaggttctagagacttcaggggaaaagctgacttccacggccaccacatgtctgtgctccccaaccagctctatctgccttgtgttcattatggaacttttgtgacagtgagactgaaagaacaaataaaacgatattataagaacaaaaggctgggtgcctaccgtgtggggcaatggggaaacattagataaggtgtctgggcagggtggaagaaagttggaccacttataaggattagctaacaagctcattacactggatgatctaaccttcaggaactgtggtccactgtataggcctgatacagcagcataagtatggaacacgataggcataaaatccggaataacaggcaggtcagctcggatagcacgccatcccaccatcaagagacaaaacacaagcacaaaacgacaatagggacaagaagagcatgaccccagcagaggcgacaggacgacagcagaaacaagagcgacaaaccaaccaaagaagacacagacca

SEQ ID NO: 593746 - DNA, 528 bp, Homo sapiens
  misc_feature (11)..(11): n is a, c, g, or t
  misc_feature (17)..(17): n is a, c, g, or t
  misc_feature (53)..(53): n is a, c, g, or t
  misc_feature (76)..(76): n is a, c, g, or t
  misc_feature (98)..(98): n is a, c, g, or t
  misc_feature (118)..(118): n is a, c, g, or t
aatatatagcngctctncaggaaaaagcccgtcgcatcttttccttgggactntgaagctactgcatggaaaaagngcacctaccccctcccctgttngaatgctgtattaatgtagnataattattactggttttgtaaatttttcttataatgtcccctgtctttaaaacatgtttccttcctcctgtcaagtcttgtacttggttgtatggttagcctatttttaaatgttttgcccagtttctcttcaatatttgtgtatataaactgatcttggtaatactgtacatagctgtttaaaaataccagaatgacttctgactattccaagttttccacaaaatacattttacctgtgaatagccatttgactaacaatatttggctagtagatgctgccctccaaaaggagggaaatgtctcacttgttttcctattaactttggtctgaaacacatttgcacttgtctgtttgacttgtgtcttattaacattgtctggtgtattaaaagtcattccgtgctta

SEQ ID NO: 593747 - DNA, 136 bp, Homo sapiens
ctgccccgtgattatcagatgcttcatgcctatcagttacatacgtacttccgctcaaatcctgatctggtccattaaagagtgtcgcagacaaagtttctgaaagattagagaagaatccctccccagagattgc

SEQ ID NO: 593748 - DNA, 117 bp, Homo sapiens
atgagatacgactcgagctcggtaccggctctgcctgtgcagcaggcttctgttggaaacaggggagtgggggtgggtgttgttctttcctcaatggttaagcaccatcttcatgat

SEQ ID NO: 593749 - DNA, 152 bp, Homo sapiens
tgactgacgacaggccatgcctttcaagtgcatgcagctcactgatttcatcctcaagtttcctgcacagtagccacccagaagtatgtcctgacaagccctggcagaaaggcagaccatcaataacaaaatgtggcagccacactgatggg

SEQ ID NO: 593750 - DNA, 206 bp, Homo sapiens
cccagaggatttcaggtggatcctctcaaacatacaagaagcaagagagccttgtccgagcctatgacagagaacactgcctgaagacacacagcattaattgatcacaggtccttgactaccttccaaaacctgtgtgggaagcatcttacagaaatgatttcaagtaccctgtattttggatgctaaaaaacaaaatctggcta

SEQ ID NO: 593751 - DNA, 121 bp, Homo sapiens
gcagtcctaggaagaacacagcccccagtcccagagtcagcagacaagcgcacatagaggtcacgggacggggagggacggaggggaggggcgatctgcaggttgcgcaaaacagcatgaa

SEQ ID NO: 593752 - DNA, 431 bp, Homo sapiens
  misc_feature (68)..(68): n is a, c, g, or t
  misc_feature (73)..(73): n is a, c, g, or t
  misc_feature (136)..(136): n is a, c, g, or t
  misc_feature (141)..(141): n is a, c, g, or t
  misc_feature (327)..(327): n is a, c, g, or t
gtctgcctagagccgggagaccctggatggctacacccttacttctattgaccaaggagctgaagctntattngggaaacatgatcaagattgtgtattagaaaaacataaagatgatttcccttgggttagaaangaganaaaatatacagtgctatttttgtcgaattagcacggacgccaatctaaccacagcaaatatttaacagtagctttaatgaattaatgcacaatattttgaaaaatctttgaccttgctcataagcagatgcctgccttgaagaaacactccaagtctgccgtgattccgagcgaaatgccaaggcngagtcaagacaatcattacctttagggctgaaacctgggcatgaggctgccctttctgggatgcctcctaaccagtctgatgtactgtctgtaggaggagtgag

SEQ ID NO: 593753 - DNA, 177 bp, Homo sapiens
  misc_feature (9)..(9): n is a, c, g, or t
  misc_feature (52)..(52): n is a, c, g, or t
  misc_feature (55)..(55): n is a, c, g, or t
agtattttnggaagaatatatatgaagtagatactaaaacattaggcagggnttnagtgaatcaagagataattctgtggccgcgcgcagtggctcatggctgtaatcccaacactttgggaggccgaggcgggcggatcacctgaagtcaggagttcgagaccagcctcaacatgg

SEQ ID NO: 593754 - DNA, 427 bp, Homo sapiens
  misc_feature (59)..(59): n is a, c, g, or t
  misc_feature (124)..(124): n is a, c, g, or t
  misc_feature (336)..(336): n is a, c, g, or t
  misc_feature (373)..(373): n is a, c, g, or t
  misc_feature (377)..(378): n is a, c, g, or t
aaaagtggaagtgaccattgtgtcaagtttcaggatccctgatccttaaagaggctganagcttcctacttgctgtccccttggaactcttgctatcggggaagcccagacgcccatttaaaantctgccctatccctggcccaggtgtggtggctcacacctgtaatccccagcactttgggagacccaaggcgggcggatcacttaaagtcaggagtccaagaccagactcgccaacatggtgaaaccgtatctctaataaaaatacaaaaattagctgggcattgtgcgggcacctgtagtcctagctatcaagaggctgagacaggagaaanacttgaacctgggaggtggaggttgcattgagctgangaanngccactgcactccaggctgggtgacagagcgagactccaacacaaaaca

SEQ ID NO: 593755 - DNA, 277 bp, Homo sapiens
gtcagagcgaactatgtgagatatcatatttttggtgttctgtaatacctaaagcactgtcttactttcaatcagtatgttgatcaacttgactaacctttaagtgtttatgtttacttatttagctgtatgatctggacaagtgacctaacttccccatgtctcagttttcctccataaaatgtgaataataataggacctacaccacaggtttgctgtgaggattaaacgggtaaagtgcttagaatagggcttggcacatagttcagcgtctga

SEQ ID NO: 593756 - DNA, 235 bp, Homo sapiens
  misc_feature (225)..(225): n is a, c, g, or t
ctcggagactgtaagactaacagcaaggattctggccaaacagaaaatccacccagagagaacaccttcggaaaaattgttagctgtgaaggagtttgaatcacatctggataagttagacaatgagaagaaggatttgattcagagtgacatagctgctctccatcacttttactccaagcatctcggattccctgacaatgatagcctcgtagtactctttgnacagggttaa

SEQ ID NO: 593757 - DNA, 417 bp, Homo sapiens
  misc_feature (59)..(59): n is a, c, g, or t
  misc_feature (105)..(105): n is a, c, g, or t
  misc_feature (185)..(186): n is a, c, g, or t
  misc_feature (199)..(199): n is a, c, g, or t
  misc_feature (204)..(204): n is a, c, g, or t
  misc_feature (336)..(336): n is a, c, g, or t
  misc_feature (350)..(350): n is a, c, g, or t
  misc_feature (373)..(373): n is a, c, g, or t
  misc_feature (382)..(382): n is a, c, g, or t
  misc_feature (405)..(405): n is a, c, g, or t
tggcttccaagaacagcctcggttcagaccactccagtgttgtcacgccaaaaaagttnagtggaaaatcaaaatccggccgatccctgaatgaagagctggggnatgaggacagcgagaacaagcggaaagccgcgtttttctcgtggtcgcggaccaggagcaccgggaggtcccagaaaaanngggagcacggggnccacngcagacgatcgccctgcatgcccaatggaggccctgtgtcgtccgagagtcgcagggctctgtgtgcctctgccgggagcctggtccctgtcggaggcctgcaggactttggtcacccgagaaggacaaggnccaccaagcactgnctgcattcatctcccggatgggnacatcctgncgtggtggtctgtcaaggcgggncttctccatcaa

SEQ ID NO: 593758 - DNA, 105 bp, Homo sapiens
  misc_feature (73)..(73): n is a, c, g, or t
cggcacgagtgaagaagagagaaaagagtgtgatgcttacagagatgtgagagacctccaagtgatgctcatnctattgagataatcacgaagtgataatattta

SEQ ID NO: 593759 - DNA, 896 bp, Homo sapiens
  misc_feature (30)..(31): n is a, c, g, or t
  misc_feature (33)..(33): n is a, c, g, or t
  misc_feature (664)..(664): n is a, c, g, or t
cttgagcccttcggattgacgccatcgtanngnccagcgctcctttgcgccgatactccgctaattcgctcattatggccgggggggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgcctgtctccatgttngatgtatctgagcaggttgctccacaggtagctctaggagggcttgcaacttagaggtggggagcatagaattctctatccaacatcaacatcttggtcagatttgactcttcaatctcttggcactcaagcttgttaggatagtaaaccgcgcatagttactcccattaacttctctgcttagaatagggggaaattacaaattattggccggttattgaaatttgtttta

SEQ ID NO: 593760 - DNA, 135 bp, Homo sapiens
ggtgtaactggtcacctgggaccctgagcccagagaagatgtgagctgaactcctgccgcgataatgccctgccaccaagtgatcaccagacgctgcggaagctccgctagcctcatgatggtgtcggaagtgtg

SEQ ID NO: 593761 - DNA, 841 bp, Homo sapiens
  misc_feature (30)..(31): n is a, c, g, or t
  misc_feature (33)..(33): n is a, c, g, or t
  misc_feature (609)..(609): n is a, c, g, or t
cttgagcccttcggattgacgccatcgtanngnccagcgctcctttgcgccgatactccgctaattcgctcattatggccgggggggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgcctgtctccatgttngatgtatctgagcaggttgctccacaggtagctctaggagggcttgcaacttagaggtggggagcatagaattctctatccaacatcaacatcttggtcagatttgactcttcaatctcttggcactcaagcttgttaggatagtaaaccgcgcatagttactcccattaacttctctgcttagaatagggggaaattacaaattattggccggttattgaaatttgtttta

SEQ ID NO: 593762 - DNA, 891 bp, Homo sapiens
  misc_feature (30)..(31): n is a, c, g, or t
  misc_feature (33)..(33): n is a, c, g, or t
  misc_feature (419)..(419): n is a, c, g, or t
  misc_feature (434)..(434): n is a, c, g, or t
  misc_feature (439)..(439): n is a, c, g, or t
  misc_feature (659)..(659): n is a, c, g, or t
cttgagcccttcggattgacgccatcgtanngnccagcgctcctttgcgccgatactccgctaattcgctcattatggccgggggggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaagatgagatgcctgccgngtgaaccatggactntgtcncagccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgcctgtctccatgttngatgtatctgagcaggttgctccacaggtagctctaggagggcttgcaacttagaggtggggagcatagaattctctatccaacatcaacatcttggtcagatttgactcttcaatctcttggcactcaagcttgttaggatagtaaaccgcgcatagttactcccattaacttctctgcttagaatagggggaaattacaaattattggccggttattgaaatttgtttta

SEQ ID NO: 593763 - DNA, 241 bp, Homo sapiens
gcgggctgagagcgtcgagctgtcaccatggggtgatcacgcttggagcttctaaaggacttcctggccggggcgtcgcgctgccgtctccaagacgcgtcgccccatcgagaggtcatctgctgctgcaggtccacatgccaccaacagtcatctgagagcagtcaagggtcattgatgtgtgtggaatcctagcgcaggctctctctctgtaggtactgccacgtgtcgttctcccacc

SEQ ID NO: 593764 - DNA, 965 bp, Homo sapiens
  misc_feature (502)..(502): n is a, c, g, or t
agcgggggccgggggcggagcgcggggcgccgggtgctctggcggctcccgcggctccggctggcggttcgggccctggcacctgtgactctcggccgcgctcgccctcggcccgcgccggcgccagctagctcccgatggccccgtccgggctgcaagctcggtctccggcgctcgctctactccgatcactcagcatccgatgagtgcggcgttcgtcgcactcttccgtcgctgtggtacggtgggtctaccgacagccggggaccgcggccagtgggagggctcacagggagtgcatgggcactgtgagtgtcctggtagacgcgacggtagacagaaacagagctgtactactacggtattaaccagagcacaagagatggcgaatttcagacaacatcgagacaaggacgaccacaacaacatacgcgagacaactcaagcggtctgatccaacaaagaccaatgcgcagctaaccaaaagctgactgcgcgcatntgaacgagcagttcacgaaaaaacccccagcgagcgaggaagccgcctacactcaatccaacagtgaactatacacactaacccaatcaaatgagacgaccaacccatgtgctacaaatctctactgagagcactctatctcacaaacgcatatatcaatacttataaaaactgattgcaaaactgtgcataccgagcattcaaagttacaataatcccaatattaataaaagagggctacgaggtgtctccgaaacgtgaagactctagaaaaatcctaaacaccacagtgctcacataatacatttaaaatattaagtacaagttacctcatgcaccctgaaaggataacccccaggagggcaaatttccagaggatttgacagcggaaagaaccgaaaaagaaaggcgacccaggggagatcaagtggccagcgctcaagcccaaggcaaaataattgca

SEQ ID NO: 593765 - DNA, 940 bp, Homo sapiens
  misc_feature (30)..(31): n is a, c, g, or t
  misc_feature (33)..(33): n is a, c, g, or t
  misc_feature (708)..(708): n is a, c, g, or t
cttgagcccttcggattgacgccatcgtanngnccagcgctcctttgcgccgatactccgctaattcgctcattatggccgggggggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgagtgtagtacaagagatagaaagacaagtctgaatgctccactgaaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgcctgtctccatgttngatgtatctgagcaggttgctccacaggtagctctaggagggcttgcaacttagaggtggggagcatagaattctctatccaacatcaacatcttggtcagatttgactcttcaatctcttggcactcaagcttgttaggatagtaaaccgcgcatagttactcccattaacttctctgcttagaatagggggaaattacaaattattggccggttattgaaatttgtttta

SEQ ID NO: 593766 - DNA, 369 bp, Homo sapiens
  misc_feature (38)..(38): n is a, c, g, or t
  misc_feature (87)..(87): n is a, c, g, or t
  misc_feature (102)..(102): n is a, c, g, or t
  misc_feature (105)..(105): n is a, c, g, or t
  misc_feature (172)..(172): n is a, c, g, or t
  misc_feature (206)..(206): n is a, c, g, or t
  misc_feature (233)..(233): n is a, c, g, or t
  misc_feature (237)..(237): n is a, c, g, or t
  misc_feature (273)..(273): n is a, c, g, or t
  misc_feature (345)..(345): n is a, c, g, or t
  misc_feature (358)..(358): n is a, c, g, or t
ccaggacagtttcaccgaaaccccggcgccccggcgantccttgagcggagagggcggggcgggacagggaaggccgcgctgtcggnaggggcggggacctnccnctttggcccaggtcttggacacctgggcgcccctggccctcggcagaacacggcgccggacagaagngatccagcggttagtgggcgcggccggcgcacgnaaggctggagccgcctgcatttccagnaatnacggcgccctttccccttcgcccgcagcggcctttncaggcacttcgagccctaatggtggtctccctgggtgctgggcttcctgggccatgttttttggccacgatnggcattgaagttncacgtcgcttt

SEQ ID NO: 593767 - DNA, 896 bp, Homo sapiens
  misc_feature (30)..(31): n is a, c, g, or t
  misc_feature (33)..(33): n is a, c, g, or t
cttgagcccttcggattgacgccatcgtanngnccagcgctcctttgcgccgatactccgctaattcgctcattatggccgggggggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgatagacagatgacgtattgccttgcccgtgttgcaaccaatgtgaacttttgttcacaaggcccaaagcatagtcaacgtggggatcgaagaacatagtaacgcatgcatcctgggcagggttttgaggacatgaccgcaattatggactatgggcatgactatccagaagtcctcgccttgcttctgccatttttaactactcgactattgccttataacacatatacgactttactgcaccaaacatgtacggctttgtacatacatgttacaccatggaacactgaatctatcttctataatttctacgtttgcagtgcatgtctccaatgtagagactgtatctcgagccaggttgctcccacagggtagctctcaggaggggctggacactttacaagttggggcagcagagacatctcctattccaccatcacctcttggtcccacttcaccccacatctcttgcctccaagctgttcacacaacaaggtgc

SEQ ID NO: 593768 - DNA, 511 bp, Homo sapiens
cctacatcctataaaacgggcccaccccatctcctttcgctgactcttttcgggactcagccgggccggcacccaggtgaaataaacagctttatggctcacacaaggccggtggggtggtctcttcacatggacgcgagtgaaatttagtgccgtgactccgatcgggggacctccctggggggatcaatccccggtcctccggctcttggctcggggagaaagatccacctaggccctcgggtcctcagaccaaccagaccaagaaacatctcaccaatttcaaatccgaaaagcggcctctttttactctcttctccaacctccctcattatccctcaacctctttctcgttccagtcgtgggtgtcacacttcaatctctcccttctcttaatctcaattcctttcatttcctggtagagacaagggagacacgttttatccgtgaacccaaaattccggcgccggtcatggactagggagggcagcttcccttggtgctaatcact

SEQ ID NO: 593769 - DNA, 641 bp, Homo sapiens
gaaccgggcattacctccagttactatacatcatgaagtctgaattagcgtcaaccgagttgcagtactggctgttgggtatggagaaaaaaatgggatcccttactggatctgtgaaaaatcttgggtgtccccagtggggaatgaacgggtacttcctcatcgagcgcggaagaacatgtgtggcctggtgctggcctctaccccatccctctggtgtgagccgtggacaacccgcagctgcagactggcggagaaaggcgaggaacgggcagctgggcctgggtggaaactcctgccctggaggaagtagtgggagagatccacaagggaccaccaaatactgccatcaaactctgtgcccagcctggaaacctacagacaatggaggagttccacatgagctcacccgtgtatatgaccgcaaagatcaccagctcatgtgactagagtgtcctatcttaacagagttcaaaaccaacagtggaccgacgaataatcttcctgtccagaagggctactataccacaatattaggagctcacagggaactgtacgcgatcttgtattcagcatgcttccaactaaaattgacgtgagcacctacacccagattgtagaaaaacaataaaacaaacatg

SEQ ID NO: 593770 - DNA, 680 bp, Homo sapiens
  misc_feature (30)..(31): n is a, c, g, or t
  misc_feature (33)..(33): n is a, c, g, or t
cttgagcccttcggattgacgccatcgtanngnccagcgctcctttgcgccgatactccgctaattcgctcattatggccgggggggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaaagatgagtatgcctgccgtgtgaaccatgtgactttgtcacagcccaagatagtttagcttggctcgcagacatttaaccagcttacaggcgggcccgaagacactgctttcggtttcggaggccacccactctcccgcatcattgcctggaactaactgtttcgtcagtcactcacacttcgtcggcgccatacagtctcccctccgccgtcttttacccttgcgtgacgcccttcgattcgtatcatatatgttgcttccaaagtgattggttat

SEQ ID NO: 593771 - DNA, 680 bp, Homo sapiens
  misc_feature (30)..(31): n is a, c, g, or t
  misc_feature (33)..(33): n is a, c, g, or t
cttgagcccttcggattgacgccatcgtanngnccagcgctcctttgcgccgatactccgctaattcgctcattatggccgggggggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgacacagacaaccttcactgctcttgggaactggtatttttgtttgagactggtttggtcccttctgcttggggtagttcccgcgggcccgctgggtggccccgcccgtgcggtgtgtttgcggccgcgggcgagtggccttgtgtgcgccgcctgcggtaggaccgaggtgcgctcgcgttgccctggcctcctataccgggcgcggtcgccggcccacggtttctgttgtctcgcgtgttttggtttgtctcggactgtgtttgtacgccattgctgccct

SEQ ID NO: 593772 - DNA, 1283 bp, Homo sapiens
  misc_feature (1283)..(1283): n is a, c, g, or t
atgcgggccttgcttgtaatgaccgcgcgaggattaaagaatcatgcagaattgccggtctccgtgcctgcgtattcacttcgctcgtgtctcgcgagcagtccgcggagacctgcggtagcgtagccgaagaacggttcttgcgaatacccgtgagacatcacccgttcggctgccgccatatgacatccttcaatcttgcatctctctagtgacattgaacacgttatcactaggcacctagtgctacactgagcggagcactccgatttcgcactgacaatgtggaggacagtgagtcgacctttagagtgccgtggaatccgcgatgatcgggagaacggacaatatatagtgaagggcgccaatggataggaaatccctactatgagacccaatgtctggcgagaaagcatgtcacgtcgcttaagcatcatcgcactttcgctcgcggaacgcgctcatttcgtagtcgttcgggagcctaaaaaacaaaatttctcacggcgctacgcataagtgtgccccttccgcacgagggaagttgacaggggtcgtagttccgagacagtgtgcaggtacaaagactgcatcggttcccttaccggaaggggagggacagattagtgacctttttgtcatcagaatccgtaggaaagtttgtacacagcaagctcgcaccgtgcacggccaattggtacctcgctggtaacgtagaggggacccgtttgcttaacgaaagcgaatacccacctggggggggtccgtggaacagcgaagccataggaggccccacaatgccattgggaataaccgcgaggtacgcaaaatgtatgggccacgcgggtttgcctatgcggctcgccatgctaccagcgtaacggccgtaatggggggtcccctggttgtcttcaaattttaatccggcaatacccgcaaacgaccgttatgggaaattgacaaatctctttttgcaaatttcgagttttgttaccagttaggcacgttcgatttccactcagggcggcagccacaagataatgtaggcccttgggtgttttgggccgaattccgtttgttggcacaaaccggaaaagagttaacgacggaggaaggctggtgtggtctccaccccggtaaaggcaccgcagttgtggacaaccaaaggctttgaaattccaagatacggccggtatggcggctggccaagcgcttattccgaaccaaaggacaacattattccagagaatggttgacccacccagaatccaccccgttcgggn

SEQ ID NO: 593773 - DNA, 107 bp, Homo sapiens
attgtgtctgatgcagctccagtgtctcgatgcgggtggcgtggctcagacggacaagcggttcgaactggacgcgcgtcgacctgcgcgtttgtcgaatctctgaa

SEQ ID NO: 593774 - DNA, 607 bp, Homo sapiens
  misc_feature (30)..(31): n is a, c, g, or t
  misc_feature (33)..(33): n is a, c, g, or t
cttgagcccttcggattgacgccatcgtanngnccagcgctcctttgcgccgatactccgctaattcgctcattatggccgggggggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgacacccaccgacatgcccgccgcgtgcaccatggcgcctcccacccacccccacctcgcctcgcgtcctccccccgccccccccccccctccagcccccgcggccccccccctcaccccaacctccggcgccccccccccgctcccctcccgccaccccctccccccccctccgacctccctcccggccagcccaacctcccgcccctc

SEQ ID NO: 593775 - DNA, 211 bp, Homo sapiens
ctggtctggatgtcttaataagccaggagtcagagagacacgaagaagtggtggtagtcttccatgtactcctccctccctcccctctcttccttctaatgactcatggattcaattaacaagatattaattaaggctttattagcaagtctggacaccatcataggtactaggaactatcgtggccagcgggtgcccttgggccagcgag

SEQ ID NO: 593776 - DNA, 306 bp, Homo sapiens
aacacgacataccaacaatgcaagcaaatcactttgtgaatagagaactcagacttaaacttcagacgagactcaaagtcatacttccattaagggacttgatacacaaaattagtttgaactgctattagcaggtggcaggagccaccttcaaatagaatcttcaaattggaaaatactgcttcaccacctgtatggggataagtagcaaatggaataattgagtataggttagtagctatatagatgaccacctcgcctggataccttcccataaaccactctagctggacaccaactcttaca

SEQ ID NO: 593777 - DNA, 798 bp, Homo sapiens
cccagttgtcagggggtgacccgggatttgcccccccctccgttcctcccaggctcctgccccccactggtttacccacccttgccaaggtcaccagcacgcttggtatcctggaaggactcaggaccacagtccatgccatcactccacccacaagactgtggatggcccccccgggaagctgtggcgtgatgccccgggctctccagacatcatccctgcctctactggcgctccacaggctgttgggcccaggtcatccctgactgacgggaagctcactggcatgaccttccgtgtcccccctgcccacgtgtcagtggtggacctgacctgccgtttagaaacctgcccgatatgatgacctccagaaggtggtgaaccggcgtcggagggccccctccagggcatcctgggctaccctgagcccccggtggtctcctctgacttcacagcgacaccccctcctccccctttgacgctggggctggccttgccctcacgacccctttgtcaagctcatttcctggtatgaccacgaatttggctaccgccaccgggtggtggacctcactggcccccctggcctcccaggagtaagacccctggaccccccgcccccgcccagagccccagaggaagagagagaccctcactgctggggagtccctgccacactcagtccccccccacactgaatttcccctcctcaccgttgccaagtagaccccttgaagaggggaggggcctagggagccgcaccttgtcatgtaccatccattaagtacctgtgctcca

SEQ ID NO: 593778 - DNA, 943 bp, Homo sapiens
cccgcgtgtgtgagcggggaaaacccagtagtgtgctgccaccacaccacgcgggggtggcttcaccaaaaggggacccggctgtaaatgcgcccaaagctgcgtgtgttttagaccgcccgaagttgctactgtccccatgtgcaggcaggccgccaacggtggggggcaccgccaccacacggtggggaaatggcccccagatgggtgttgtcgcagatgagtttgcacggatgtcccccctcggcgcgcccgaccgctccgtggtggggcaagacacagagaagcaccaacggggtcaagatagtcgtgcgcaccgccggcgagcaagtccacactcgttggtttcttttgataaacagcacgacacaaccgccgcgagggtagaaggtgtggtcgggtggaaacacacaccacacaggttagaaccagcgcaagtgcggtgcaaactaactgggaatctggcggtgcgaaaaaaacccccgccccgttgtccccccaagtggcgggacacgggctcgccatcgcagccgttcttaatatgtcccgatagaatttcccccgcgacacggttcttggggggcacccacgcgcttgctgtcacacccaggaagcgaagaacccgcccaccactcatccaataccctggacaaccctgggtccacatgtgagggaaattttaaaacgggttgttctcacttaatccagtgtgccaaaaacccacggcccactttgttatacaacaacgcttctttgttagacgagtgactgcgtaacacatgtacggggccaacgaaccgcccttcaaagatggggtagaaactagtcccttgtaaccccgccaaaggaaatcctccagaaataggaggtgttccccctcaaacaagtaccaagggttctctgttggcgccaaaaaaaccttctttgttctaaaaggaaaaca

SEQ ID NO: 593779 - DNA, 120 bp, Homo sapiens
gaattagaatctagaagggacacttgtaaaaacaggatgctttcaggctgcaatactctgatgacaatacccaaaatactatctccacaggcatgctgatggattctgcaaacagggaga

SEQ ID NO: 593780 - DNA, 1285 bp, Homo sapiens
cgcgagtgtggtggaggccgggtgtatggtgggggcccctgtaggtagttcgtggggtcgtggaaggagggtttcctcccgggcaataggtgggggaaaaggctcccttgggggggaatgttcgtcactacagggggtgggacccgcggatgagtggagggttgctgtaaagaagtaggggttaggttatgatagggtaggggtccccaaagaagtgggggtgtgacccccgctgtggggagaagcttgcgaggagctttatgggggggtggttgaaaaagaagctcggtaaattgtgggaggggccgtttcggcacgccaggtgtcccgcgaagaatgtgttgtggccccgggaaccatataaaggggggaatatgtgggcagccagcgaaacgggggttttaaaagtttgagaggagaaagttgcgccgccaagtgtagtttagttattgttataggagatggaggggaggtttctacaaggtccccccgtgttctttgggtggggatttttagaaaagggggattaaaagagagagggagatgttaaaggaggggactcttaggagaagggaggcctcttgcgagaatagagaatgtctgtgggcgccactggctgtgtgggcgcctcggctgtgtggtgagccgcccacctgtgccacgcaccgctgttgcccaccaaggagaagataagggggagcgcccaacgatataatagttgtgtgatatgtgtgggggtagatatagtttgttcacacaggcgttatatacccacgtgagacactcgagcaccacatgtgagatatgtggcgttagaaatagatatccccacacacgacccaaaggtggaggtttgtgttggtgagatttaatggtttgtgggtgaggagcttaaagggtgcgctttgtggcgtgaggagaaggtttttcacgaggccctcttaaagtgagaaatattcttgaacacatgcactttgggaccacctgaaatgttgcacactcccacacaagtgtcaccactttaaatatattaagtgtctctaaagtgatggaggcaccacggtgttaagtgtgagaagtgttaggctttctttttcttctccacacacctatgaatttgaaacacacactgatggaatgtcacagaggaaaaaaaatttaccacttatttaaaattctgtgaatgttaaaaggacccacttaactattaccacaattgtgattaaccacaaaaatgctgtattttcccgtacccgtagtaatagtaataaaaattataactaga

SEQ ID NO: 593781 - DNA, 1048 bp, Homo sapiens
ggcttaattcataaacactatgaattacagacgaaaattaaccagacagagggaggccgggagagcagggtctggaagccagaggccagggagcccgaggtgcgcgggggagactgtgtgccgagcctgtcgtatgctcctactggcatcctaggtaccgcctgctggattgggggcacagggggcgagaggccaccaacagggtacatggactcacagggcacatcacgccccaagcatctaacgctacacatccatctccgacgggcacggtagaccggaccgagagaagacacgagacgcggcccactgaactagaaagaaagagcagaacacccgccagcccagcaggaagccgggcaccgagaacacccacgagggctcaggccgcaccgcaccccacgaggaccaatcagtgcgcccccgccgagacggcgcaccacgggcagcgagagtcaggacgaaacagaagccaagacacgagtccagggagacaaaaaagcaagaaacgaccagaacgagcaagatcacagcaaaagcgcgacagaacatcgcaacgcaccaacaaacaggacacacaaggaaggagaccaagacaggcacagaccacagacaacgtacaccatgagcgtaggccaccaactcgcagagggctagaaaaacaagagcgccagacgaagagcaagcaccaacagcggcaagaaggcacaccgaacgcagcgatcgcgccacaaaaagaaaacagaagacagaaagcaccacaactggaaacaagcaacaacataagaaaacacaacgccagcatgatatagaagtacacaaataacacaataacaacaacaacaaacgacgaacaacagccggacagaatgcaacacacagaaaccacacgcacagaaaacaagaccagagacagaaaaagcgaacctcgaacaaagagaacaacaaggacaacaaaccaaccagagacacacaaagagaacaaccacggaactacacgacaacaccacagaagcaaaagaaagaagcaagaagcagcaaacgagac

SEQ ID NO: 593782 - DNA, 681 bp, Homo sapiens
  misc_feature (529)..(529): n is a, c, g, or t
  misc_feature (598)..(598): n is a, c, g, or t
gccaaacatgttctgcaggtcaagcaggcataaagagggatgtaagttaatgtaatcattttatcctttctaatcttcaattgatgttagagtctttttagtgttcctaaatgtctgtacactagatcctggttggctgaattgccatctgcagtggtcctgctactggattcctctgacctttggtcattcttccctttaaaccttttacattttgacacttcattattttatgctgcttattcaaaatgtatactttcttttaacgttattctttctttagtctctttacttcacttggagtcagattctactagaatcttttttgaccccaaaagcatttggaaacacatgaagatatttggcggaaggggagttgtcatggtaactatggaactcccgattcctagactgcagtacagcgtcatgatctcggctcattgcaatctctgactcccgggtttgagcaattctcatgtctcagtctctagagtagctaggattacaaatgtatgccaccatgcctggntattttattattattattattattatctttcgatctatagtacaaatggtgtcttgccatgattgccangctgggcttaaactccttggactcatccatctgtcctgctttactctcttacatgcgtgagccacttaaccttgccctctacc

SEQ ID NO: 593783 - DNA, 295 bp, Homo sapiens
atattgccaagtcaggacatctgcacgtaattctattcctcatccttttttttggagacggagtctcactgtgtcacccaggctggagtgcagtggcgcgatctcggctcactgcaacctctgcctcccgggttcaagtgattctcctgtctcagcctcccgagtagctgggactacaggcgtgcaccaccacgcctggctaattttttgtatttctagtagagacggggtttcgccatgttggtcaggctggtctcgaactcctgacctcgtaatctgccctcctcgacctccc

SEQ ID NO: 593784 - DNA, 301 bp, Homo sapiens
atcgagctcggacatccttttattcaagcagtcgcagcgcaggccatacacaatgaaatggtaggtcaacaaatcttctggtcaagagaaaaaaaaaagaaatagcactctgcatgcttgagcctacaagatgaattaccctagaaaagaatccaatgaaggcgtgagcaaccgagcccagccacattaatcgatgtttaattgttaaacgaaggtcccctgagtcaaactcaactttggtagactattaaacttggtttactagttatctggtaaaggacgactgcttggattacaagga

SEQ ID NO: 593785 - DNA, 650 bp, Homo sapiens
  misc_feature (637)..(637): n is a, c, g, or t
tgcagtggctcacgcctgtaatcccagcactttgggaggccgaggcaggcggatcatgaggtcaggagatcgagaccatcctggctaacacggtgaaaacccgtctcgactaaaaatacaaaaaattagctgggcgtgatggcgggaacctgtagacccagctactcgggaggctgaggcaggagaatggcgtgaacccagcaggcggagcttgcagtgagccaagatcgcgccaccgcactccagcctgggcgacagtgtgagactctgtctcaaaaaaaaacactctgtcattcacactagactgcagtggcatgatcatagctcatggcagcctggaactttcaggctcaagtgatcctcctgactctagccttccgagcagctgtgactccaggcatgctccacaccggctaatttagtacttttgttttgtttgtttgtatgtatgttcgtttggttatgtagagacaagggtctatgttgagaaagactggtccttgaattccctgcccttaaacaatcctcccacctcagccttcccaaagtgctgggataaacaaggcgtgcgagggccggacttcagtcctaaaggttaaatttttatatttgggctacctatactggggatcaatgntacaagactatct

SEQ ID NO: 593786 - DNA, 170 bp, Homo sapiens
tactttacgggactttgataaagaatgcaaacagatgcttcttgctctgaaatccaaacatctttcccactgtaaactgtccttgcggttattggcagcaccggagcttgattaaaggggattgtgcacctgaccagagtggcaaggaccatcttgagtctgtacaacta

SEQ ID NO: 593787 - DNA, 138 bp, Homo sapiens
ataacagatacccacaaaaggagatatatgacatgcgtaaagatcattccagtaacgatatcaagaaactcagtgaggctaggcatgggggctcatgtctgtaatctgagcacttctgggatactgaggcacggaaca

SEQ ID NO: 593788 - DNA, 627 bp, Homo sapiens
  misc_feature (230)..(230): n is a, c, g, or t
  misc_feature (245)..(245): n is a, c, g, or t
cgtggtggctcacgcctgtaattccagcacttggggaggccgaggtgggcagatcacgaggtcaggaaatcaagaccatcctaccatcgtggttaacatggtgaaacaccatctctactaaaaatacaaaaaaattagccaggtgtggtggcgggtgcctgtagtcccagcaggagaatggcatgaacctgggaggtagagcctgcatgcagagagctgagatcacaccnatgcactccagcctnggtgacagggcaagactcgtgtctcaaaaaacaaaagaaaaaaaaaaccaataatgtgttatttagtgtgcaaatagttagaaggaggatatgtgaatggttccaacacaaagaaatgataaatgtttgagatgatggatatgctaattacccgtgatcagatcactacattatatgtatcaaaacgttactatgtaccacagaaattgttacttataattatttcagttaaaagaattaaattcaactttaaaaagaagtaatgtgggtaatacactttctgtggttccaagtactatatgtgtaattaaaactggaaagatcattataattccagtttatatcaactgaaggtaaatattaagaacataggcacatttgg

SEQ ID NO: 593789 - DNA, 1088 bp, Homo sapiens
  misc_feature (94)..(94): n is a, c, g, or t
  misc_feature (377)..(377): n is a, c, g, or t
gggtgggacgtggtctggggtatcgggaaagcaagcctacggttgctcactaattgacgtatagatcctgtgctgctttgtcaacgatgcctgnaggaacgtgcagcacactggatgaggaggaggtggagactattgcctttcaggcagaaatagcccaactcatgtccctcagtgatcgataccttgtattccaacagaggagattttccttcggagagtggagtctctaactggctgtcttgatggccttggacaagagttcgctaatgagagtcgctgaacagagcccgtatcgaagcttggagcagtggctaaagagctgaaagattgaccattcattcgcccgaacccgtcagaggaaacgttacccgtgnactttgggctaggactacagggcatgggccatgcaccaagaggctgagtctgcataaggtcaagtttagggaagccgatgtgccgaacgtctggatacctaaaggcagttcagtggaggcgtcttcacggcgtgggtgcaagacactctaccatgacttggggcagattcgcgtgtgggccttttagttctgtcctacttggtggcagagaaaggtgggtgtgatcgagcaagagcacagacgactgatgaagagtatggttgggagtcttactgctggaggttccttcgctgtgagtgctgagcatggggagcccattggcaggggtaccgaggtgatcgtccagtcttatagacggatcagacggagtacctcagaagagaggcgggtcaagaggtggtggaagaagcggtctcagtgccataggcatccaatcaggcttgatgggacgaaggaagaagcaggaacagcgatgatgaagcgaggacgagaacggggaaacagaggaagcaaaggacgcgaaaaggcccagagtcgaaaagttgcgctcagagagcggggcggaccagagaaggcacggcacaggacatgagcctcggacaagcagagcggaaaacaccacggacagccaggggacagacctggtaatcccgagcgtgggaattaggagccatacggcaacggacaggatacaacacgatgaggcagaac

SEQ ID NO: 593790 - DNA, 197 bp, Homo sapiens
gacagtctgaggttataataagttctagtccagagggatgggtaatttacagaggaggaaaaggtattatacagcctctggggaaggtgactgtggagatgctggaggagaaacctggaaggttcctggttgtttaccatggaccagagttttctgaaagatcttggaaactgttctgttctgaatactgggaaaca

SEQ ID NO: 593791 - DNA, 392 bp, Homo sapiens
cacgaagcgagcactcagcacgttaaagctgtggctcaacacagatatattgagctctgtgggcatttataatctgggccacaaagctctcaagcctcctccaataaagctctattgggaaacacaatggaccagtggaaaccacagacccggacctttaatacacagtacaagcgggttggttctggctatcgataccaagagggctcagatctatgggaggcggcagattatactcgggaaagagggaaccgaagagctcaaaccggttgatgatccaaggttgatgctcaagggtttcaaggcggtggtaccggtgaagcaccattacctgagggccttcctgttcgtgtacccacaagagtcgcttgtgaatgggagcgcaccctgtt

SEQ ID NO: 593792 - DNA, 131 bp, Homo sapiens
cacactgtccaacggtgcggaccagcacgaacctggggccgagctggtgaggctgtgtggtcaccagcagcaaagaggtgctgtatgcctggtagccccgtggtcaagggggactgtcgggctagtcgggg

SEQ ID NO: 593793 - DNA, 250 bp, Homo sapiens
ctttacttcctatcaagatttgggaacttccctgtaatctcagcactttgggaggttgaggtgggtggagtgcttgagcccaggagtttgagaccagcctaggcgacatggcaagaccccatctttacaaaaaattagccaggtgtaatgatggacatctgtggtaccagccactcgggaggctaagaagggaggttcacttgagctcaggagtcagaggctgcagtgagctatgatcacaccactgctc

SEQ ID NO: 593794 - DNA, 163 bp, Homo sapiens
gtgggggcggggttcccccttttggcccgggggggttcaaaacctttaccttggggggtctccccccctttggcccccccaaggggtggtttttcagggggggcgccccccgcggggccccgctttccccctttaaaatggttggggtttaggggtgggggga

SEQ ID NO: 593795 - DNA, 927 bp, Homo sapiens
  misc_feature (460)..(460): n is a, c, g, or t
ccataggcgtcgaatcctacaaagtctctgctgtctgtgaataaatccaccagtaacccaacgttctccggagggcgcggactcattcaactcgctccatcccggtgctgacagcagggcagagatgggctatacatgcccccagtacatctcctacaggtacctcagatccacatgggagcagctgtgctggcacctcagatgtatccatatgctgtatccaattcagtgcctgggcagcagggcaagtaccggggagcaaataggctcccttcctccgcatgacgctcggaccataagacccagcacaagcctctagccccgcccgatgatgcacggccgcgcgggtgctggctcgctctggtggatgccatcgtccctattcttcctacatccgcctacaagacctcatgctagatttcccacgtgcgctagcctatggccaatggattgcgatgcncccaatggggccacatgactcctccttcgagcagcctggtggtttgcccctctagtgcttcagagtcaaacccatcgtcaatgctgaactgtcggggccacgtcacatcgcccgaggccatctgtgtcaatcgctctaccccctcagtacccttctgctgagcagtctaacccctatgcctgtatatgctcactgttcaccagtacctacttctatacacatgtctacgacagctctcaattgcccagtcatgaccgtcagctgggataaccattgccctactggataaccacggcggtgtcactcaagcaatgcgtgccccagtctgtcaaggccgcatctgtgcggggaggccccacgtctgtggtcagcggaatgcacagcaaatcttgtcgccccggggcctggtaggccggtgctgttgggcgggctttctggcgttcctcaaggagttccccgccaacgtg

SEQ ID NO: 593796 - DNA, 182 bp, Homo sapiens
tctattgccgcgagggtaaaacgcagaaaaatcatttctagaacattctacattacttcagtcttagaaaaagtggacccttaagtgctatactagactatgactgggaggcaaaattttttaaaatttcctaaggcacttctccagaagaaaacaaaaattaaggtcaggtcttcctcttg

SEQ ID NO: 593797 - DNA, 127 bp, Homo sapiens
gcgcaattaaagctgctggcagccttgaactcctgggctcaagcaatcctcttacctcagcaactaggactacaggcacatgccaccacgcttggcttctaatttatttctgtgtcaacaaaataaa

SEQ ID NO: 593798 - DNA, 344 bp, Homo sapiens
acacttgaaggtcgtacttccttccgctacggcggactgattcaccgctagactgtgtggcgtggagccggcagccgacggctaaaggtgtcgtggttggtcattaaagcggagacccggtccagcggaagcctgtcacctcctatgtgcggaccaccatcaacaagaatgctcgcgccacgctcagacagcatcagacacatgatcctgcaagaacaacgtaccgtcccgaaccatcgcatgtggaggcattcgcagggccagcgccatcctgcgcagccagaatcctgtgatggtgaagaggaagcggacccgccccaccaagagctcctgagccccctgcc

SEQ ID NO: 593799 - DNA, 152 bp, Homo sapiens
accggcacgaacaatatgagcccggcgagggaagttcggctactcgtgcagcttcacctgcattcgcaagaagattccctaccgtcctgcgttcgacggcgagcgtccgacgatcgtcgggccgcagacggcgattgtcgtcggcccgaagg

SEQ ID NO: 593800 - DNA, 490 bp, Homo sapiens
ggggtggaggggctgtagatgaccctggacatttgtgcgtgactagtgggacagtcacgctcatacagctgttccagcgggccaggtcaggctggtcgctccagtgcatgggggctgcaagtgcagctgagcttggagaggtatgaccgggaccacctggtgcgcatgaaatggcccagttgtgccaccaagtggaatcgtggtcactggatcttggctctggtttgccctcaggggaagcatctccaaccgtacatctgagcgtggtggcctccagccagcatgctctgcccgcagggcctgcttgactcctcctggcacctattactgagggctgttcatctcccaatagaaaggatgccgcctcctgagcccagaagcacccccggggtccagctggatgcctggaacttgggggggcacagtcacttcaggctgactgggcagtgcccgggcctggagagggggtctgctctgagcccacagtgaa

SEQ ID NO: 593801 - DNA, 310 bp, Homo sapiens
actctcgacgagcccccaggtgtcttcatgacactgaacaaaagcttaacaatcgtaatggtatactgttggcgggttgggctgaccccggccggtatgcattcatggagtcctgcctttaaaatcaccataaccctaaacacgtcctcattgacatcatgaagtgtaagtggaatggtgattttaaggcaggccccattattgcagctgtgccggtctaggccaaaccgcccaaactgtatcctttacaatctttaagcagttcttactagagtctaaatagtaacgtgccggaatcttcaagagcaca

SEQ ID NO: 593802 - DNA, 293 bp, Homo sapiens
  misc_feature (4)..(4): n is a, c, g, or t
aggnctcaacggaactttttaatatccaaaaaaatctaagctcctcccaagctgactctgagtctaaaaatttgaacatgtaatcatcactttgttggtataataatgatctcatttacatataaaatagatttaacattctgaaataattttacatttaatttgtgtaaaccctgtaggtagtcttcttgaactgtaagtcccgtgaggccagggatctctagtgcagccctttacactgaaagtccagttagtaatatttctgctgtttctggtaagtcaatataaaccat

SEQ ID NO: 593803 - DNA, 422 bp, Homo sapiens
cgatatctctctcctgggcctgaagtttcagaatgctaaggcaagcaggttgaatccagtgtcaagaggattacagagttctcatacattgctggtgggactgtcaaatggtgccgctgtataggaaagcagtccagcagtttctcacaatgctagacatagaattacacagtccactctgagtcccattccacattcaaggattgaaagagcatagaaagcatatgtctcacacaaaaaacgtgtacatcaatgcccataggagcataattcatcatcagccaaaaagaggacacaacataaatgcccatcgatggaccactggctccacaaaatgtggtatatgcatctgctggaatcttcttcagcccaacattccagccgtccaggggtcccagaagactcgaattcagtaactcatg

SEQ ID NO: 593804 - DNA, 393 bp, Homo sapiens
cctcagaggcagagattgcagtgagctcagatggcgccactgcactccagtctgggtgacagagtaagatccgtcgcgaaaaacaaaaaacaaacaataacaactacaaaaagagttaagtctctacctcaaagtgaacatgggttgtatgttacatgcatgtttgttcaataagcatgagtcaggatgaccttcataattattcatagctcctcctgtaacctgttgaatatgtatgtttagccaacctattcagcatcaagttcctacccctgctcctcctttgaagtgcctgtctctggtctttgccagagattgtacttcctggcctgtgggatggccaccttgcaggcctttaaccctttataagaaataaagtctcctctccaaaaa

SEQ ID NO: 593805 - DNA, 215 bp, Homo sapiens
gagagtataggccagttggtgcttcggagccaacgaggccaagccagatggtgagggggcttgcagtctgcaaaacataccgggggtggtgtattggggctacaattcccttaaattccacccggtcattatctgtgcttggacaacccagtgaaaaatgactggtgtggtgacacttttctcctttgtcagatcctgctccacgtcctcggcct

SEQ ID NO: 593806 - DNA, 86 bp, Homo sapiens
acggccgtgtattactgtgcgagagatctatttggttcggggagttatggaggctactggggccagggaaccctggtcaccgtctc

SEQ ID NO: 593807 - DNA, 225 bp, Homo sapiens
tgctgaatttataggtgtgagccattgcacccagcccctcagactacttttttagagtcccttgattggcagtagcgtcagcattcttatggttagctatttcttctataatcctgttaatgttggatgggaatttcatttccaactttatactttttggtttctctgctacccttacttcattcttggccaattctctccttctgttactcatttttgtaacat

SEQ ID NO: 593808 - DNA, 100 bp, Homo sapiens
catgaagggcaaggggacgtgagataagggtctaaaggtcattgtctcccgcagtgaagtggacatgttgaaagttaggtgtgagttcaagagagagtac

SEQ ID NO: 593809 - DNA, 471 bp, Homo sapiens
ccccctcataaaccccgggggcggttcccccccgcggttttttcctgggggggggggggggatcaatttcccccggggacccgcttgcgcctttgggcctttttgtggtgcccttatacccaggttgtgcccaaaacgggggggggggccgggcggggattcccggggaattcctttttgggcccccccccccccaaaaggggtttgtttcctaaataggaaaaaggttttttgggggggggggggggtttttttctccctttaacaccccccccccaaaaaccgggctttggggggggggggttttttggttaggggggggggtccccctttttcaaattgcccgggggggggtgggtttaccccaagcccggtttttttgggtcccccttttgtttttttttcccccttttttttttttttttggccattttccccccggggggggggggggaatttccttttttttta

SEQ ID NO: 593810 - DNA, 141 bp, Homo sapiens
cattagcaacgcttcttaataatggcttatcatcctcagtgaaaaatgtaatggcttttcccttattcccggctcttccagttcgacctatccggtggatatattccacgtgagctagtgggaaagtcatagtggatcccc

SEQ ID NO: 593811 - DNA, 144 bp, Homo sapiens
tagtgttgtagctccaagtgtcccttggtaaatgtgattgctagcaaaggggggtccgtcagggtggtgggccaggaagtgtcgcagagatggtggtgagagtggtagccgatgcgggagtcagcagagtgggcaccgtagcac

SEQ ID NO: 593812 - DNA, 170 bp, Homo sapiens
gctctacgaggatcccttactacttttattattacctcttctaaacaaatttagagtcatttgtcaatgccaaaaataaatctgctggaatttctactgaaatttgtatatatacatatatatacaaaatttatatataaatatacatatagagatacaaaaaaagagtt

SEQ ID NO: 593813 - DNA, 376 bp, Homo sapiens
  misc_feature (154)..(154): n is a, c, g, or t
gagtttcagatgcctttgagaaatgaatgaagtagagagaaaataaaagaaaaaccagccaggcacagtggctcgcgcctgtggtcccagcgctttgggaggctaaggcgggcagatcacttgagaccggcttgggcagcaatggcgaacccantcctctacaaaaaacacaggaattagcctgggcattgtggcgcacacctgtattcccatcctagtcaggaagctgagatggaagaattaattgagcccacgagttcaaggctgcagtgaagtcgtgattgtgccactgcactccaagccgggggtgacagaaagaagaccttgtctcgaaaaggaatctgaaaacaatggaaccaatgccttcataattcta

SEQ ID NO: 593814 - DNA, 285 bp, Homo sapiens
  misc_feature (68)..(68): n is a, c, g, or t
cccccccccaaaggtgggttttcccccggcccggggggggttttaattgaaatttttattaaaaaaanttgtttttaagttaaaacccaaataaaaaggcccgggttttttccccccccccccgggaaccccctttgtttaaagaccccgggtccccgttgggggctttaacccggtttttttatcccccaaaaacccaaatttttaaaatcccccggttggggtttggtttgggatgggccttttttccccccccttaaaaaaagggggtttgggtttttttga

SEQ ID NO: 593815 - DNA, 205 bp, Homo sapiens
  misc_feature (99)..(99): n is a, c, g, or t
  misc_feature (102)..(102): n is a, c, g, or t
tcagctcggccacgcttaagtactggaataagaggcagcttctggtagggctggtaatgttgtttattgaaacggatgcttgtgacataggtgggcccngtntgtcaaaaattcacaaaggtgtaggcttcagtatgtccatttatttgaatgtgagttatacttaagaacaagttaaaaagcaagaagattacattggctgcgg

SEQ ID NO: 593816 - DNA, 1516 bp, Homo sapiens
  misc_feature (792)..(792): n is a, c, g, or t
cgtcactatattataacattcccgtgtgttaattggcggcccccacccattgtgtcgcatccctcctcctctatttcccgtgtggcgccaagggataggacgtcccccgtatgtctctttattggggaagacgtggtgctgggcccccaccacatgttgtggtttgtttgtcttcttctgttttgttcgccgcccctctgtagtgcggccatagtccctgtttgtgcgcgcctaaaaagttttgtgtggtccccgacgccacaccacgccccttgtttggtgttggggcaaaacaactgtatataggggcccacccacgtgtggttcttccttggtcagaagcatcccccacacgtcccccaagtgtaaggtaggagaaaatgtgtgggattacctttcctcttcggccaaccgagcgccctattcttaatgtgatgtatagagaacaccacccgctgttggggaagaaaccctctattaatagggcgtgcataaatgacgcacccacagctgggttttttttccctgccggggcgacaacaaacaccgccaggtgttgttttgttttacccgtcgggggttttgttcggcccacatccctcgctgtttcgtaaaaaattgtcctcttcttcaagaagtcctgcttataggtgtaggattgtgcccgccgcgtgttgttggagaaagattgtccgcccgcggtgtagtaggagtatggggccccccccccacctttccccgcgtttgttcgcctctctgttgtcttgttccccccaccgcggttgtgtggtnccccaccggcgagaaatttagaaatgtcttttgggtgttttgtcacacctcagcccacacttttgatagagagatgtttccgcgctccgcctcttgtgtcccccactgtcacgtcgtccacctttgaaaaaagtgccccccctgtataacacgcgcaaaagaaaatattgggtgccaccgtcgagaattggcgagaattttctttctctatagagagagagccccctcggagagagatttataagaacacaagaccctatcatttttgggaattaacactctaataaggagaagcgcctctgagacctctcccccgctaagaatgtgggaatttttgttctcgtttctttccctctttcttctcttctggaccccaatatgctttaaaattagccacgctaattatgttattgaggtcttgggttccacgcgtgttcttatttcttgttggggctgaatttcccacaaagccacccatgctgcctgaaatgttatcccgcggagtccctcactatcctcaccacaatgccacaaccaccttatactaccacggcctctttttctgtgtccacactggaaaagcttgaggctcacacactccaaagatcacagaggagcctatcaagaagagggctctttggtttgaggagcccatggcttacctttcctgcctttgagcccctcaccaccccctttcctcctctttccctctcccccctgccca

SEQ ID NO: 593817 - DNA, 847 bp, Homo sapiens
tgtacagagctatctcgccttttatgactgcggcgggatccgcgtcggcgttaccctgtcaagagactttgctagcccacagaaatgccgttctcagttcacggatctaaatggttctaaaagatttcggcatcaacactttggcacgatgcagagtgggatttatgctaattcagatgtaaaacagaaactctatcccttgactagtgggcctattgtgccaatttaaaaataatgtctggaatcagcatctctgactattgaaaaatggatgtagcagagtgatgattttctatcttaataaatgcataggaagtgttaaaaaaacgccaaacatcggactccatggcctcaacgtttgatctttacggctgttacctttccggaggcttaataccggatactgaatccctacgactcaaggtactggatcactaacttatagactcaagctccttctccttaatgggcgtatacccgtgacccgatcacacgacggattatcgcactccaaacttcctttcggagaggcggtaaggtagcttcgtaaccagtaacagcgggtctcccctgccgacggcgtgttgggttcacataccgcaatactgagttcgggtatatccgtcaacacgcaaggcgagataatcctctatcgccagtccattccacattctgattccaacacatagccaccattcaccggactgggtattgcctaccataaaattgacatacatccctccactctctcatgatctcgaggtcgatgagccgcaacactcattggtcccgccgtggctaagcgcgcagcacaggctccgaagcgagctggaaagaattgttggag

SEQ ID NO: 593818 - DNA, 380 bp, Homo sapiens
tgcagcagcacacagcacccagaccatatgacagctggatgagcatcctggtgcccaagagggtgcatgtgatcctgcccatagttcacagctgtagcacagacagatttgaaggagccgctgaatgttcttgggattactgacatgtgtgattcatcacaggcgaattttgcacaaattcacaaggtcagaaaacctccatgtttctcatatcttgcaaaaagcaaaacattgaagtcagtgaaaatggaaccaaagcttctgcagcaaacgacagcacatggtacaaaccaatcattaccaggtttctggctaccctggttcacattgaatcacagccatcgctggcagcatctatccaggtcagggatttctaaagg

SEQ ID NO: 593819 - DNA, 861 bp, Homo sapiens
ggacagactcagttcactgaatagggaaaaggagtgacaagacggaagtccggtcaaagccccaacagcttggtatttctccagtcccggcgcagaccccggagcctcctcgaggcactcccttccatgcattctggacatcatcggccagatataggttgtggatggattagacaggacagtctcatgtagggtgcacccctagtgcagtcaatctcatggtgactagttaccggtttggcctttttcttggcaggtagtgcctcatcgcacaaagaggctggtactcgtgttccggaggctcggtagagggttcctggtgtcctgtctaggattacttgcgcaactctacagaagggctcgaaagacagacagatgtccgggaacatagtgagtcgggccaaagcctaacattgcgatgcacgagccaggatgagaaaaacctggaaggtgagtggactcctatgaggtagcatgcactctgtccaaaattccttggacgaagcgtcccagttgccaggaatctcatctaccttcgaaacctggaggttgctctaagggtcatagactcctctctcacagtcaggctttgtgctcaattgtgcttgccctcctcagaggccaccttccttaccacctccgttcccatttctaatgcttgttctgctcgcctactgttgttggtggtgctgatggaatctgccagagttgagtactatgtatttatttatctatatggtctaatgcgcaggacattgtcaaataagccttcaagtcacaaagtaaatgggtccaagcaatggggtacgggcgcagggatgcccttttccaccccaatattaagtccgaaaataagggaag

SEQ ID NO: 593820 - DNA, 515 bp, Homo sapiens
ctcaacgcttatacttcattatgtacattcacaccatgtacaaccatcaccaccctccactgccagaactcttttcatcttgcaaaactgaaactctgtgcccattaaacactatctcttcattctcccctactcccacccctgatagccaccatactactttctgcctctataaatttcattactctaagtaccagatataagtggagtcacacagtatttatcttttttgtgactgacttatttagcataatgttctcaaggttcatccatgttgcagccaggattttcttcctttttaaggctgaataatattccattgtttgtatttttatttttattttttttttttggggaactaaaaaagaactttatttatgggggcgcaggggatgcaaacaatacaaaaatcaaaagcttatcgggtatttaacttttctttctcggctggtcaacggggagtcagattttattttcacattggctaagtgtccggatctggtcatgaaatcctt

SEQ ID NO: 593821 - DNA, 486 bp, Homo sapiens
gggggataaggtagagatgacacttgtggcctgattaaggagttcgtactctgtccttatataatgtatataaactattcaggccttctaagcaatgatatgtggtggctcagatctttaccttcgagaatgacatggtatggagaatagattcggacgaggagcaagatttggcggcaaggagaccagttaggaggactaactccagaagatggatatctgatgattgtccatactagagatagtagagaacgaacgactgcgagtacctagcttttcatgtctctgtatgggtaaactccttttcactggcccgttgaatcagtcttccctacattttaccccatgggttcatgtactgtcactgtgctttccagatgtgtcaaatatggtagattggctggtatacttatattcgtgagctcacataatggtatattagccgtgctaatatgagtttaaagagtgagttcagtggaagtataa

SEQ ID NO: 593822 - DNA, 345 bp, Homo sapiens
gcctctgtccctttgggcacgcctcatgccaggtgcatctgtggacaggggccatgctcctgggcttccaaagttggagaaaactgccaggctcaggtttgaaggccagaattttccagtaagtcctattgagtcaaggtgggagcagggtcggtagcttccaaggctttgcgggaaaatctgtttcctggccgtaaaggtggcctgccctccccagcctgtgttgcccgttttgaatgactggagtttcctgcttctgtccctacccctccccccccaatcccaaattttgttttggttctaactccctccaaaatgtgttcaataaaatgcttttataatata

SEQ ID NO: 593823 - DNA, 194 bp, Homo sapiens
tcgcggcgcggtccacgccggggcccttgccgtaccacatggcgaagacgccatcgacgttgcggtcggcgcgcacgccggcctgctgggtgcccatgacggcggtggcggccatgtcttcgttgatgctgggcaggaacgagatctggttggcgtcgagcgccttctgcgccttccacatcgccatgtcgacg

SEQ ID NO: 593824 - DNA, 391 bp, Homo sapiens
cggaccaggtctttcccctcaaatcctaaaatgtgtgtcttcaaagaatcgtggaaaggactttgaatacgagtttgtaccatattcaagtattcttgaatacaggtttcagataactatggagatgataccattggactaggtaaaaatttccaaaattcgaataaaaaactgatgtgttaatgaagattgctaagccaacatgaaacagaacaggaattaattacatgggactgaactgatagaggactgaaatgattttttaatcactttttgtttgaaacattgttgattcttctcatatttgttttgccagagtccacattttttttgggccatttatagctcatagcaattaggtgaagtatacttttgaggggaaaagaccctg

SEQ ID NO: 593825 - DNA, 135 bp, Homo sapiens
atgaatctagaggatccctaatcactatgtcgtgagagataagattactgagctccgtgtcagaaactctctgtctccaagcccacagtgacaactggcagcggttatggcttcacggtgccccagtggaatgag

SEQ ID NO: 593826 - DNA, 262 bp, Homo sapiens
  misc_feature (5)..(5): n is a, c, g, or t
  misc_feature (125)..(125): n is a, c, g, or t
  misc_feature (129)..(129): n is a, c, g, or t
  misc_feature (139)..(140): n is a, c, g, or t
  misc_feature (185)..(185): n is a, c, g, or t
ccccngcaaactggttaaccaagtcctgtttgctttcgtctttttttgtgcgtaataaagtcaactgaccaagtgaccatgaaaaggggtctgtctggggtctcctgttttttagtctgctgttncttncagtctccgnnccatgttgcctgtgtgcattatctgcaattggttttaattgaggncgaaaactgaaactctaccaatgaactgtttagaaacaagtacacacttttgtattaaaattgccttggcagtaaca

SEQ ID NO: 593827 - DNA, 279 bp, Homo sapiens
ggcaggacactgtctgataaaagcatcatgtgattcattatactcaattttgtatatgaggtgaggtaagggtcaaggtttatatatttattatgagacagagtcatgctctgtctcctggccagagtacagtggcgcgatcttggctcactgcaaactccacctgccagattacaggtgcacaccaccacacccggctaatttttgtatttttagtagagatggggttgccccatgttggccaggctggtctggaactccagacctcaggtgatccgc

SEQ ID NO: 593828 - DNA, 90 bp, Homo sapiens
atctaaaacactcctggaccattaacgtaaattaaatgtcttaagagatatggatatagatatagatatatttatatgcatatatatttc

SEQ ID NO: 593829 - DNA, 412 bp, Homo sapiens
taagcacatggttagatcactgcgatctcaatgggtatagcaggtgtatgtcaagcggcaagctaaagggtcgctgcagcggcattatatgccaatgattatgccgttctgaaaagcgtgtagtcccaggaaagtttccatagttggcaaaggtgaccagttagaatggctatgtcgtcaggtgtgctggctccagtccacagcctgatgttcccttctttatacctgtcgcagttgctcctcagatgaaggtataaagtcatgtcccttcaggtccctcttcgtagcaaagcctccatgggtaatatagggctaagatcagtgaatcgcagaatcgatgatttggacaggcaagtgccgcatgtcttagagtgtagtgtaggctgaagcgtgtgacagagaggtgtctccc

SEQ ID NO: 593830 - DNA, 236 bp, Homo sapiens
ttgatgagctcggtaccattcgtcgtcatctgcagtacatcgagggcaatggcgctttgcgtacgcactgcctgctcagacctacgatgagatctcgatgttgatcgaccgcggcatcaagccgtacctgtgaggcaccgccccctagcactcctcacggggcgctagggggcttatgccgtcagtcgatttttaacccaggtggtcgatgtccagttcgggcaacggccaatcct

SEQ ID NO: 593831 - DNA, 511 bp, Homo sapiens
  misc_feature (54)..(54): n is a, c, g, or t
tatgtggtaatatcttactgttaggaaaaaaacgggagccttagtgtaacccanaggccttgaacactgaacaccacaaaagaagtgaaaatagccttaactgctgacattccaccattgtggtttgtttctgccccactctaactgttcaatgtactttgtaatctccccacccttaagaaggttctttgtaatctccccacccttaagaaggttctttgtaatcttccccacccttaagaaggttctttgtaatcttccttacccttaagaaggttcttattatcttccccacccttaagaaggttctttgtaattccccccacccttgagaatgtactttgtgagatccacccgctgcccgcaaaacgttgcttctaactccaccgcctatccccaaacctgtaagaactaatgataatcccaccaccctttgctgactctactttcggacccagcccgcctgcatccaggtgaaatgtgaaataaacctgtggcctcgttggcctca

SEQ ID NO: 593832 - DNA, 107 bp, Homo sapiens
cttccatctgtcatgtgtcagcatggcatggaccctgaactgatcaatgcaggtggtcaatgcagatgttctacatcatatgtgggccatcaccctgaacaaccttc

SEQ ID NO: 593833 - DNA, 305 bp, Homo sapiens
ttccccgcgtcccgtttgcgcagacagcaggtatactagatccgggccctcaggggtctcgtttcttgctcacttctgtcttgacagaagcattgctaaaatgtatcccctctcggtccaacaacaggaaacctgactggggcagtgaaggaagggatggcatagcgttatgtgtaaaaaacaagtatctgtatgacaacccgggatcgtttgcaagtaactgaatccattgcgacattgtgaaggcttaaatgagtttagatgggaaatagcgttgttatcgccttgggtactacgctttggca

SEQ ID NO: 593834 - DNA, 269 bp, Homo sapiens
  misc_feature (137)..(137): n is a, c, g, or t
  misc_feature (159)..(159): n is a, c, g, or t
  misc_feature (235)..(235): n is a, c, g, or t
  misc_feature (249)..(249): n is a, c, g, or t
ttcttaaacctatcatcatctgaaatagctggcccatcaggaaggtactttgttgggtgattccatttggccagagaaaagtgatctttgttttccaaccctttctcctgttccaaggcaccagccagagatttgcnatatagaagttatcacggtcangagaattcgcggtggtacccaagtgatagtctatctctcatcatctcgtggattccactatttgcaaatgcacctnatttgtaaccccanaagtccgtactcatgctgac

SEQ ID NO: 593835 - DNA, 1366 bp, Homo sapiens
cccacgcgtctggctcgcaagaggactggcagagtgcccggcagctcggagctccgtggaccttgtgtgctgcatcatggactgctggcttgtccctcttgcctgggacccatgatgcctgcctgcctgcctgcttctggccttcctgctgttgttatgcgctccttctgctgctgctcctgtgtgcatggctgtgcctgtgtggagcctgcgtggtgtgcgatgtgactggctgctgatgtgcttgcttgcttgcttgccctcctgtggccctgctgtctgtgcttgtgaacactgtgatgatgtgcctgatgccaattgctgtgctgtgcctccattcttattgcttgtgtgagtgatagcttggacgatgctaccgcctggacttgcaatactgctgcttgaaccggactgcggccgtgccttggatgaaatgcctgcaagctgacctgtgcgttttgttttgcacggctcgttgtgacccggaccaacacaccgctgtttgccatccaccttcaagcactgatggaaactgtgggcttgcatggccattactcgccggcgccaaagcgcatggcttgcacatcaacccacgccactgcacgcacggcaacacaatgcaatcgccacgccaacggccactgcaatgcaaacgcagaacatggcacccaggagcatcgcggcgcacctgatgcacctggacagcccagattcaccaaaatcaccaactgatgtgtgacccccctggcactagatcatggcccaatgatcacaatacggaaggcccatggccctgggatccacaccgcctcctacatgggacaaccattggcacctcttcttcccagccgagttgaacagaaccctggcctgcgaacccttgtattgattgagacacgccaggccaactggggtgcccaccatgattagccagttgcttacgctttcaaccttgggctggacttggacctgagccaacgacagctggttcaaatggggatgacatacggaacccttatatcacgggaatgcccccccggaccaacggaaccgcagagggggacccttgggacaaaaccggccccggcacgaactctcacacccggcattagccaacgagaattcgggcgcatcgcaacagggaaaccacacaggcaacatccagggctcccaagcggggcccaactacccctatgggggccaggggatccacagcaattccaaggcgaaccagcgacgacagaaactagccacaagcaacggcaacagcccttcggcggtcccacaggcgccacacggacacagggacctcccccgcactcgcacgagcccaggcagagcccggacacaagcagcagagaagtcg

SEQ ID NO: 593836 - DNA, 977 bp, Homo sapiens
tgggtacctctggcacccaccatgagggattggttctgagctggaagccatccctctggtgggtacctctggcacccatcgtgcaaatatctccctactctccaatcaagatggacgtagcatccccctggggcacttgcatgaggcccaagtcgcgactcacatcctcgacttatgcatgtcccaccatcgtgctgacaactttccattagaagccatggttatgctgtatcggtcaataatctcaggccctttggcgctgggctcttgtggtctgtgtgcattccatggcttcatgctcaagaccaccagaggggtctagggttggtaggcctgtgcttgtgattctgctgctatatgtcgcgagcttacagatgccgaatgaggatagggacctactggagctacgtgggcatggggtccctgccttgtcggtgtacatcatgtgtgattctggactagcacactctgtcaggtagggccgtcgaatctcccatctgtgacatagagggactctcgaccttacgtgggacccgtccattgtttgctgggtatttagccaaagcgtggtcctggagaagaagtgcacgatagcgtgtctcgatggacttatccataggccttggacttgtatatcttagtgccaggaggactaacaggatcctaatggggagctccgtggttgctcatgcgcaagacaggtatcatacatagacacccagaagggggcactatgaggccctgtcgtccgccagtaggccagtacgggaactcgtgccgttcacaatcacaagggctagttccaggtcccacagggccattggtactgctagtcgaggggggacagggcctgtagatgtgggcactccaggagttcctctccagtgtatgccctattctccttgggagccatacttgaacaacaggatagttcgtgcggccagggagatcaggcccatggaacgccgcacccttaa

SEQ ID NO: 593837 - DNA, 1322 bp, Homo sapiens
  misc_feature (858)..(858): n is a, c, g, or t
ggagatcctcccttgtccgacagggtgcggcgtgcatggtgaaactgagcataatcagggcaacagctagagagcgtacatccatcctcatataacaatgcgtgagtcactatgtttcgcacattccgactgtggcgtcgttaattcgcctcttggtgcactattacctgggattgtactgacgtgggtgcaggattactcgcgaaactgcctgtaacccaatgtgctccagactcctactttgagtgataggaggcttatcctgggtcttctggattcgagaggcaatcagtgaagcagccataggaacggattgtagtgtcatcttgtgcgtccggcaactacatgacgatgtggatcggactcactgcacgtcaactagcttggggagtggccaacaacggggtcttccacactagcggcagtctgtagtcacctacctggaactatgttagctacagctgtatgatacgacattgtatcacgtaagataaagggtcgtcaatcataccatggttgattgacagacccttcgctaattagagagtaccctccaagtaagcggggcgattccgcccccttgtgagaggacgcggacttcccaagtagagagcatttgcgcccgcttccgtggacacttgctgtgccttcgattcccgccctagggggacttgctggatgcgccctattcttagacgaagcccttggcggccatcaagcaggtaatagggagagcgtaagccgtactcggcaagatggcggttatggggctctgaatatgccgtacaggggacccacggtaaagtcaccaggaccctagtgtgcgcgcacccctgaatagtcttggttcgttcagangggagttgctcaatggaggactacaggtcctttggggtgttcccccatatacgagggcggccccccctaccacacgcggggaaattgcaggccacctacgcaaggcggccagtaaggacggtcaatcctttagggccgctaccccttcaagttagcccctgccttagaaatgccccggttaacaggcgtgtaacaataaggttccgtttataagtccatcccttttggttgggcccttagttggaaacacctgaggttttatcaactaaaggcgcttcgtttacacgacaggaaacccattttatcctcacaacaaaaagacacggcactctgtcgctgcagtgcaacttcgtgaaaacattagagaggggttgggagagcgagacagcagaggtagacagcgagagaactaggggagcagagtggtggtcacatgaagcagagtgtttcccctggagacacac

SEQ ID NO: 593838 - DNA, 351 bp, Homo sapiens
ctttactgcttatacgcgcgagagcgcgaagatgcggtgaatgagattaccgaggctagcagcggcatctggctggccctgtgcaagcggcatgatgtcggaagatgatcagcttcatatgaggtaggcgtgcaggaatatgagcacggcataagctgaacgtgctgctctgatgagctatcaccccactgctgaagtcacacattgtacacctggatgtcaacaacctggcacaattgttactgtccttcaaagatcttaagcaaaggtatatctgttgctgaaggatgaacctttctcaagtgaatgctcagcgtaacacttagtagacgagaggctagcgaccgttgg

SEQ ID NO: 593839 - DNA, 184 bp, Homo sapiens
catcagcgttctcgcagtcatcacagctggttactgatatctgaaggaagattcggcactcgtggggctgcagcttcatcagtttctcagagtccctctcctcatgagatgggaggaacgtatgggcacgagttctctcaaagccagatcatcgcggtcaaagtagtaacgacatggacaggtg

SEQ ID NO: 593840 - DNA, 1196 bp, Homo sapiens
  misc_feature (310)..(310): n is a, c, g, or t
  misc_feature (370)..(370): n is a, c, g, or t
cccacgcgtccgcccacgacgtccgcaaaattagacccccgtaagtaagagattcaagttaaccactcattcatcgacctcccccactcccgatcgcaacaatcatccagtcaatagatgaaacgttcggcgtactagcgtccgttgagcgcctgtcgcatggatccatcctaaatcatcgcaacgaggtactattacctaagcgcgatgtcacgtaactgcacctagacgcctcaatccgaccgtttatcaatcagatcgcgcacagcagtcacatcgaagacggtaagagttattggcatgaagtcantccgacgtaccgttcacgtccaagtggacggccgtcaaatagttcgttgtattcgtgccntcgttccgtacatgcatcggggcgaaggcctatagttagcgggatcatgttctctgaactcgagacaacctagataacatacgagcattgatccttcctgacttgcaactgatagcaagcaggcttcataggctatgtcctcccgtgaggccaagatatcattctgagggggccacagtaattacaaacttactatccgccatcccatacattgggacagatctagtgcaagtgaatctgaggaggctattcagtagacagtcccaccctcacacgatacttgagctttcacgtatcatacttacccttcatggattgcagccctagcaggactccaactcctattcgttgcacgaaacgggatcaaacaaacgccctaggaatcacctaccattcggataagatcgactttcgaaccttactaaagcaatcagagaagagctcgggttacttactcttcctttctctccttaatggactttaacactattcttaccagaactcctaagggaccagaaaattaacctagtaaaacccgttaaaaaccccgtccaaattagagccgagggagatccaataggcgcaacaaattcgagcaggcccaaaaacaaagagcgggggcgaggcccaaaaacatcacacgacgtcataacagaaaagccaacccagatttgacacacagcacaagtatcgcacagcacaacagtagtcctcagagcacactcacagcagagaggagaaccacacatgcagaacaccagtcacactgaccagccaagtcacgcagaacaaaagaggcgcgggcgcctcctctccagcaatattt

SEQ ID NO: 593841 - DNA, 466 bp, Homo sapiens
cacgagggcaaccgccgggcctgccagtggtacctgcgctaccacgagtgtcgggaggcttcgcccatccctcatgacggcatctcccgtggccacatcgaggacagttgtccccagttcctgggacgcagccccctggtgatccccatggaccactctacagacgtcaccttccacgggcatcaaactggacaccgtgatgggttcctccctgcacgtgcgcagtgacttgctcaagttcagtggtgccggtgaccatgcaataagtctgggaccttcgcctttcggaccccaaagctgtcccaccatgtcattgagacgctggccctgcacctctacgtcaagtcttaagggaacaatatctatagtccgctccatgtgagcctctagatctgctcctttgcccgcagcgactgcatcctgtgccgggtcgcatttcccgtttacaggtgtgcgtggtgcggcg

SEQ ID NO: 593842 - DNA, 184 bp, Homo sapiens
tacgggtagcatgtatgagatgagccatgataacattccagccacgtggctgctaaacaagtcagcaaaagacactgcgtgaaaccctgagcagaaagaggccttctggtatggccaaagcccagattattaacatgatgtctctgctaaaccaagcaggctaccaactatgtatacccggcct

SEQ ID NO: 593843 - DNA, 196 bp, Homo sapiens
ttttgcctctggtcaaagtgtttgctgcgtcgtcagcctgtcccggggaggcgctccgtcggtccgggtagcgccggctcgcggctccggctctggcgtgggtggtcccggctccgaggagcggcggtggctgcgcgtccgatgccggttctcgttgtcccgctcttgtgtattctcgttgagctgccgcacgacg

SEQ ID NO: 593844 - DNA, 291 bp, Homo sapiens
cgtcgttcggctgtccggtcggagcgtagccgacaccgctgcacaccgatgctatcaatgggtaccggagagagaagaggtgtctgccccgcaacctccccgtgtggctgtcactggccagatgtcatgagggaagcaggccttgtgagtggacactgaccatgagtccctggggggagtgatcccaggcatcgtgtgcatgttgcacttctgccaggcacagggtgggtgggtaccatgggtgccaccctccaccacatggggccccaaagcactgcaggccaagcaggg

SEQ ID NO: 593845 - DNA, 377 bp, Homo sapiens
ccccccgggccccccccggggccccccccgggggcgcccccccccaaaaaaaggtttcaaggttggtttgcccccccccaaaaatagggtttttttcccaataaggcccgcccccccaaattttcccccttgggaagaggggggggggttgccaaaaccggtttttatggcccgggtttttaggggggggccctttcgggggggtcccccccttttggggggtcccccccgggccggggttttaaaaaataaaatcccccccccccccccccccccccccgttttttttttttttcccaaaaaaacccttggggatttggggggcccatttggggcccccaagggggccccgggggaaaaaaaattttttgggttta

SEQ ID NO: 593846 - DNA, 268 bp, Homo sapiens
gctcgacgtattatgctctgagaaggaaaaattgcccaaaatttccctatcaaaggaaactgaaggatccagcctgggcaaacatagtgagaccttgtttctgcaaaaaataaacaaaattagccaggtgtggcagcacatgtctgtagtcccagctacccaggaggctgaggtgggaggatcacttgagcccgggaggtctaggttgcagtgagccgagattgtgccactgtattgcagcctgggtgacagagtgagactccgtctc

SEQ ID NO: 593847 - DNA, 140 bp, Homo sapiens
aaacaccgcaatctcactaacacctgtagtttcttgacatatcaataattgccattttgattggcatgagatggtatctcattgtgggttttgatttggctttaggtcttgatgaccagtgataatgagcatatgttcat

SEQ ID NO: 593848 - DNA, 861 bp, Homo sapiens
ggaacgccgcagttcctgatggcggcgcatgcatcagacaaggtctcgagaccgtttcagctggatcatgcaaacatgcgcccactgctggtacggcattccatgtacgcgataaaatcggcattcagacgactgtccatagatgccaatagtgcagaaaagtcgttagacagccatgcttatcgtcggcggtcgaatgactcttgcagatatgctgtcttggacttatgatcaatttgtcatgcatgtgagtcccatagtgacttctcacaagcagttgtcaatgagtgtgatcgcgagccattgaagtgtcaagtcccaagatttcattccctcctgtcgttcgactctttagccttctgcagtgacttgcatccaggagatatgttgcattgcctttcgcaattgcaagccttatgaaccactccgctagatattgcatatggagcagatggagaagtttttgaatgattgcaaatacccgccgcagcctatcgagctacggactttcagctgcgtaccacttagtgcgctcgtagtcactgtgctggctctgcgtcttcactggaggaactgacatgtgtcatctatgtaatgggacgaatgcctgttcaaccaggagagagggctatctgttggaatttcggtgcgatctgctaagtcgttgtcgaagcaggattgttaagtcccactttgcccctcgtcagctcaaagttggtttaatacacgatgtgctcgaagtcggagtccttgctccaataagatgtggattgaccaagattttaaaagcaccagacctgctcctatgacccagtgcgtggaaacagctagctttctccagtgccgccatctgtcgtctaa

SEQ ID NO: 593849 - DNA, 181 bp, Homo sapiens
  misc_feature (19)..(19): n is a, c, g, or t
  misc_feature (169)..(169): n is a, c, g, or t
atcagcgacgcacccggcncataaatccaccatttctaaagtgtttatagtagaagtagtattacattattgcaaaatagtaagtgaactcatggaaaatggagtttatttccactgaagacttctatgccaggatagtggggaggaagagttcactcagaggtgcgtngctgatcacctc

SEQ ID NO: 593850 - DNA, 233 bp, Homo sapiens
tccttgcccctcccttgggggtcccccaggaagccaggtgaccccaggtgggagcctgtgtgtggaggccttcctggaaggaagtttagccctgcccaggtgtggagcgaggggcacaggggcttcctaccctcagaaactgaaataacgcctttgaaaaaaaaatttgtaaaccttccccccccaatcagaagatggcaaatggggaataaaaatagcaggtaaaaagtcca

SEQ ID NO: 593851 - DNA, 320 bp, Homo sapiens
tgctgatcactagcagggaggggacgccagagtcacgtacttaagtcgctactgacgatataagtgctgcgacagagcggattagaggtaggtggtaacagaggcatctagaagtcgtggtaacagaggtgctacgggggctgacgcttcctgctgaggaagggaaaccaatcatcttggcgtcctggccctcgagcaggctgcggtaggtggcgatctcctgctccagacgtgtcttgatgtccagacagcatcttgtaactctatggttctaggcactaccatactcactagcgagagctacgctcaagctaggagcc

SEQ ID NO: 593852 - DNA, 1218 bp, Homo sapiens
gggcgtgcgggttgtgtctacgctgtgcgcggcggacgtcggagtgcagctggggagcggagctggggccgcctgtgggcctctccatgggcctgcagctggcatgcagttgtggccccccagccccgtgccggctggaccgacagaacgcaggaatgtgggtgcctgtgggggacccctgaaccccgagcctggccagacatgccatgaacatccatactgtaggagaacctacccccgacacatcatccgcctggtgtacaaggacggtgactgacactgaccagcagacccaccctgattggcatcaaggtctattcccaaacgaggaggaccttcaccgacctccagtgtcagcatacgagggccctgagtgggaccaccatatagctgcgaggtctgtaaccgcaatgaaacttcctagctaggggaaaggacttacccctgcctacccacaacaccaaggtgctaactatacctgaccaacgatcttcacaaccgaaacgttggagcgcccaatgggcgcagattctgacgtcaacgatgctcgaaggagggactggaccggctgagcatggagcatccgaccagcgtacttgctagaccatcaagtgcactagctagatccaacccttaacccccgagtctagaactccaaacgaaggacaggcataggcctgccttgcttttttggagaaattaaccaagcgagtactgcgggtccgggaccagatctaggtcaccaagaagataccaatggaggccaccacggcgggaccccaaacgcgggcaatgaggcgcgcagagctgggtcggtggccctgaggcacagagggacatagaagaattccattcaacagaaccatgagagacccgagagggccagagacggacaacagcggtccaattgccacgaagcatgttagaaaggaaataaacgttgcggccatgaaaaggacggacaactaacacagatacatagtaactacatatatatagacattaatccaccttttcccgtgtagctccaaactacttatttcccaatccgtcaaatttatcaaaagaataaaacaatgacagagacaggaaagaaaacgccaagtgactgcatgttttcacaactcggcacgatcacaacaaaaaacaccgacatatgcaccagcaaaacatcactatcaatataaagtccccatttaaagaataacacactccaca

SEQ ID NO: 593853 - DNA, 325 bp, Homo sapiens
ccctgtctctgaacttagggtgccggcacttgctgtcggaagcatcctggtggcctccccttagtgtgtgaagctgggggactttggtctttcccgagggcggttgagtgcacgaggactattacaaagcctctgttgactcgtctccccgatcaaatggatgtccccaggagtccattaacttcccgacgcttcacgacaccccgtgacgtcctaggatgttcggcgtgttccatgtgggaatttctgagctccggggcttcgggccttcttccgtcttctggctggaggaatgtcgttgtcatcgtggtgcagaggaaagggg

SEQ ID NO: 593854 - DNA, 188 bp, Homo sapiens
gggatttgctgaatatggcggtatataagctgagcaagaggtggtgaggttgatcgggggtttatcgattatacgaaaagtgcacctcatagaggtatatgaatgcaccgtcgaggtctctttgatattataatgctgtatgtgtcgataatgttctgggcgagcacgttttgattgattctacactg

SEQ ID NO: 593855 - DNA, 303 bp, Homo sapiens
tgtagtgtggctcatggcactttttcagaccatgggtgacacatactcaactctatagtcatagctggttccggagaacacttctcaagaggtaatcgatgtacatgcagtaccaaaaaaatagtgcactccagttgtgccctcttgtggttaaagttaaatctttacagaatttaacctattttccatctggtggggagctaaacttgaacagcctctgcgtttctgaccaagtcctgttacgcctatttatcaagccacattatttagaagaccacaactttttttaaatcattccccttc

SEQ ID NO: 593856 - DNA, 771 bp, Homo sapiens
gcaaatggataactcgttttaagatgggacgagatgatgttgaagatgaagccctcaaaggcagaccatccacatcaattttgcaaggaaaaaattaatcttgtacatgccctaattgaagaagaccaataattaacagcagaaacaatagccagtaccatagacatctcagttggtttaacttacacaattctgactgaaaaattaaagttgagcaaactttctgcttagagtgccagaaccattgtgctcagatcagctatagacagtagcagagctttcaatggaaattttaaacaagtgggatgaagatcccaaagcatttctttgaagaattgtaacagaagatgaaactgattttaccaggatgaccctgaagataaagcacaatcaaagtaatggctaccaagaagtggaataggtccagtcaaagcagaagcagactggtcaagagcagaggtcatggcaatagtttttgggacgctcaaggcattttgcttgctgactttctggagtgctaaaaagcaataacatctgcttattatgagatcgtttgagagagttagccaaagcattagtagaaaacaaccagcaaaatctgcactacagagtcctccatcatgacaatgctcctgcttattcctctcagacaagggcagtttgcaagagtctcagtgggagatcattaggaattctacccttggtcgtctgatgtggctccttgtgactgctgcggttgcctaatcttaacacaacattttctcgggggcc

SEQ ID NO: 593857 - DNA, 153 bp, Homo sapiens
tagcaggatcctttatgttctcgatccgttagtgggagctaagttgcgaagatgcaaaggcataagaatgatatagtggactttgaggactcaagggttgaaggatgagactacacattgggtacagtgtgcactgcttgggtgaatgagtgc

SEQ ID NO: 593858 - DNA, 688 bp, Homo sapiens
  misc_feature (4)..(4): n is a, c, g, or t
  misc_feature (92)..(98): n is a, c, g, or t
  misc_feature (118)..(118): n is a, c, g, or t
  misc_feature (126)..(126): n is a, c, g, or t
  misc_feature (165)..(165): n is a, c, g, or t
  misc_feature (167)..(167): n is a, c, g, or t
  misc_feature (183)..(183): n is a, c, g, or t
  misc_feature (189)..(189): n is a, c, g, or t
  misc_feature (193)..(193): n is a, c, g, or t
  misc_feature (197)..(197): n is a, c, g, or t
  misc_feature (199)..(199): n is a, c, g, or t
  misc_feature (202)..(202): n is a, c, g, or t
  misc_feature (214)..(215): n is a, c, g, or t
  misc_feature (218)..(218): n is a, c, g, or t
  misc_feature (230)..(230): n is a, c, g, or t
  misc_feature (232)..(232): n is a, c, g, or t
  misc_feature (260)..(260): n is a, c, g, or t
  misc_feature (270)..(270): n is a, c, g, or t
  misc_feature (281)..(281): n is a, c, g, or t
  misc_feature (322)..(323): n is a, c, g, or t
  misc_feature (328)..(328): n is a, c, g, or t
  misc_feature (332)..(332): n is a, c, g, or t
  misc_feature (349)..(349): n is a, c, g, or t
  misc_feature (353)..(353): n is a, c, g, or t
  misc_feature (356)..(356): n is a, c, g, or t
  misc_feature (361)..(361): n is a, c, g, or t
  misc_feature (383)..(384): n is a, c, g, or t
  misc_feature (390)..(390): n is a, c, g, or t
  misc_feature (394)..(394): n is a, c, g, or t
  misc_feature (402)..(402): n is a, c, g, or t
  misc_feature (414)..(414): n is a, c, g, or t
  misc_feature (430)..(436): n is a, c, g, or t
  misc_feature (447)..(447): n is a, c, g, or t
  misc_feature (458)..(460): n is a, c, g, or t
  misc_feature (467)..(467): n is a, c, g, or t
  misc_feature (497)..(497): n is a, c, g, or t
  misc_feature (546)..(546): n is a, c, g, or t
  misc_feature (549)..(549): n is a, c, g, or t
  misc_feature (555)..(555): n is a, c, g, or t
  misc_feature (574)..(574): n is a, c, g, or t
  misc_feature (687)..(687): n is a, c, g, or t
tgtntaaaatattcattttacatatctacaacatgtatttcatatttctaatcaaccacaaatcatataggaaaatatttaggtccatgaannnnnnncaaaacattaaaaaattaangttttganacaaatcacatgtgaaagctcattaaataataacattgncnaataaatggttaatcngctttncttnttancngcngccatgcatttnnggnattccattccangngggggtcagcatgcagggtataattttntattatgcgnccgtaaagggntacagggcttatttttggggtggaatgtcacagggtctttnnttctntttnaaaggggggtcactcgngggnggnggggngttcccatggggggtgccagannggggcntttntggggtgntactgtgagggntcgtgggaacatgttnnnnnnntcctgttttgngggggttttgnnntgttggnggggtgggccagttggtggggggtatctgngaagcccttttctgttttaaaatataatgtttcactgttgttttttgtntcnacagtnttttaagaacaatgagggnttaaaactacaggatacgtggaattttaatgcaaattgcattcatggatatacctacatcttgaaaaacttgaaaaggaaaaactattcccaaagaaggtcctgatacttaana

SEQ ID NO: 593859 - DNA, 275 bp, Homo sapiens
gggccggaaatggctagtggatattcttctagatagggtccagaagaggaaaatatctttcaaacaaagaggacaacaatgtgttgtgtatgattttcacccccttgatctcacgtcaagcaaatcaacagttgaaaggaactgctctaacaactcagactcaactagacaaattcacaaaacctaagtaggccacaccgggcatgtgtttacagagaaagctacaggacaggacaggctagcaggggagtatcacgccaggcgcacaacaggag

SEQ ID NO: 593860 - DNA, 939 bp, Homo sapiens
  misc_feature (2)..(2): n is a, c, g, or t
  misc_feature (25)..(25): n is a, c, g, or t
gnggagaggacaagaaagcggtgcnggaaactacggcctgcgacgtcgacaggagcaagctttcgccgcctgtcccacgcaggggtctcccagagggactcaactgtgcctaaggatcatctttaaagggcaccgtgtcaccccaggtacggtctggtgaaaccccgtgagacatcggggacaacccctgggaccacctcattcaggattgcacagcacaagtactgggggttctgaaaaaaaagacaaaaagtggagcgcgccaactacaaaacacagggggcccaaagcgccataccaaagcgtttgagttaatcaggccgtcatgggccccccccgtcttgtcccgcagggggccaccggttctccagtccccgggtgtttcccgaggagtgtcttaggccccgtttcaggaacccccagggccccagtcacgatttttcaaagaaactcttgttgttacgcctcagtccccaaccacccgattggggtatttgaggcggaggccccccctctcttggctgaacacctgaaggcccgccgcccaaagatccctccactgaacgcgtggctgacgaacacaagtgaaacccttctatgtgggcgcggtccacaattgtccccacccgactcccctccgtccctcggtggtgagcgcacgtgtttcactcactgggcggagtcattccgggcactatggggttatgtgcctcccggcgataccgcgtgttcacccccacaccggcgcttctcaatcgccttgacgaaccattagaccgcctcttgtccgcccacttgggaacagcgtagacttttgtagcgccacccacacaggggcgattcatacaatacgggatataatacgaatcgcgcgggcccctgtgagatttttcccccacccccccggcccctaacaccctttttttcacccacataaca

SEQ ID NO: 593861 - DNA, 1188 bp, Homo sapiens
gacacacgcagaattccactgcctgggtgacggggctcagaacacaggcagaagggaccaggacgtaaaagtcacctacctgatgtttaccatggaaaactagcttctacctgctcatctctcaggcgatgcggtacctatagggacccggctgtgcacccccgggacaaacagcggatgaagccaggagctcagctctagagatatgagcactgctgctagtcccagcccatctacgcgctactatacccgccagggagagacacacacagcatacacccatgcacacctagaggtgtacctccaccatcgaccgcaagggacaaagtcccaaccttcttactaccttccaaaaaacccaagacccctgaagcagtacaggagaccctactgattccagatttgagtcgccaggcgttagtgtcccggcacttcttgcacaacgataaggtgacagttgactgtttctgacaccaaacataaccgaccatcatacaaagcagacactaccaccatggacaccgctgggaccttggcaagagtggatgactgaaatgggaatgaataaggaggccctatacccaactaggcagaggccaacactaccttggtacacccacccgccatacccccggaacggtaagacaaacaaaaatacgcagagacaaacaaccacagcttgcaccgtataattagagaaaataagctcagaacttagaacagcagagttcacacacaggcacagggacattggggggacgaccgacagtgatatactgggtagacgtaccgggtatccctacaacgcgttacaaggaacggaccccacactttagaaggacaaacattatccagtacccacattacccaggcaataaccgcagaccacgcaactgacacaggggcccagaggagcagaagcggccgagcacgcccccagcgcacgaagggcatcatagtaacaagggagaaataacaacacaatgaataacacaacaacctcctgaactcaggacagatgccaggcaactacagtaaggccaattaccacccgggatattaacacattagctacacagaccaaaacaaaacaaacaagaaaacgtgagcaacaacagaccgacggagagacaccaaagggatcagaacacaggccaaagacaaaccgagtagtaaagcgacagacca

SEQ ID NO: 593862 - DNA, 345 bp, Homo sapiens
taacgttgcatattcttgagcgtcttttatctactcatacaggccatgtcttgcaacgatctatgtttggagttcatttactctttgcataatccagcgcatcataaatcatgccaaagccagatagtcttgccaccaccaaaatgagttctgaatccaaatacaaagatgacatccggtgtggtacttgtacattattaggctagttttatacccgaatttctagtcttaggcactgtcgccttcccggggtgaaggacataaatgaccatttgtttcctctgaagtagtcggttggtcatgaactttctagtgcggatagtaaacggtgtcgttcataatgga

SEQ ID NO: 593863 - DNA, 908 bp, Homo sapiens
  misc_feature (876)..(876): n is a, c, g, or t
tacccacttccttcagaaaattcccatatgggaaaccccaacaactaccaatacacttttggaaaagattacagggacaaattggttggattttataatttcctatgtttaattttggctattggtattatttaatacttctggaaaattttttttaattggactaaggaaagcagctctccaggggtggttaatcttcataattggcttaaattagggaaaacccagattatggtttggtaaattaaatatataaagggactggatggtttattacaccttattttggtatatgggatccataatggaaaattacaatttagccatatgcattaatattaaatagggcaaaaatccactttactccaaacatttggcatttggtacctattaaatcccatggtcttcggtatgcatttattaaaactccttaaagcattataggtaatccttttccaataagggactttattaaaggtttaaaaatggcaccgcagaaattggattccaattattaagttactaaatacattcttatattggccccaagtggcttatatttatactttccaaaagacttgggagttggcacttaactggtcctacttttaagaattgacggtcagggtctttgtcaccaacaattagatttatggttgaaccattcttgcggaccgcactctcattccgtggcgaataaccccctagcggggaaccaagatggtcggaaaatgtggagttcttcaacgaaaaaatggtatgacaaagcaaaacggagagagccgagagtcaccgagggacagtttccgcctttccacggagacgggcccagcgaataccgctggattaccgatacccgcggcgggccgcggaganaaccagcagaccaagacaagagaccacgacag

SEQ ID NO: 593864 - DNA, 152 bp, Homo sapiens
atgcgaacgaacagtttatggattggcgagtggatccgcgtttcgcaagccttgcatctggccctggttatttggcgcgaattgtagtatggtttatacgcagacaagattatccaccaatttcttaatgattccggaaggcaataaggggc

SEQ ID NO: 593865 - DNA, 324 bp, Homo sapiens
  misc_feature (161)..(161): n is a, c, g, or t
cataaccttgacctcctgaacagttgcaggttcttcacatcggtgatgccgtcggaacgccttcctcgggactcccctgggatctggttttcactccaactctagtctggtgatgcttcggtcgtgctctgtataaagcagatccagggcgctgcggccgngcggcccggcagctcctggagtgctagtaggatgacactccagacccactcagatgagcaacgtgctgacaataggaagttggaagctggactcgcgagaaggggacgtccacatgaccctcgtcgacttccttctccgcttctctatgacccctcgcaactc

SEQ ID NO: 593866 - DNA, 111 bp, Homo sapiens
  misc_feature (95)..(95): n is a, c, g, or t
tactttccagggaggcataattagtcctgacacagaggcttctcccatagaacctcacttctttaacaaggcattactgtaagagaacgtgttcntgaatcagcatgcgaa

SEQ ID NO: 593867 - DNA, 330 bp, Homo sapiens
gggcctcactgtcgcctaagctggagtgaagtggcacaatcatagctccctgcagcctcaacctccctaggctcaagtgatcctcccacttcagtctcccgagtagctgggactacaggtgtgtgtcactgtgtgtggttaatttcttttatttatttatttttgagatggagtcttgctctgtcgcccaggctggaatgtagtgatgcaatcttggctcatgcaacctccgcctcctgggttcaagtgattctcctggggctgaggttgcagtgggtcgagattgcactaccgcactccagccagggtgacagagcaagactctgtctc

SEQ ID NO: 593868 - DNA, 904 bp, Homo sapiens
  misc_feature (128)..(128): n is a, c, g, or t
  misc_feature (145)..(145): n is a, c, g, or t
  misc_feature (163)..(163): n is a, c, g, or t
  misc_feature (188)..(188): n is a, c, g, or t
  misc_feature (206)..(206): n is a, c, g, or t
  misc_feature (208)..(208): n is a, c, g, or t
  misc_feature (223)..(223): n is a, c, g, or t
  misc_feature (232)..(232): n is a, c, g, or t
  misc_feature (236)..(236): n is a, c, g, or t
  misc_feature (238)..(238): n is a, c, g, or t
  misc_feature (242)..(242): n is a, c, g, or t
  misc_feature (636)..(637): n is a, c, g, or t
  misc_feature (658)..(658): n is a, c, g, or t
gagtggcctcgccgcttgagtttgattcatcatggataatctgtcatcagaagaaattcaacagagagctcaccagattactgatgagtctctggaaagtacgaggagaatcctgggtttagccattnagtctcaggatgcaggnatcaagaccatcactatnctggatgaacaaaaggacaactaanccgatagaagaaggcttngnccaaataaataaggncatgagganacananaagnctttaacagaactcaacaaatgctagaggccatgatgtaacaacccatataaaaaaaacaaaaaacaaaaaacaaacaaaacaagaagacaacaaaggagatggtggagaaaactcaccttgcaatgtagtatctaaacagccaggcccggtgacaaatggtcagcttcagcaaccaacaacgggaggcaagccagtggtggatacattaaacgcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggctgacaccaacagagatcgtattgatattgccanngccagagcaaagaaactcatngacagtaaagctactgtgtcttctttatcatttatcacttccgtagctctctgaaagttttaccttttccgagtttaagtttcggtccacctcttctaattggagaaacttggacgaagggccgagcgtaagtcccttctttggtgtgctgggggggcgctgtggtctgctcctgtgtctttttgtgtctagctgcttgcgtttctgctctgttgtgcttctcgttttctgtgtctcgttcggtgg

SEQ ID NO: 593869 - DNA, 465 bp, Homo sapiens
ctacaggatccttatgctgctccctcttcactgctgcctggtaggctgaagcacgagaatcgcttgaaccctggaggcggaggttgcagtgagccgagattgcaccactgcactccagcctggcgacagggcaagactttgtctcaaaaacaaaaacaaggccaggcacagtggctcatgcctgtaatccctgcactttgggaggccaaggcagtggatcacttgaggtcagaagttcaagaccagcctggccaacatggtgaaaccccatctctactaaaaatacaaaaattagctgggcatggtggcacgcacctgtaatcccggctactcgggaggctgaggcaggagaatcgcttgaacatgggaggtggatgttgcagtgagctgagattgtgccactgcactccagcctgggcaacagagcgagactctgtctcagaaaaaaaaatgctgttagagaaa

SEQ ID NO: 593870 - DNA, 101 bp, Homo sapiens
gaatttgacggtttaaagtggtggaaattggaaggaaaccaggaggtatttgggaaggccaatggggtggctccttttaggaaataaaaccctaagcatga

SEQ ID NO: 593871 - DNA, 503 bp, Homo sapiens
  misc_feature (412)..(412): n is a, c, g, or t
  misc_feature (445)..(445): n is a, c, g, or t
  misc_feature (454)..(454): n is a, c, g, or t
gatggagtggtgctaccaaaggaccccaaagagatcctggctgagaagaacttcaacactgtgccttacattgtgggaatcaacaagcaagaatgtggctggcttctgccaacaatgacgggatttctaccagctgatgtaaaattggacaagaagaaagccattgcactcctggagcaatttgcttccatgactggcataccagaggatattattccagttgctgttgagaagtacacaaaaggtagtgatgaccctgatcagatcagagagggagttctcgacgcaatgggggatgtggcatttggtgttccatcggtgattgtgtcccgtggccacagagacactggagctcccacctacatgtatgagtatcaatactacccaagcttctcatcaccccaaagacccnagaatgtagtaggagaccatgcagatgatgtcnactctgtcntcggtgctccaatttttaagagagggtgctccgaagaggagttcaatct

SEQ ID NO: 593872 - DNA, 329 bp, Homo sapiens
tcagagatgttgagacgttttcagagtaatggaagaaggcatcaccttctctagctaggaaaagggatagagctgcgtctacatgtgtgagtggtgtccgaagcagaaagggagctgtcgtcattgcaggggccagccgatgcactgccgttaggaaatgccatttgactcgacaaactgggttatggtagtagctgatgaagaagatgaggagccaggatgtgattcctgttttctagctagagaaggtgatgccttccttcgcattactcagagatgttgagaagctttcagagatgcttgttgaaaatgaaaaaagataagataaa

SEQ ID NO: 593873 - DNA, 573 bp, Homo sapiens
  misc_feature (573)..(573): n is a, c, g, or t
tctggtattttaaattttcttactgggtccctatctctaaaaaaaaaaaaaaaaaaaaaaaaaaaaaaaaaaaaaaaaaaaaaaaaaaaaaaaaaaaaaaggggggggccaaatcccccgggggggcgcagattagtcgtcacacccctttttgttgtatagaaaagaagggtcccaccttgaagagggccgtatttatttataaagagcgcagacgccgcggcgccggtgttaacacacacgtcgagacgcagggacaacaacatctgctcagcgggaatctttttggggggagaggacaacccctctatcttgtgtgggggggggggggcaaaaattggtggagaagaaacatcctcactctacagagaaagtattatataaaagtctcatcagggggagagaatattataataacattttgtcagttggtggtatatatgtgtggtggttaaaacacaaggggtgataatattgatgtgggtggtgggggtaagagataatttggtgctataggagggattgtgtttattatagaaagtttttttaccgaggaggggtattgtgaataan

SEQ ID NO: 593874 - DNA, 291 bp, Homo sapiens
ttcgacggtgtctgcagttacttccttcccgtcaaaatttggcctcctatgattttcaatatatatatatttttttggtcttactctgtggcccaggctagagtgcagtgacgtgaccttggctcactgcaacctctgcctccggggctcaagcaatcctcccacctcagcctcctcagtagctgggaccacaggcatatgctacaaagcccagattattttttatagaaacagggtttcaccatgttgcccaggctggtcttgaattcctgggctcaagtaatctaccca

SEQ ID NO: 593875 - DNA, 548 bp, Homo sapiens
  misc_feature (77)..(77): n is a, c, g, or t
  misc_feature (528)..(529): n is a, c, g, or t
caaaacccattgaaaaaatggtgttcctatccaaaattactgaatccttcctgtgggggggttccttgtaagactgnattgcagcctaggagtctctggcctttggtgcatgcattcttacttttgttttcctttatttgattcattctttttggttctagaacacaacagttccctattctccagagaccacccaagttggtgataaggaaatggagacctcctactattcactgacctctcagaagaataacctcagcaaatgccgcctctcccccaacagggtggcagtattttaaaaaaaatgtttttttttttttggtttgttaaagcagtttctttgtcttaaacatttaaatgccacttgaaagcaaaaacaaatgctggtgttacagagtaaactgctaatattttatctctgggggatgaaaataacaattattttgactttcttccttgtacattgctccttgatttttttatgcactgcatttaaattgaaaataaaacaaataaaaatcaaaaaanncgctctctgccacaaaaaa

SEQ ID NO: 593876 - DNA, 517 bp, Homo sapiens
  misc_feature (4)..(4): n is a, c, g, or t
  misc_feature (24)..(24): n is a, c, g, or t
  misc_feature (497)..(498): n is a, c, g, or t
tatnaattgtcccgggaaagctanagtccattctgttctgcatcagtagaacccatacctgtttgccattgtgagttacagatgacagaatggtcctcagtgtcttgaagcccattgcgatgtccaatagaacacaacagttccctattctccagagaccacccaagttggtgataaggaaatggagacctcctactattcactgacctctcagaagaataacctcagcaaatgccgcctctcccccaacagggtggcagtattttaaaaaaaatgtttttttttttttggtttgttaaagcagtttctttgtcttaaacatttaaatgccacttgaaagcaaaaacaaatgctggtgttacagagtaaactgctaatattttatctctgggggatgaaaataacaattattttgactttcttccttgtacattgctccttgatttttttatgcactgcatttaaattgaaaataaaacaaataaaaatcaaaaaanncgctctctgccacaaaaaa

SEQ ID NO: 593877 - DNA, 1073 bp, Homo sapiens
cacgcgtctgatacaggtcacggggacccttcaatctgcagtctccattgccaatggatgaccagtctgaaagttatgttgaatgcaaacgttacgtgtctctcgctccttcctcctttcgtttccaagacagtgggtgtggacctagtagccttgtgccacgcggtgtacatcattggggtgaagaagttggaacctgtagtgagtgtctaaatgaaacttggcttcttggatgtacgctgtggagtaaaggagtgcgctcgacgttgtctacctgtctgcaccagctatgtgccgaggggatgctttgactagtcgagtgttacgagtgttgattgcgacaaacttgaacgctacgtagctttgtgtggacgggcttggctctgggcctctctagggtgagaggaagccttgactcgattgacttgcaataaccatcgaaatagcgcccaattgcatccattggaacgttggggcgttttcaaggatatctccccgatatggagcatgcacacttatttcctaagcgtatgtacgcctatttggcagcgaacgcattagttaattgaaatcagaaaaaccgccggaacgccttagtctacggcacaaaactttggtatggcagggcgtaaacctatggggaaggaaagtcctatggaggacgattaaccaaagacgctatacaattaagtagaccccacacgaagtcccttcaggcgcgcacccaaggctttaggaacctatatcccataatacaaagcagttagaaagagccaactttgtggccgggtttcccagactcggcggcgtaaaaactcaatggacaatagggattggcgcacaccaattggggacccagcatatgttatcgaacagcggaaaagagaccatgggctgggcgacctggcaggctagaacacgtgtttgtcccccatactgtccaaacaaaggaccgggggaagggccgattttcccctttgtgataagcgtccaagggcgtattaaagatcgctggaaagaggaaatcaaaaaagcgttttaggacaggacgttggggattggacacttttaga

SEQ ID NO: 593878 - DNA, 164 bp, Homo sapiens
tatccccatgtagtgaatgcagaagaaatgacagactattactatattcgacacttgaatgaaataatgtgatctaggcactgataattgatagatagctgaaatacattaggtagagaggctgatgcaggaactttataattgctcggatctaagtgcctcgt

SEQ ID NO: 593879 - DNA, 105 bp, Homo sapiens
cgttattaaaaatgcaccttggccagttgtagtggctcacgtctataatcccagatactttgggcagctgaggctgaaggattgcttgagactcaggatttagag

SEQ ID NO: 593880 - DNA, 374 bp, Homo sapiens
aacgattagagtcctagcatactcagagtgcataactggagacagttggcggcttattatagaggagcagaacgtcagagcttactcctctacttgaaagaggtagatattacttactgtgccgagctacatagatgcctctgttcccgagatgttgatgcatcccgtcaaccgatgagcctggggcagaccttttgagacaaggtcatgagatggttccaggccatgctgcagcggatgcggacctggtggcacggggttctggcctgggtgaaggagaaggtggtggccctggtccatgcagtgcaggccctctggaaacagttccagagtttctgctgctctctgtcagagctcttcatgtcctctttcca

SEQ ID NO: 593881 - DNA, 591 bp, Homo sapiens
tgagcggtgctacctgtccgtgacgaccgattcggagagggccccctaatctctaatcgtgcccgcaccagcagcgctggcagtcagggcgcaggtgggggcaggacgggtgacttggcagacagggacggctgaccgggaccgagaagggcgcacgtcaccgtggcgccgtcctgcgcgtgtccgtatgccaccgtctatggtggcagaagagaccgacacagggacacggctgagaaggggacacgccaccgaatcaccggtgagaggatcaccagaagaagaccgatagagagggtagagcggccagggacccacgaagccgcgataggacgcagagtcacatgatagagagcacaacatggtgctgaacaacgagacagtaatacaagggaagcagtgcgtcatagaacgaggaaaggagaaaaacttacagtggtccagcagtttcaatcgagttgttatacacacacacaaacggacatagggaaaagagaagacgcacaacaacgagaaggatatgagagcaacgagacgatacaccgattgatgtggaagtgagattatggccaaaacacattgcataaagcg

SEQ ID NO: 593882 - DNA, 134 bp, Homo sapiens
gaactgatatttataacacattagtggcaaaagagagggtcttcgtaattgacgggaataagcacgctctaagggagaaggatctgcttgtactgtatactctccaatatgagaccttccctcctcgtcgattt

SEQ ID NO: 593883 - DNA, 501 bp, Homo sapiens
caagccacccgggcgattgtgacaagctggctgaagtcggtgcgctgtgcacaccgaaaccatcacccacagctacatgcactgctggcgtcacaaaaccccgctgatctaccgcgccaccgcgcagtggtttatcggtatggacaaagagccgaccagcggcgaaaccctgcgcaagcgcgcgatcaaggcgatcgaagacaccaagttcgttccggcctggggtcaggcgcgcctgcactcgatgatcgccaaccgtccggactggtgcatctcacgccagcgtaactggggcgtgccgattccgttcttcctgaacaaggaaagcggcgagctgcatccacgtactgtcgagctgatggaagtggtggcccagcgtgttgaacaagaaggcatcgaagcctggttcaagctggacgccgccgagctgctgggcgacgaagcgccgctgtacgacaagatcagcgacaccctcgacgtgtggttcgactccggtaccgc

SEQ ID NO: 593884 - DNA, 383 bp, Homo sapiens
agtggatgtggataaatagaaataaagctatgacaaattaattcagaaatctttccactcacgggtagatatcaagtggggggtcatacaggaagaagtctggaaacacgatttacagtaaattatgataatttgggatagagactgtgccattaagagttgttaaacagcatgattcagacagctctgtttttccagtgacgtgcctattcctttatggtatatgtgtacccaagtgatgctctcacatttatcttaagtccctattattaatatacatttaaagtctcccgaggtttggttgggttggctttggtcctttttgggagtgatttgaagcaaagttaattgtggaacctatttatagacatctttctatactt

SEQ ID NO: 593885 - DNA, 346 bp, Homo sapiens
  misc_feature (1)..(1): n is a, c, g, or t
nctcctccttgatgcaatgtgatactcttcaactatcctctgtgcatatagcatggttatgaacacctttggctggctgtccctatggtacatgttcacatgtaataggctcgcacccctcatgtctcaggctaatgcagctgttggtacacaactgataatcttggagcatatggtggctctggaaagagagtaatgccctgattgtcaataggtggttcggcatggcatttacagatgagatctccttacattgcataagggttaggactgtcatcaggtgctctatcgtcacatgtatattgacacatctgtctccacagtatttgagcaatctgtactagag

SEQ ID NO: 593886 - DNA, 203 bp, Homo sapiens
cactgcctagtactaaatacgacacggacgatacaagtgacactgcagaatggatcattaactcagttatgagatacctttgaacactcgctcctctcatacttggatacctgtggtcattctagagctaatacatgccgacgggcgctgacccccatacgcgagggggatgcgtgcatatatcagactcaaaaccaacccgg

SEQ ID NO: 593887 - DNA, 437 bp, Homo sapiens
gtagtttagagtaggatgacattagttcttttgtaaatgttggctagaatttagcagtgaagccattgggtcctgggtttttctttactgggagatttttttattatgcattcaatcttcttacttgttgttggtctgttcaggttttggattgctgcatggttcaatcttggtactttgtgtgtatctaggaatttaagcatttcctcgagattttcctatttattggcatacagttgctcacagtagccactattgagccttagagtttctacagaattagttgtaatgtctcctttttcatttcgattttactcatttgggtcttctctctttttttcttgggtagtctagttaaaggtttatcaattttattttttcaaaaacttttcataccattaatttttattgttttcttcattgcaatttttaaattt

SEQ ID NO: 593888 - DNA, 1702 bp, Homo sapiens
gtcgctgtcgctgcggcgagagcgcgattccagaagcggcatcgcggcggcgtgcagcaggcggcggctacaccgggcttgggcgacataagagtacatcatagcagctagctgtgcccatggactgcaaggccgataacaaagaggagcaacgtggagtacagagagagaagaagacggaaagacgacccacgcagaacgactggcaccgagaacagaagacacaggaaaacgagagccacaagagcagccccaaaacagcagtccgagaccacagaacaggcaccaaacaaggagacacccatgacaacaagagaacgaaacgaactcaccagagcagacaccaagcacccaaggacagagcccaaagagtacacgagacagacaggcccccagcggcaccccaagcagcgcaagaaagggaccaccaaaagacacccttgcaaccgtaaccactgcggacgagcccggaggacgtcgaaagaggacgagctaccacacagaaccgcgagccagcacggagcacctggggagtggaccccaaagggacacacgaagggcacaggaaggaacgcaggacccgcagggactaggaccacagacacggcaacgcccggacagagagacagacaagaccagagagaagaagaagggagacaaaccagaagaaacgtagcaagaaaagcagagaaagaccgagcaagcagacggcatgcaccagcacccaccaaagcacacaccacaccaacacgagagagcgagaaaacagaggaacactgcaaagacgcgacaaggacgcgcaagcgcaatggacatggagaaaacagagaaaatgagcgagcacagaagcagagacaacgagacaagagagcgagcacacaacgggcggacaacagagaacgaagagaggagccgccaccgagagacgccgagacgcgagcggcactgaaacacacacaagcagacacaacgcacgcgcgcgagacacggacgcgacgaaccgcagaccaaccgcgacgacaaggacacggcacaacgagagaacgggaacccagagacgagacgcccgagaacgaccaagcctccaggacgggtgaggaccagacactaggcagaggggacacaaccagaaggacgcaggacagagacgaaggacgcccgacgacgaccgggaacagtgcgacacgcaacagagagaggaggagaagaggacggacggacgccgaggcagacaggcgacgacggcagcgggcacaagggaccgaggagacgacgaggggacggagagagcggacgccgaagcgcgaacaccgacagaagacagcacgacgccagacgaccacgcaagacggagcgcgcagaggcgagcgcacagagaggggagagcgggaagaagagaagaacggtgcggcgtccggcgaggagcgcggcgagggacagcacagagcgcagaggagcgacagaggagagagagcaggcgagagcgagcacggagcagcgaggcagaggcgaggcaacgacgcaggacgagagtgaggacggcagcgagagaagcgaccggacgcgacgcggggagagagcgagagtcgcggagcggctgcgtctcgcgacgccgcgacgccaccaccggaggacggcagcaggacgcgcgaacgcgacagacgacagcgacgagggcaggaaggcagagcaagcggacccc

SEQ ID NO: 593889 - DNA, 843 bp, Homo sapiens
agggaattacacaaaaataaaagaattacggcttcttacagacaacaagtacgattatcttataggaaaaacaacaaatcactggctaaagtatcaagacaactacgagtacacatgacacacggctgtccaacagctacgtttttacatcactgctgctcaagccgtgtccctaatataccccttagacaactgtgttaactagatgatgagcaacataataacacttaacatcttccctactcaactaccatcctatacacacaacactccaaactcagcatgattacatcctactccaactttatgaccaacccgtgtctcctgcaactgtcgacacgatcgcgcacaaccctgtgggacttatacacagcccccaagcatcgagaatcacccggaataacactactccggacttatattacccaacaacactactttaccaaagggcatattacgatctagcacttcaacgggactcttacttatctcgcggctcaaaccatttctcaatgtggactcaacacactatcctccctctgcacaaaccgtgccgattacacctaacaccctgggctggctttacgctctcacaccacaaaggccacaaaagcgcattactcaacaggccttcctgcaccaacaactcatttcacaccctctcgcaccccatcatctcatttccaccattattaccacgaaacctgcgacaacaaccgcgaaccttacttgctttaacaccacacatcggctcacctaacacactctccctggcacaccgcggcacaccttatccttcacaactaacacataccacaacaacacagaaacataccacaaacc

SEQ ID NO: 593890 - DNA, 418 bp, Homo sapiens
  misc_feature (29)..(29): n is a, c, g, or t
  misc_feature (151)..(151): n is a, c, g, or t
  misc_feature (154)..(154): n is a, c, g, or t
  misc_feature (212)..(212): n is a, c, g, or t
  misc_feature (218)..(218): n is a, c, g, or t
tcttattaccttactgacccaatccctanaataggaataacacatttgatctttaatacaagtatgtgataggaacatggcttctataagcccaaacttggcaatttaaatttaaatttattaaaattaaataaaactggctgggtgccangtntcacgcctgtggtcccagcactttgggaggccgaggcggtgaatcacgaggtcaggantgcganaccatcctggccgacgtggtggaaccccgtctctgctagaaatacaaaagttagccgggtgtggtggcatgtgcctgtggtcccagctgctcgggaggctgaggcaggagaatcgcttgggcccgggaggcggaggttgcagtgagccgagatcgcgacactgcactccagcctgggtgacaagagaaagactatgtctc

SEQ ID NO: 593891 - DNA, 875 bp, Homo sapiens
gtgcacgtgctcgagatgacactttagtgattcatgggatgcgtatctatcattgctactatggtccatagcattcgttccttaagcgctcccaggtgtcggtagccgctgggctaggcctgcaatgagactgattaactcacctcgatgaccacttgtgagcgagtagagtgcccgacaacgcgtggagaggcgcgactacaacaactagtctatgtgacggtgacggctaaacactacaattgtgccgacacaacgggttgaaactacacgctctgttactgccgtagtgaaataaaattgactcagacaaaactatactcacggcagacatagtttgtgaacacaaatgcccggtgtccacgattcctccacagcgtgtcactgcgatagaggcagaagcgtagataggcgcgcctacagccagcacattcaggatatattggacaaaacaccatggagtgccagacgcttcgacacactcgctaatgcacacagtgccagacccccaaacaacttcaaacctgctcacaacgtagctagaagtacacaaggagatcgatggacaagcacaaacgccacagcaaggagatcgaacggcaccatacccaggtggatattcaacacacaactatggagcaagacgacagacactataacagcaaaccagcgtgaagacaacgaccccaccacgcaagccgctcggtgagcgataacacaaagagaaaaatagaaccgaagcagcttggacacacagcaacgagggggcgcaacatacacatagtacaccataaaaatcagaagagatcagagagacaccccaccgcacacgcagagctacacagagacgacaggcgacagcagaatggagcaag

SEQ ID NO: 593892 - DNA, 119 bp, Homo sapiens
cttatctccacaaacagacatgcaggagaagatattgacattgaatttatataaattcaatgtcaatatcttctctgtatgtgtgttggggtggttaataacctgtttgtgggaggtag

SEQ ID NO: 593893 - DNA, 89 bp, Homo sapiens
gactgaaaacaagacaagtttattttctcacagtcctggaagtcacaaatctgaaatggctcactcacaaggggttggcaggaccgcat

SEQ ID NO: 593894 - DNA, 152 bp, Homo sapiens
actgagcagacgctccaggatctgtcgccagctcctgttctgagggagagcagagaccatgtctgacatagaagaggttggttggaagagttaggaggaggaggagccaggaaggaagccagcctctttgaaggagccaggaggaggccacc

SEQ ID NO: 593895 - DNA, 427 bp, Homo sapiens
  misc_feature (359)..(359): n is a, c, g, or t
attaccgagtctcactaattatgacaagtcgcattagcaaaggcctgtctcttgagcatgggcaggcccctgtcccagacataggtacccccaatctcactttggacagagcctacgtggggggaattctcccgggcctgggcctgtcgagctctgactgccgaggacccttccaattgtgctcaaatctatagcattttgttgcttccaacaatttatgggtgtttgcgcagtgagtggaatctggtgggcctgacccctaacattgaccttgtgcatccctgagagagtgggcagagaatccaattctcatgaagcgcgaagtcggggtgtctcatggatgttgggctcagggctcnctgaaggacttcaagtttagagagtcaatgacacttgccaggacagcagagctggccccgccgtgagg

SEQ ID NO: 593896 - DNA, 369 bp, Homo sapiens
gcagtaagaaacacatgtgacattttacagaaatgaataatggatcagaggcatttgcccaacaacagtgaaaatacagcagagaaatgaaagagtgataggatgtaatgaaactcaggtagaatataaatgaagttatacagaagtagctggctgtggaactactgacattacacgttttgaagagactgaattcatagctggaggaacttggtcacggtgagatctgcaaccaacataaatgatgaaagtgattctgttgaagagcatgaagctgtctcagaggccgtggtgctgtcagcaagacctcacattcattaaaggaactctaggagatagttgagaacattgaaaagcaccagggaacca

SEQ ID NO: 593897 - DNA, 139 bp, Homo sapiens
gcggccgcctactactactactactactactgctcgaattcaagcttctaacgatgtacggggacatgctcataaggaaaggttaaaaaaaaaaaagttgtactgcaccagcaaatccatgatgatgatgatgtcgacc

SEQ ID NO: 593898 - DNA, 244 bp, Homo sapiens
gttcacgcccacaagactgcaggtggtggctcgggtgagggttccagcagtgaggctggagattgaactagaaggacctggaggtagattctgaaggcagagctaacaggacttcttgaacttcatcaatgcctcccctctacagtgacaggtatggtggctcacagctctaatctcaacacttagggaggccacggcgagaggactgcttgaggccaggagttcaatccatcctgggcaatat

SEQ ID NO: 593899 - DNA, 199 bp, Homo sapiens
catggattcggttgggcgcggccagtagaatggaaggtatagtgtctagagatctgtctgactatgttggatctacaataaaaagcccgtggacgacgtctgaaaatccagatgatctgagtctatggtctataaggagtcacagtcgattaatagcgccctgcaggaaggtggaggaaaagaacttaacagcggcgag

SEQ ID NO: 593900 - DNA, 327 bp, Homo sapiens
actgtcacgaatacgtcgcgaacattttatcgttagacagtaggagactatggggcgcaatatatgtgttttcgagatacacgatagattgcgtgatatgttggacctaataagattgtcgatgctggggattttatattcgtagtgtatagtgaattcccgtcattaaacacagggcgaacggtgtgccacacgtgcgtattcgatgtacaaagcctgagactagttcggactccccttcggcaaggtcgaagggggttcgcattggtctctgctaatgtaggagataaatcatattatggcccagggtcatgatagagcaggtgg

SEQ ID NO: 593901 - DNA, 127 bp, Homo sapiens
ctggaaggcgcagaaccaccagatgactttgagcgtgtacatgcggaggtctacactcatgcctgtgcagttggagagaatggcagccagcgccgcctacttcaggagcccataaatcaggatcttg

SEQ ID NO: 593902 - DNA, 231 bp, Homo sapiens
tggtacctgaatgggctctggggtactcttcatctccatacagtagagatgctgtagtggcccttctcggctgggcacataattgactggtcaatggtgctgcctactcatgatgccagcaaggtgaagtgccagtggccccgtggctcaacaccactgtgcgtgcctgccagccaacctgtggactagttggggatcctcttagaagtctgaccttgcatgtgcatgcaa

SEQ ID NO: 593903 - DNA, 714 bp, Homo sapiens
atttaccatctcacttctaggaatactagtatatcgctcacacctcatatcctccctactatgcctagaaggaataatactatcgctgtgcattatagctactctcataaccctcaacacccactccctcttagccaatatggtgcctatgtgccactactagtcttgtgccgcctgcgaaggcaggcggtgggcctagccctactagtctcaggtctccaagacatatggcctagactacgtacataacctaaactactccaagtgctaagaactaatcgtcccaacaattatattactaccactgacatgactttccaaaagacacgatagttggaatcaacagaacacccacagcctaatttattagcatcatccctctgctattgtttaacccgaaatcaagcaagcaacctattgtagcttgtccccaaccttttcctccgaccccctaaaagcccgcctcgctaatactaactacctgatcctacccctcagaatcatgggaggcaaggccacttatccagtgaagcaatagcacgaaaaagagtctacctctctatactaatctccctacaaatcgtcctcagattataacatgcacagccacagacactaatcatatttagatcttcttcgaaacaaacttatcccacgtggttataacaccggggggaccaggcagaagtgaagcggaaatattctcatttaacg

SEQ ID NO: 593904 - DNA, 431 bp, Homo sapiens
aattttagggactaggttttgctatgttgcccaggctggccttaaactcctggcctcaaggtgatccttctgtcttggcctcccgagtagctgggactagaggtgtgcaccgtcacacccagcttcaagtctcttattataaagttctggccacgcacagtggctcgcaactgtaatctcagcactttcggaggccaaggcggtcagatcacctgaggtcaggagtttgagaccagtctggccaacatggagaaactccgtctctactaaaaatacaagaattagctgggcatggtgcacacgcctttagtcccagctactcgggaggctgaggcaagagaattgcttgaacctgggaggcagaggttgcagtgaaccaagatcaagccatttgcactccagcctgggcaacacagttgacccgtctcaaa

SEQ ID NO: 593905 - DNA, 900 bp, Homo sapiens
ggttcataaccgctggttttgacagaagcacccaatgtgtcttggtggcccccaccccgaggaggaaaggggcgccgccgccccgggaagaaacacgggggtgggccgccgttttaacacccgggggaacacgggggtcccaaaaaaaaatggcaaaatgggcgcacagttgtgccccgactctaacagccccaaggcgcggcacaccccacgttgtgtggagaagtgtggcccgcaccccggcctttcaaaaagggtggtcgcaccaacactatagcacacgcgcgcccacacgttggtggcgcctgtggaggggggacccgggccccacaaggtcacaaaagagacgcgcgtgaggcacaagtactggggcgcacccaccgcccccacggcccatttgcactgtaaggcgcccggggggtcccgctggggacaaccaacaggttgaccgcccggagaggtaaatcccccacaggggggcgcccgcttgtggccaaacactgaggaaacacactggggggacagcggcgaatctgacaggaaaacgccgaccagttcttctccacaaaggcgcccccgggaaaaaaaaaatggcgcgccgccctcttgcgagaaaaaggacatttatatacagagaacggctcgtcgggtaggaatttccttaaaaagaaacgggtggttggcaaaaacgaggagggggattctcaaattatcccctccctttgggcgcgccacaaagtcacataggtgccgcccaattttccctgctcgcgttatgatgagccaagccgttaaactttctgggtatgaatggggtcaccctggggaaacacaatctgttccacaaggggaacccggaaaaattgttccccgacaaattgccccaaacctccccccaaa

SEQ ID NO: 593906 - DNA, 412 bp, Homo sapiens
  misc_feature (390)..(390): n is a, c, g, or t
tgaaacggggtctcactgtcacccaggctggagtacagtggcttgatcttggctcactgcaacctccgcctccctggctcaagtgatctttccacctcagcgtctccagtagctggggctacaggcatgtgccaccatgcctgtctaatttttgtattttttgtggagacagggttttgccatgttgcccgggctggtctcgaacagctgggacttaaggcaatctgcctgctttcagccccccaaagggccggggattacagggtgtgagccactgtttccccagcctccctaaggctctttaacatgtttaaacaggcagcactagtttgaggtaacctttttaaccccaaaatggcttttgggaccatatttatttgcgggattttntgactttttttcagatttttgg

SEQ ID NO: 593907 - DNA, 484 bp, Homo sapiens
gttgcccaggctgatcttgaattcctgggctcaagtgatcacctgccttggcttcccaaagtgttgggatgcaggcgtgagccactgcatccagtctccaaactgctttaattaacctgtttgatttttgtatcttcttgtaaatggtacagataatgatcttgtatgctactcaaaaattcttcatataaataaattcaaaaattgaaatgggtggcattcacgagcattttttgggagctttaaattatcaatttcataggtgtgtttcctttttttcctttaagcaagcaacctgatatctagcatagacctggccattaaataaggatcttaaatttgcagtggattaaatcttaggtttaaagagctgacaaaataatttggctgtggttaacagtctacctttaaattaatcgttttaaaactattaataaatttgctgtccaatattttgttgaaatctgaaaaaaaagggcgtggt

SEQ ID NO: 593908 - DNA, 132 bp, Homo sapiens
acaagatgatagatacaatcatgaaccaggatatactcgccatactgcaggcacaagtgcgctttggtggggatcaggtactgctcgcagtaagtacgaaggtggttcatagtacagccacagcagatgaca

SEQ ID NO: 593909 - DNA, 421 bp, Homo sapiens
gtgaatgtcagtgggtgatcagaataaattgttggagttattagaatgtacatttgagtaggtttcagtttgactagaaataattggcaagaaggcaagaactagtcttctagagcagggatcccatcccccaggtcatggactggtactggtccatggcctgttagaaaccaggccacacagcaggagatgagtggaaagcaagtgaaagttcatgggtatttacagcaattccccgtcgctcgcattaccacctgagctgtgtctcctgtgagatcagcagcagcattagattctcaaggagcacaaacccttttggaactgtgtgtgagggatctaagttgcgcatttcttatgagaatctaatacctgatgatctgttgttgtctcccaccacccccagatgggaccatctagttgc

SEQ ID NO: 593910 - DNA, 497 bp, Homo sapiens
  misc_feature (239)..(239): n is a, c, g, or t
ggggaggccgcacagatgcctggagttactgtaaaagacgtgtaccagcacggagttcgtcagaagcttctggcagccttccatcaaaaaagtcacgggaacgctgaaagtccccgaatgggtggataccgtgcaagctaggcacagagcacaaagagcgttgctccatatcgatggagatacataggttcttatcatcgcgacgctgcttccacagacgtcggtcaccttgtagcctnccggggtggcagctcgggggtctgtgctgcgcatgagcgcaacgaatctatgggggacgtgcatgagaaacggcgtcatgcccagaccatcttcatgccgaggctccaagagtgtggcccgctcgggtcctcaaagccgtggaggggctgaaatatggctggaaaaggaccatatgatggcggccgtaaacctacagcctgagagatcaaagacgattctgactacgaatagattacacggtggcagctgccacaata

SEQ ID NO: 593911 - DNA, 192 bp, Homo sapiens
gtgccgtacacaccacccccgggcttcctcccttctttagtctaccttgtgtgtgggccggctgccggggccggagccacccctctccgggacctgttgcgtgtggtgtaccacgggtcggcgtcccctggtggtctgctgacacacagacccccttggacttctacccgccggactggggtcccggcgctc

SEQ ID NO: 593912 - DNA, 223 bp, Homo sapiens
acagtggggaaagggggaaatagggagtgactgctaatggataaggagtttctttcgggggtgatgaaaatgttctgcaaacagcagtgatggttctgaacagattaaaaatcactgaactgtatactttaaaagggtaagttttatatgtggatcatatttcaattagaagaaaacattgtgcattagaaggatgtcaaaatggactttcatagctcacaat

SEQ ID NO: 593913 - DNA, 162 bp, Homo sapiens
cgggaggccctggaccagctccgagagctgtgtcaccagtggctacagcgtaaggcacgctcaaggagcagatcctggagctgctggtgctggagcaagttcctaggtgcactgcatgtgaagctccggacatgggtggaatcgcagaacccatgagaactg

SEQ ID NO: 593914 - DNA, 688 bp, Homo sapiens
agcggcttcttctcctggcgctcgcgtgcgagagggaactagcgagaacgaggaagcagctggaggtgacgccgggcagattacacctgtcagggccgagccgagcggatcgctgggcgctgtgcagaggaaaggcgggagtgcccggctcgctgtcgcagagccgagcctgtttctgcgccggaccagtcgaggactctggacagtagaggccccgggacgaccgagctgatggcgtcttcgagcccatcttcgtccgcaaactcctcgaacgcgggagcggaaaccaagtaacaagttaactggggcccacaaaaggttgattactgtgtgtgcggtgtggccctgtggtgtgcaccagcaaaagctggggctcaagatctggcggcttcgttgcaagaggaccaacagccctggacagagcaagagtcgaccttgtgagtgccttcacaggcagaggcaatcctccaagaaacctgctttcctgtgaacaacagcgaccgggatgcccgcttccggcgcacagagactgacttctctaatctgtttgctagagatctgcttccggctacgaacggtgaggagcacaccgtgcaattcctcctggacgtggtggacatactcctcacctatgtccgcaagcacattcgatcgctcaccaaggtgctggactatcatcacccacacc

SEQ ID NO: 593915 - DNA, 273 bp, Homo sapiens
aaatttgggaaaaatgtgaaaatagccctgttttaaaaaaaaaaggtcgggggccccctggcttcccttatggtgcaggggcaaaaattccaggcaggaggttctgtcatccctcctttaaatttgcccatgaaacgttttgtcaaaaacctgggtctcttttctgttcaggcctctggtggcccactggggatatataatggaaaaactctggtattttaggaaagccactggttcataattaacgtgattaaattagtttggccctatgga

SEQ ID NO: 593916 - DNA, 266 bp, Homo sapiens
  misc_feature (27)..(27): n is a, c, g, or t
  misc_feature (29)..(29): n is a, c, g, or t
gatcaggtgatcctgccttatccttgnanaagaagtgttatgcaagaggccaagaagaagctaaacaaacatgccatgatggattcccatctcagcttattaccatcgggacatgtcctttttgtccaatcacatttctacatggcagtacagtcttcatcaaacctaagcattaaaaaaaaagttttctctgggtctttgggtcttttgtttcggaaggctcctgtattacataaaactttgttaaataaatttgttatactttt

SEQ ID NO: 593917 - DNA, 802 bp, Homo sapiens
  misc_feature (390)..(390): n is a, c, g, or t
gagaactggacgcttgtgaacagagttagctgattgccagtgaacttcctccaagaagaaactacagaaattctgacaggttcctggtctgaccgaaacatatccagaaggcacccaggctatctataaatgccgccctggtatatagatctccttgggaaactataataactggtatgccaggcaagggagaactggcgttgctcttcaatccattaacggacaatgtcagaaacaggccctgtggaccatcctgggagatactcctttcggtacatttatacccgttacaggaggacaatgtgttccaatcatcggtgtaaccagctgtgtatcacatggtaatgcacggcggtatcaacattagctaggctgagaattgatctaccngtgaactgtgacactagatggcatggccccaatgatattcctcatatgtgaagtttgcgcaagtgtgttaccaggtgacagctaccatgagaactggataatagacttcgtccggtagtggcaggtggaaccagatcgggcaataccatgtttggacagagcagtcacggtctggtaatgctaactcaggctacaagacttgcacggagcatgaaggacattgcattgtccagaccgaggcggtctcaggacgctaacagagaagcccaaacgtgtcgtgtcagattgcagtgcagaagtccccaagactgttccataaagtggatctcctactatctcagaaagattactccataaggacgactgaacgatttccatatacatgtaacatgggttatgactaccgtgaaca

SEQ ID NO: 593918 - DNA, 1835 bp, Homo sapiens
  misc_feature (602)..(602): n is a, c, g, or t
  misc_feature (672)..(672): n is a, c, g, or t
cgcaggcgggcgggagggcgggcacggagaggcgggcgccgaggaggggcaggtagggctgggacgcaggggtaactggatcccccgacttcagcccaggccctggtctgaccaccctgggagcagggactttccacagtcagctggacgcacactcagcccagtaaaagaggggacccatcccgggagccccggggagggcacagctgcctcctcccgggctcccctgccacctggtgcctacctgccccctgctccctgccgggtccggtcctcaccccatcttcatctggccttgactctgcccttgaggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggctcctacgacagcacatcctcagatagtttgtatccaaggggcatccagttcaaacggcctcacacggttgccccctggccacctgcctacccacctgtcacctcctacccacccctgagccagccagacctgctccccatcccgtnagtagctgctcagcccctgcccctccaaagctcagcccctccccctccaaactccactctctaccccttnacttttttggattgggggcccctttcccttttgcaactgctgttgccccctgagccccacctcaggcatgacccctgacctttgactcccagaagatccccgcagccccttgggggctcccaccggacgccatcttcccggcgggattctgatggtgccaacagtgtggcgagctacgagaacgaggaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttgagcgtgcgtctgtgtgtgcctgtgtgcgagtctgagtcagagatttggagatgtctctgtgtgtttgtgtgtatctgtgggtctccatcctccatgggggctcagccaggtgctgtgacaccccccttctgaatgaagccttctgacctgggctggcactgctgggggtgaggacacattgccccatgagacagtcccagaacacggcagctgctggctgtgacaatggtttcaccatccttagaccaagggatgggacctgatgacctgggaggactctcttagttcttaccttttgtggttctcaataaaacagaacttaaaaaattgtctaagaaaaa

SEQ ID NO: 593919 - DNA, 2030 bp, Homo sapiens
  misc_feature (797)..(797): n is a, c, g, or t
  misc_feature (867)..(867): n is a, c, g, or t
cgcaggcgggcgggagggcgggcacggagaggcgggcgccgaggaggggcaggtagggctgggacgcaggggtaactggatcccccgacttcagcccaggccctggtctgaccaccctgggagcagggactttccacagtcagctggacgcacactcagcccagtaaaagaggggacccatcccgggagccccggggagggcacagctgcctcctcccgggctcccctgccacctggtgcctacctgccccctgctccctgccgggtccggtcctcaccccatcttcatctggccttgactctgcccttgaggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggtgagtgggaaactggtgggggtacccagggcccagggacaccgacgggatcctcatccactcccagcccctgtgtctgtcctggctctgtccctgcctccgtcctgatcccagcgcctctgagagtccctggatcccagcaccttctgccctaagcaccccctgttcctagctcaccagccctctctttcccaggctcctacgacagcacatcctcagatagtttgtatccaaggggcatccagttcaaacggcctcacacggttgccccctggccacctgcctacccacctgtcacctcctacccacccctgagccagccagacctgctccccatcccgtnagtagctgctcagcccctgcccctccaaagctcagcccctccccctccaaactccactctctaccccttnacttttttggattgggggcccctttcccttttgcaactgctgttgccccctgagccccacctcaggcatgacccctgacctttgactcccagaagatccccgcagccccttgggggctcccaccggacgccatcttcccggcgggattctgatggtgccaacagtgtggcgagctacgagaacgaggaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttgagcgtgcgtctgtgtgtgcctgtgtgcgagtctgagtcagagatttggagatgtctctgtgtgtttgtgtgtatctgtgggtctccatcctccatgggggctcagccaggtgctgtgacaccccccttctgaatgaagccttctgacctgggctggcactgctgggggtgaggacacattgccccatgagacagtcccagaacacggcagctgctggctgtgacaatggtttcaccatccttagaccaagggatgggacctgatgacctgggaggactctcttagttcttaccttttgtggttctcaataaaacagaacttaaaaaattgtctaagaaaaa

SEQ ID NO: 593920 - DNA, 235 bp, Homo sapiens
agcccaagtcaaagcctgacagcagccgcggccgaagtctggtgcccgggaagagtcgtgcagcgactccggcaccatgtgctcctcccaccctgataacttgagccgggctcagtcaggctccagcctgtccttggcctctgcggcgacgccagaacccgagagcgttcattccggggacacaccctctcagggagtggaatagatggaagcgtcgcgcatgggtaccgagctc

SEQ ID NO: 593921 - DNA, 1354 bp, Homo sapiens
cgcaggcgggcgggagggcgggcacggagaggcgggcgccgaggaggggcaggtagggctgggacgcaggggtaactggatcccccgacttcagcccaggccctggtctgaccaccctgggagcagggactttccacagtcagctggacgcacactcagcccagtaaaagaggggacccatcccgggagccccggggagggcacagctgcctcctcccgggctcccctgccacctggtgcctacctgccccctgctccctgccgggtccggtcctcaccccatcttcatctggccttgactctgcccttgaggggcctaggggtgcagccagcctgctccccatcccaagatccccgcagccccttgggggctcccacaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttgagcgtgcgtctgtgtgtgcctgtgtgcgagtctgagtcagagatttggagatgtctctgtgtgtttgtgtgtatctgtgggtctccatcctccatgggggctcagccaggtgctgtgacaccccccttctgaatgaagccttctgacctgggctggcactgctgggggtgaggacacattgccccatgagacagtcccagaacacggcagctgctggctgtgacaatggtttcaccatccttagaccaagggatgggacctgatgacctgggaggactctcttagttcttaccttttgtggttctcaataaaacagaacttaaaaaattgtctaagaaaaa

SEQ ID NO: 593922 - DNA, 1398 bp, Homo sapiens
  misc_feature (5)..(5): n is a, c, g, or t
  misc_feature (489)..(489): n is a, c, g, or t
  misc_feature (544)..(544): n is a, c, g, or t
  misc_feature (561)..(561): n is a, c, g, or t
  misc_feature (592)..(592): n is a, c, g, or t
gtctngcttgggcctagtgtgtcatgtcccctccacacacgccaccaaactcccactgctccgagccgcactacatccctgctccccagcctaggggctgtgctggggcctgaccctttgtgagctctcctcagtcccagtcaagtggacctcctccctccctctccacagcccttgcccttgtccaggccaccatcaccatcaccaacaccatccttgccagcctggagtcccctctcttcattctgtggggctaatgggggtggctgtgtgggaagcctctggggtctaccgttggggagctctgcatggctgaggttgggggttctctgggaacctgtggccaagggtctctggtcacagtgccgaggtgggcctggcttttccacagtggagtccattgatgattacgtgaacgttccggagagcggggagagcgcagaagcgtctctgggtgagtaaccggtgcttgtcggtgcctgcccctgnaccccgctgccccaccatgctctcagtgtgaccagatcccaccctggggctaccnacaccctctgccccctntgtctgggcgtccccttgctctctcgccctnctgacccctttgcgtggctgcccctccttctgatctgtccccacagatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttgagcgtgcgtctgtgtgtgcctgtgtgcgagtctgagtcagagatttggagatgtctctgtgtgtttgtgtgtatctgtgggtctccatcctccatgggggctcagccaggtgctgtgacaccccccttctgaatgaagccttctgacctgggctggcactgctgggggtgaggacacattgccccatgagacagtcccagaacacggcagctgctggctgtgacaatggtttcaccatccttagaccaagggatgggacctgatgacctgggaggactctcttagttcttaccttttgtggttctcaataaaacagaacttaaaaaattgtctaagaaaaa

SEQ ID NO: 593923 - DNA, 219 bp, Homo sapiens
gcctttaatcccgctacaacagggggggaaaattggccttttgattaaaaacgggcccctaggagactggaagtttaaaaaaggacaagccccttcagggaagagggaattgattttttttaaaagttttttttttaaaaagcccaaaaggttgtttttttaaaattttgaaaaggggtgggcccacaaagccccatttatgtttttaaatttttttta

SEQ ID NO: 593924 - DNA, 702 bp, Homo sapiens
  misc_feature (171)..(171): n is a, c, g, or t
tggggtccccaggagctgagggccccaggatcgacatgattctgaaggtgattgtcatgggtgcagggagcaggagctgatggggcagaagtgctagtggccggggtgctgtcaggaagcaccaccaggtagcctgggttgtgatagtcgtcctcatcctcatccgcatcntcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttgagcgtgcgtctgtgtgtgcctgtgtgcgagtctgagtcagagatttggagatgtctctgtgtgtttgtgtgtatctgtgggtctccatcctccatgggggctcagccaggtgctgtgacaccccccttctgaatgaagccttctgacctgggctggcactgctgggggtgaggacacattgccccatgagacagtcccagaacacggcagctgctggctgtgacaatggtttcaccatccttagaccaagggatgggacctgatgacctgggaggactctcttagttcttaccttttgtggttctcaataaaacagaacttaaaaaattgtctaagaaaaa

SEQ ID NO: 593925 - DNA, 609 bp, Homo sapiens
gagaatgtgtaagtgctgggtgctgaacttggatattcagctgaggagatttccaagcagtgttgagagcgtagcctgacttctccttgctgcttatagtaaaatgtgagagacataaggaagaaactgttgagcacaaaggagccagaaagcgaagatgtggaaaattcttggcctaatcatattacaaaaactgcaaaagtgtcccctggacagaacagcaaggctgttcaagcgtttgccccagagctgaggtatgtgactcgtgggtccactcaaccctttcagcagaaatctacaatgaagatggggtaatctaggaagcgtctgtgggaaaactctctgattttatagcttgggcctctataacttgcaaaagagaccaacaaggctcttgagaatctgacaccagcagaaacactgccggcctggagtgaagggggcagagatgagataaagggaaggaagggtggccccgaaggtggggctgtctcgtatcagagcatgggtcattccagcaggcccagaagaaaaatctcaggccaagaggattccctcaggcttgaaaccaatgatttgcctgctgggcttggatgccggtttagcgat

SEQ ID NO: 593926 - DNA, 583 bp, Homo sapiens
gcggccgcctactactactactgctcgaattcaagcttctaacgatgtacggggacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttgagcgtgcgtctgtgtgtgcctgtgtgcgagtctgagtcagagatttggagatgtctctgtgtgtttgtgtgtatctgtgggtctccatcctccatgggggctcagccaggtgctgtgacaccccccttctgaatgaagccttctgacctgggctggcactgctgggggtgaggacacattgccccatgagacagtcccagaacacggcagctgctggctgtgacaatggtttcaccatccttagaccaagggatgggacctgatgacctgggaggactctcttagttcttaccttttgtggttctcaataaaacagaacttaaaaaattgtctaagaaaaa

SEQ ID NO: 593927 - DNA, 329 bp, Homo sapiens
atgtgcttggcctcgtcctcctatgacctcactggttcgcatctgggaccttcagagctggagctgatcggctgaagctgcaggggccacaacaatacgctggcttgccgtgcagcgagtgcttcgctcgcgagctactcgagcgcagaaccggcgatgtgatatggcctgtgtgtgtggtgaccatgagcatgtcattatagctgcggactgagtggctgatgctctcactgtgcataaccactgctggttctgactgaggcgatggtaagtgggcgaagctgtcgagtccactgctttcccagaacggttctgtactgtcccgatct

SEQ ID NO: 593928 - DNA, 1156 bp, Homo sapiens
cgcaggcgggcgggagggcgggcacggagaggcgggcgccgaggaggggcaggtagggctgggacgcaggggtaactggatcccccgacttcagcccaggccctggtctgaccaccctgggagcagggactttccacagtcagctggacgcacactcagcccagtaaaagaggggacccatcccgggagccccggggagggcacagctgcctcctcccgggctcccctgccacctggtgcctacctgccccctgctccctgccgggtccggtcctcaccccatcttcatctggccttgactctgcccttgaggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggctcctacgacagcacatcctcagatagtttgtatccaaggggcatccagttcaaacggcctcacacggttgccccctggccacctgcctacccacctgtcacctcctacccacccctgagccagccagacctgctccccatcccaagatccccgcagccccttgggggctcccaccggacgccatcttcccggcgggattctgatggtgccaacagtgtggcgagctacgagaacgaggaaccagcctgtgaggatgcggatgaggatgaggacgactatcacaacccaggctacctggtggtgcttcctgacagcaccccggccactagcactgctgaactgagggcctgtggaggccgagtctgtcctggaaccaggcttgcctgggacggctgagctgggcagctggaagtggctctggggtcctcacatggcgtcctgcccttgctccagcctgacaacagccaggtgctgtgacaccccccttctgaatgaagccttctgacctgggctggcactgctgggggtgaggacacattgccccatgagacagtcccagaacacggcagctgctggctgtgacaatggtttcaccatccttagaccaagggatgggacctgatgacctgggaggactctcttagttcttaccttttgtggttctcaataaaacagaacttaaaaaattgtctaagaaaaa

SEQ ID NO: 593929 - DNA, 576 bp, Homo sapiens
ggtcctatacaagtcgacagtattttttaactgcctttatatacaaattttaaatatgaatttgcaagaaacatctatcatatgtacattgcggtgttctgaatagatcacattagccacaacattcccttaaaccaaagcctaatccagggcaaagccctaactcttcaactctgtgaaggccaagagaggcaaggaagttggagaagaaaaatttaaagcttacagcggttagttcatgaggtttaaggaaagaagccatctacataacataaaagtgcaaggtgaagcagcaagtgttgatggtcaagctgcagcaagttacccagaatatctagctaagataattgatgaaagtgactacgctaaacaacagattttgaatgtagaggaaacagccttctattggaagaagatgccatctgcgactttaatagccagaaaggagaagttaatgctttgcttcagagcttcaaagtacaggctgattctcttgtaagggtcagctggtaatattgagttgaagccagtgctcacttaccgtgccaaaaatcctggggcacttaagaattatgt

SEQ ID NO: 593930 - DNA, 778 bp, Homo sapiens
  misc_feature (5)..(5): n is a, c, g, or t
  misc_feature (489)..(489): n is a, c, g, or t
  misc_feature (544)..(544): n is a, c, g, or t
  misc_feature (561)..(561): n is a, c, g, or t
  misc_feature (592)..(592): n is a, c, g, or t
gtctngcttgggcctagtgtgtcatgtcccctccacacacgccaccaaactcccactgctccgagccgcactacatccctgctccccagcctaggggctgtgctggggcctgaccctttgtgagctctcctcagtcccagtcaagtggacctcctccctccctctccacagcccttgcccttgtccaggccaccatcaccatcaccaacaccatccttgccagcctggagtcccctctcttcattctgtggggctaatgggggtggctgtgtgggaagcctctggggtctaccgttggggagctctgcatggctgaggttgggggttctctgggaacctgtggccaagggtctctggtcacagtgccgaggtgggcctggcttttccacagtggagtccattgatgattacgtgaacgttccggagagcggggagagcgcagaagcgtctctgggtgagtaaccggtgcttgtcggtgcctgcccctgnaccccgctgccccaccatgctctcagtgtgaccagatcccaccctggggctaccnacaccctctgccccctntgtctgggcgtccccttgctctctcgccctnctgacccctttgcgtggctgcccctccttctgatctgtccccacagatggcagccgggagtatgtgaatgtgtcccaggaactgcatcctggagcggctaagactgagcctggtgtgttcttgcggaggggcaggaactgttgtagctgctttgggtttgggggatagcttgcaagctggagacct

SEQ ID NO: 593931 - DNA, 938 bp, Homo sapiens
ctttggggccagaaggtcgtctgaggaggccggggaggctgcctaccctgtccctttgcctgctgctgggaccatgggggctggggccagcgctgaggagaagcactccagagagctggagaagaagctgaaagaggatgctgagaaggatgcccgcactgtgaaactgctgcttctgggtgccggtgaatccgggaagagcactattgtcaaacagatgaagattatccaccaggacgggtattcgctggaggaatgcctcgagttcattgccatcatctacggcaacactctgcagtccatcctggccatcgttcgggctatgaccacgctcaacattcagtatggagattcagcccggcaggatgatgcccggaagctcatgcacatggcagatactattgaggaaggcacaatgcccaaggagatgtcagacatcattcagcgcttgtggaaggactcgggtatccaagcttgctttgaccgagcctcagaataccagctcaatgactccgccggctactatctctcagacctagagcgtctggtgactccaggatatgtgcccactgagcaggacgtgttgcgttctcgtgtcaaaaccactggtattatcgagactcaattctccttcaaggacctcaacttcagaatgttcgatgtgggcgggcagcgttcccgaggcgcaaaaagtggatccactgctttgagggtgtgaacgtgccttcattttcatcgctgggctgagcgcttacgaaaatgggtgctggggggggcgaacgcaattgaaccgaatggggaaaagctggacctgttcaacaggttgggatcatcgtaattggcccaaggtattgggcttcctcacaagaaggaggtttcccgaaaaaaaggggcctaattgtccgtatatggagattttagagggggaatatagagcg

SEQ ID NO: 593932 - DNA, 118 bp, Homo sapiens
gatctccagaggccggtggcttgtggtgcttaggctcggcacgcacatttcagcgaaggggtatcgccacaagcccagcaccgcgcagtcctgggctttggcgattaccccttcgctg

SEQ ID NO: 593933 - DNA, 386 bp, Homo sapiens
  misc_feature (39)..(39): n is a, c, g, or t
  misc_feature (43)..(43): n is a, c, g, or t
  misc_feature (54)..(54): n is a, c, g, or t
  misc_feature (67)..(67): n is a, c, g, or t
  misc_feature (70)..(70): n is a, c, g, or t
  misc_feature (88)..(88): n is a, c, g, or t
  misc_feature (127)..(127): n is a, c, g, or t
  misc_feature (156)..(156): n is a, c, g, or t
  misc_feature (183)..(183): n is a, c, g, or t
  misc_feature (187)..(187): n is a, c, g, or t
  misc_feature (220)..(220): n is a, c, g, or t
  misc_feature (257)..(257): n is a, c, g, or t
  misc_feature (265)..(265): n is a, c, g, or t
  misc_feature (275)..(275): n is a, c, g, or t
  misc_feature (278)..(278): n is a, c, g, or t
  misc_feature (283)..(283): n is a, c, g, or t
  misc_feature (292)..(292): n is a, c, g, or t
  misc_feature (309)..(309): n is a, c, g, or t
  misc_feature (316)..(316): n is a, c, g, or t
  misc_feature (385)..(385): n is a, c, g, or t
tgactttcaccaatgggtttatttaaaaggaagcaaatnaaanaaaactatggngataacagcagangtntagttataattcatttcnctaatgctgattaatatattcatgaacaaatcaaatgtnttgccaaaagaagaatgccaccattaacnccccagcggctactggtttcagttgtncttntcaatcaggcaaaatgttctttcttaagccccnatttattttacttcctgacagtttcaaaaataattcntcttgggngttgtttccncanaaacncttcctggngcttgattgctttgccnatgtganatttgacttcaaactgccattttacctttataaacatttggaactttctaagcctgaggggaatgcccna

SEQ ID NO: 593934 - DNA, 319 bp, Homo sapiens
gatggaagccctgccccgggccagggccctggtccacccgcggggcctgcgccatatggtcgaccccaaggcgctgtggctgggcgcactggccgtctatggcgaagaggagatgcagcgtagctacggcaagctgatcccggtgccggccgagcgcgcccaggccacgcatgacgagcagatcgtccatctcgccggccggccgctgcgtttcatcgacagcccgggacacgccaagcaccaccacgccatctgggacgagaaaagccgcagctggttcaccggcgacaccttcggcctgtcctaccgcgccttcggc

SEQ ID NO: 593935 - DNA, 152 bp, Homo sapiens
  misc_feature (2)..(2): n is a, c, g, or t
tntatttaaatacatttatttgaaccttcctgggggaggcttgatttgatgggtggtgattaaagcctcccaaagccaatcctggcatggcttgggactcaaaacacaggatctgacgggagggcacaataccatctgaacgcccacaaaag

SEQ ID NO: 593936 - DNA, 597 bp, Homo sapiens
  misc_feature (50)..(50): n is a, c, g, or t
  misc_feature (121)..(121): n is a, c, g, or t
  misc_feature (137)..(137): n is a, c, g, or t
  misc_feature (343)..(343): n is a, c, g, or t
  misc_feature (497)..(497): n is a, c, g, or t
acgaatgtcccacgttcgtcgtaatcgtcgaggtcggactaggaagccgncgtcgggcatttcgcgcaccggattcgatcatcgagtaaggcatgtgtcacgtgcaggtcgccgccaccgncatcgagttcgatgtngaaggtcgacaccacaatggcctcgctggggccgacgatgttggccatggccgggttcacttccgagtttgatgtactcgaaattgacttccatgatcgcctgccaggcttccttcaagtcgatgaaggcctgctccagcaccatgcggtaccacccgcagttcggtgggggtgaattcacgcccttcgatacttggcgtgacggncgtcgcccaccgaaggaagttgtccaccagcttgaacaccagcttggcgtcgaggatgaacagcgcggtaccggcgtcaacgggcttgatcttgaccaggttgaaggctggtgggcacgtacagcgagtgcacgtactcaccgaacttcatcanctgcacgccgcccacggccacgtccgccgagcggagcagcagttgaacatgctgatgcgagtgtagcggcaaagggtacgttgatcatctccaggtacgc

SEQ ID NO: 593937 - DNA, 324 bp, Homo sapiens
aatcctgggggattttttggggggggggcccccccccttgggggggtttcccccggggcccccctttaaaggggttttttaacccccccagggggggtggggccttgttcccccccttttaaaccttttgggggcccaaatttggggccaattttgggggggtttttaaaagtttaggggcttttgtggggtttgggggcttttccaaccttttttttggggcctttgccccgggggggggaattcccttgcccttttttacccctggtttggggggggggaaggccctttttttttttaaactttttttatttgggcccctta

SEQ ID NO: 593938 - DNA, 122 bp, Homo sapiens
cgacgtaacacgaccctcctctgagtagcatcccttgtctagcattataagaaaatgaaggacaacgaggaacgggagcacagcagtgacctcacctctagaccctactccctaagacccta

SEQ ID NO: 593939 - DNA, 897 bp, Homo sapiens
ctcaggtgatccacctgccttgggctcccaaagtgctgagattacaggcgtgagccacgggctgactgttgtttcaacatgacttctctaagctataaataccagagtggccaaagagaagtggtcataattaaaccattattatatgtgtgtgaggtatccctagtctattattatagcaagggtggaacaacaggtgttctattctatgcgaagtttatgccaatgatcccgaacattagtgggaaatatagaggagtccctaatcagtgggtataattcaacaagagcggaatggtaaatccttggggagagttaaaaggacatttctctttaagtagggggtggtccacccccaagaggggcatttacattaatgccctgctatcataaattcccctttcatagccccaggtggaattacttccctcctctccacgggctaccgtgttgactcgacgttgggcacttgggtcaataacaactggaagcgtgaccttggaagcggggaccctttggggtgccttaacgggtcgcagggtgtgaccgttgacaaaaacataagcaaaaggctgtgaattttaacacaacactatgttcgttgcataaacagggggtggttgtcacattacgcgggaacgttaccataggacattcctggaagtacagctgggtgtggcgacaagtgccttaagtgttccgtgtggtagagtgtgggcttaagtgatgtggacacaacttgacttgggaggcggggatgctggctgggtcatggtgaccttaatgaaaggcggcggtctaaggcaccggtggcacacacgcatttgtcctgttgggtagacgccacctgtgtgggcccaacctcgaacagtgccgtatggtacttcccacgtataa

SEQ ID NO: 593940 - DNA, 274 bp, Homo sapiens
gcccagagctgaagtggggcagacctgttcctcgggatgatgggcacgctatccacagtctcgcagtggttttattggaggttgtgggctttttttaaaaaaaaaaaagtcctcaaatcaggaagaaacatcaaagactatgtcctaggggagggagtaatcctaacacccaggcgggccgccagttggcaccggcctctatcccagacggccctcgtcccagctctcggtccaacggtggattatgtgatttttctgatacgtccattcagcg

SEQ ID NO: 593941 - DNA, 282 bp, Homo sapiens
  misc_feature (37)..(37): n is a, c, g, or t
  misc_feature (45)..(45): n is a, c, g, or t
ccccccccccccagggtgggggttagggggggggggnaggggggnggccccccccccccctttgttgggggaaaaaattccccccttttaaaaagggggggggggggccccctggggggaaaaagcccccctttttttggggcctttcccccccccaatttttttttttggggggggtacccccggggggggtggggggggccttttttttttttgggccccggcccccttttttgggggggcctttttttggggtcttttttttttttttccccgccccca

SEQ ID NO: 593942 - DNA, 190 bp, Homo sapiens
gaatgagatcgtcgcaccgaagccgccgccaccaccgcgcctccgcctcggccgccgccgcagctgctcctggtccccgtccctttgccgccctcgtcaggcccagctctcctgcgccgccgctcccgccgcgccccgccatgccgctctactccgttactgtaaaatggggaaaggagaaatttgaagg

SEQ ID NO: 593943 - DNA, 245 bp, Homo sapiens
  misc_feature (190)..(190): n is a, c, g, or t
  misc_feature (211)..(211): n is a, c, g, or t
caatagcactcgttttagaagtcaatagcaaaacattccaaaaagtggaaagtgatctataatacccaagttctatgttcaactaccaggttaaacaaggaaaacattttctgtgtcattctgttttacaaccacgtataaacccacgaagaatcaacgatctggatatccttttccacacactctgctnattgacaactgggagatcctnctcagagtcgacctcgccaggcatgcacaagctt

SEQ ID NO: 593944 - DNA, 770 bp, Homo sapiens
tccgggtaataaaatttatccaaatgtgccttaaaataggcgcgggggtttgcccagggtgctctgtgatatataaggcccggacttttctgccagttttcctgtgaccaaggaccccaaaaagttggacacgccaggtgaattgttatacacaagctcatcgtctgtcatcttcacgtgaccaacagctacagccagacataacaccttctccacttgggacactggatggtgggacttacacctcatccacttgggccaccatgtttccgtggtgtcgtagaccagggaggggaactcttcctgccttatttaaccctggggccgaggattcgggaaaatctggattgatcagagactctgaggccaaaaacgcatcatactcctgggccagccttcttgaccagtttttaaatcactaggtgcgagtatactccaagacgcctcgatgtccatgtggggggatcatccacggtctaagcctcgtccacagttgctgcgaggccccccgaggacacacacagaagaaacttcaggggcggggaacgaggacctataagcctgacacgggcccgaaaagcgctgagtcctctcgggggatcacaagtcactcacaagccgatatgaaacctccaaccgcttccaggaaacttgggggcaatcgcgctggtcccgagccggactacccgacaccgctcgaacaggggtgcgccgaagaaacattgccggccagggtccacagcaatcaaaggggatgactggccccagtg

SEQ ID NO: 593945 - DNA, 182 bp, Homo sapiens
aggtacccccgtgggcgtatcaggaagttatgcccacgatacagttcctacagagtgactcagttggacccacgcatcgccaatgtcttcaccaatgccttccgcgacggccacgaccctcatccaacccttcatgttcctgcctagactatcgtgcaccagtcccatggaacccaaccccc

SEQ ID NO: 593946 - DNA, 379 bp, Homo sapiens
aaacattcagaccatagcacttaacctttattttaaaatgtcagccaggtgcagtggctcatgcttgtaatcctagcacttagggaggccaaggtgggaggattgcttgagctcaggaatttgagaccagcctgggtaacatagtgaaaccccatctctacaaaaaataaaccacattagttgggtttggtgatgggtgcctatagcagcagctacttgggaggctgaggctggaggatcacttgagcccagaaggttgaggcttcagtgagccatgattgagctactgcaatccagtctgggtgacagagtgagaccctgtctcaaaaagtcaattatttttgtcttcttgtgtcttctattggttgtagctgagttt

SEQ ID NO: 593947 - DNA, 1008 bp, Homo sapiens
ctgatactctcagcgacgtgccatatgcgctgacgaaatgtaatgtctcactgaccgggatcgatgattaaagttgagctagtcactctggatctggacctatctcggctattggctgcatcccatgaattcctcccccccacaatgttctatccggcatcgctcatatctcgaagtcttctctgggcgtcccctgatgacttacatttgtccgcgtatgggcaaggtcttcgggagtccgtttgatcgtttgtccgttgagctcaagttaacactgggtgtcacctggccatgtaccctcattcttgcaagtcgaacttcaacgaagcaaggcaccgctctcctagtgacatacgtgctgacgaaggatcgttcttatagagcgctgtcctgaccaacgttggtgttggtctgtctcgtgcggcacaggaccggcccattcatggtgggagccagaagtccgaatctcgctgatttggcgagttgtatcggcgtgctgcgatatgatggaggggctggatgcattcgatgacctgatgcagcacacgcacatccacgccctggtacctgcgggtggagagggccatcaccgaggcctccccagcgcactgaatgtccccgcgcagagcatgagggaaggcagcggaagacgccagcatgcaagggcctggggccactgggccagcgcctggcgatactggttgggggcaggatcattctgccgcttgtgtccacgcacccgccaccagccctctcagcttctaatcacagggcacctgctggggctcaggagatgttatgggatagagttacagcgccatgcacaatgtcagtggggtcgaccgcttgcctgtccactgccttcctgctcagcagcccctcttcctggaccactcagtggctgtctcatggctaatcctgtgggtgggggccctcgaaggacagcaggacggtttgttttaagtggaatccatacctggttcctgtaacccactggtccaaagcctc

SEQ ID NO: 593948 - DNA, 561 bp, Homo sapiens
gatgaggtcggtgcccgacccttattcccgggtccctgctactcctggccttgctgatcctctacgccctgttgagccggctcatctggctcccgagcctctggggcccaactcgaggccaagggtgcgagggctggaacgccagtgtggaggtagctgcgtctggcgccagaggcagagccggcgaagggggcccgcagttgtttttggaggagtgagccggatagccccacacacgcgccagtggtacataccgaaagagctagagctagcttcgtgggcctatgctagccctcactgccagcaccacctgcgcctttatctatgcatctgtactctagaacacttcagtaatcatttgattcctttgccagcaggctcccacatagccaatgagagaacagaagaaatgaccattcccccatggctgtccattgcgtgccctggttcttcttgagtgttctcttgtctgcgggtatggctgctcttagacccgtttctcgtgcctcccagtcctgtccttcactcagaggaacggttagagaagggcactcccttcat

SEQ ID NO: 593949 - DNA, 116 bp, Homo sapiens
aatcgaagtcctggcttttttcggtttttcacctgctctcctggtctctggttttttaaacccatttttctttatgaatatattcatggcctttggaataaatgttttgagaaaga

SEQ ID NO: 593950 - DNA, 834 bp, Homo sapiens
cgccatttttcattgtggacgcccaacccttttaatggctccacgtagtcaacaatatggctaaggggctaactatactggcaagatccggatttcatagagtatttaaatatgagctattatactcttggagatggtgtagtgtaggcccgtttaattaatgggactgttaaaattccgaataattttatgaaagcgccacttcttatatgaattatcaccacccgtggttttcccttctatcttttcatttgtaaaaagttactacgaaattaggagatcacgccctggttcccaatttgtcacagccacttattttaggaggagataatttccaactaccccactggttaaaatacccactgaataatgctgtaattatatctaccacgttaaccccaaatttttataattggccgttcatactataattttctgtccccgttttttgttccccacaaataaatattatggcattaaaatatggcactgttatattgtatactcttacccctacttttgtttttataattagttcttccccatataactcagtgtagtattaccccaacacgcccctcgggagtttatgatcttcctcctgcaacctgtttttccacggagcttatctggcaccttatttaccacctgtgataaagtggcaacaggaaaaataagaatgaaataattctttttccacattagaattgtttttaaggggccaagtgcccagcccgctataaaggttttgtatttttttagaaaatgggaaaaagatatttgttttacctttgctaaaattttcccaattttaagtaaaccttttttttccta

SEQ ID NO: 593951 - DNA, 113 bp, Homo sapiens
acactgtcttactacttacgacgacgactgtgggacttacggtaacggggccgacgtcactggcacctgatccacaccacccgttcccgacacaccatggggtctacttcacg

SEQ ID NO: 593952 - DNA, 568 bp, Homo sapiens
gtgaaaatagggaattatgtgaagacaaataacaataagtataacgaaagtaaaatctaacaagattccaatccttaaaaaaagaacgaaacaacacaagtacaaacaaagcaaacccagaaccaatgagtggaagcttcctgtttacctatcttcaacacctttcatctttctactttccaacaggtagctactaaccaaaatttaacgtatatcattcttgtgtcaacagagcaaggcttatggccagaaatgaatgaaattcataatgaaggtattctgaggaaatatgatcttactctcaaagtctcaacaataccctgggtgataacaactggctctcaaggaacaagatagctcccaagcaactccagtgcccaggaaagatggtgaagagatctttgcagacaatctatcagttactggggcagaaaaatcattgtgactagtcatcttcatacgatagcttaaaccaacagacagaatttatagtgtagcgaagggcagtctactgcagtagttacttggatccactcctgctgtttggtgaccctgggcaatcaagctt

SEQ ID NO: 593953 - DNA, 1094 bp, Homo sapiens
  misc_feature (704)..(704): n is a, c, g, or t
gctgcagctcttgtcattcggccatcctttgccagactccatgatggttctgcaggttgctgcggccccccggacagtggctctgacggcgtaactgatggtcgctgctcaggatctgtggtccaggcgcagggaccactccagcagaattaaccttcttaccatgggacgggctagtgaatgtctacgcgtattaattgtgggacacagtcgacttacctggacgacgatacatctactagccgcgagacggatgttgcggtgctgcattccgacagaagatctgttggtggcgaagttgcctcggtgccggtagacggagacgcatgaggtgcgtgccttgaatagagagaagtagcttggcatcaggccgggataatgggacagtcctctggtgaggtaagcaagcaggggctcacgtgccagtgagactcggaatgtgctatgaaactctaggcctacagaagcactgaggcagttgagtcgcccaatttggaaccctcttgactagtcaggccctgaattgatcacgacggcccgttaaggcgggctggcacacctgggtttgatcaccacccggttcgcaaactgaaacggggggggccccctgtatatgacaaggacaatctccaaacagaagccctttggcttaatggttactttggcccaaactggtttgaaacgcggcgaaatttttccataanccccccaaagggggcacggccaattatccaggacggcttaccccgcaatttgggttcttccccttggcacatttgggtcacccagggggaaagggaaaaaaaccaagggccttggagcgaggttaccggttatgttccccaaacccaataccccttggcattgcccggtacacactctggggcaagaacctatgtgacccccttattccccaaggaatttcaccttgggcgttgggaattcggcccttggggatcaaattggaacaccccccccacgaaggcaacggggcccacgacttggtccgttaaccacgcccctttgtcgacaaaatggttgggggacggccaacgacccccaatggccatttgggcaacttagggttcaccttg

SEQ ID NO: 593954 - DNA, 191 bp, Homo sapiens
  misc_feature (141)..(141): n is a, c, g, or t
agttgaggaatgcccattgttaacgcgggggctggggcgggccttcatcccgttccctgattttaaaaagggccgtacagcattgccatcaattatcaaatcgggaatggcattgagatgccaagttgaagaccttttggncttcgtgggcttacagcagcaaggtggggtgtctggtggctgaaaagttc

SEQ ID NO: 593955 - DNA, 806 bp, Homo sapiens
tatttccaactatattcctatagaaaattgctacttcatagggcacttcaacacatttgtggctccaaagtcaaatgaatttggtagtgcagtaagggtgagtcccaattctttatgagctgccacatttttaatttaattcaatcttcattgtttcttttccaaaactttcttcacatagggatactcaatatttcttgtttattttttaaactatcatttaaattaaatacataaaaaccgtgatattagcataacttagcttttgagggactaattgtgatccagcagatttattactaaaatatgccgtaaaaaaatatagagcagattctgttaaataccttaattgcaagtgcttggagtgagaaatataccacctggctgtataacatacacactttttggatagataacccacacttgcttaaaagtacacttggtcattaacaaatttacaatagaaaaaaaaaacataacatactgttgaaactaactttacatattattatcgaaacctactactgtctgtcgcgaccgtattgtattctgtaccatgtcatctatactgcgtgtgatatagaagaaattagttgttagtgtaaaaaagccagggcaatacttaactcttcagctctaaatccataattcaatgagattacttatttgcagtctgctatggataacatatgggtcctatcgattatattgcgtgtgttagtattattgctccttagattattaaaccgggcctggtagattctcggcatatactctcttacagtataaacgcgatgacgagaagg

SEQ ID NO: 593956 - DNA, 938 bp, Homo sapiens
  misc_feature (278)..(278): n is a, c, g, or t
  misc_feature (434)..(434): n is a, c, g, or t
  misc_feature (463)..(463): n is a, c, g, or t
  misc_feature (502)..(502): n is a, c, g, or t
  misc_feature (557)..(557): n is a, c, g, or t
  misc_feature (611)..(612): n is a, c, g, or t
  misc_feature (639)..(639): n is a, c, g, or t
  misc_feature (690)..(691): n is a, c, g, or t
  misc_feature (694)..(694): n is a, c, g, or t
  misc_feature (696)..(696): n is a, c, g, or t
  misc_feature (698)..(700): n is a, c, g, or t
  misc_feature (703)..(703): n is a, c, g, or t
  misc_feature (707)..(709): n is a, c, g, or t
  misc_feature (711)..(712): n is a, c, g, or t
  misc_feature (714)..(714): n is a, c, g, or t
  misc_feature (726)..(726): n is a, c, g, or t
  misc_feature (754)..(754): n is a, c, g, or t
  misc_feature (757)..(757): n is a, c, g, or t
  misc_feature (759)..(759): n is a, c, g, or t
  misc_feature (766)..(766): n is a, c, g, or t
  misc_feature (768)..(768): n is a, c, g, or t
  misc_feature (770)..(770): n is a, c, g, or t
  misc_feature (772)..(772): n is a, c, g, or t
  misc_feature (776)..(778): n is a, c, g, or t
  misc_feature (785)..(785): n is a, c, g, or t
  misc_feature (789)..(789): n is a, c, g, or t
  misc_feature (791)..(791): n is a, c, g, or t
  misc_feature (793)..(793): n is a, c, g, or t
  misc_feature (798)..(798): n is a, c, g, or t
  misc_feature (811)..(813): n is a, c, g, or t
  misc_feature (817)..(817): n is a, c, g, or t
  misc_feature (822)..(822): n is a, c, g, or t
  misc_feature (836)..(836): n is a, c, g, or t
  misc_feature (878)..(878): n is a, c, g, or t
  misc_feature (900)..(900): n is a, c, g, or t
ctgcctctggggggtccgctagtcgcggggcggcggtgtgcggctgcgggcgcgaggttcccagcaggatgccccggctctgcaggaagctgaagtgagaggcccggagagggcccagcccgcccggggcaggatgaccaaggcccggctgttccggctgtggctggtgctggggtcggtgttcatgatcctgctgatcatcgtgtactgggacagcgcaggcgccgcgcacttctacttgcacacgtccttctctaggccgcacacggggccgccgntgcccacgcccgggccggacagggacatgggagctcacggccggactccgatgtcgacgagtttctggacaagtttctcagtgctggcgtgaagcagagcgaccttcccagaaagggagacggagcagccggccttgcgccggggagcattggganggaagagccgtgagagggctacgactggntccccgggcgacgcccgggcgcagcccagaccagggccnggcagcaggcggagcggaggagcgtgctgcgggggcttcgtgcgccaacttccanccttgcctttccccaccaagggagcgcgcattcgacgacatccccaactcggannctgagccacctgatcgtggacgaccgngcacgggggccatctacgtgctacgtgcccaaggttgccctgcaccaacannaancncnnnaanaacnnncnnancttaatccctcntcacctcttttctcccaacctctacccncancncaacccncncnancacnnncacaacnccancncncaccntacccacaacaannncttnctccnctactttaatctcnccctccaccccaataatttcaatctcaataataacaccaatnacctcttctttctctacccctnctctctccctaacccctcctacctcatcaatatctatc

SEQ ID NO: 593957 - DNA, 350 bp, Homo sapiens
ttgaagagacctttataagacactatacagaatggaatactagtagagatactagtatctttaacagtagcatggaaatgtaaactataggtaacataacataccacaggtaaacactggctttggtagaatagtgcagtcattagaagtcaaaataaatgactttctttttaaagccaaagaccatagttttagttctaagccactaggtagatctttaggggaatagtccaaatttactgtttacccagcagttgctatgtgctttcttaaccctgttctgttccagttttgctggatttgtacatggccattctagaaataggagttgaggtaatccgtagaggggc

SEQ ID NO: 593958 - DNA, 839 bp, Homo sapiens
  misc_feature (347)..(347): n is a, c, g, or t
  misc_feature (455)..(455): n is a, c, g, or t
gccgtggaccagacgggtcactttgaacggcaggtggcacagtaggtacgctaggagtgaaattaggaacaagtggggagcgaataagcctattgtaatcataggagaacttcttgtattatcgagtgtcgcaagctggcgctaatgtgtgatgggtagtcgtagaacgaccaaagacatacagctaagctcgattctctgcttgaatcctagagtaccattacgttagactaggtgactgttggtagagaacatacgtgcagcgaattatggtgagacgcgaatgtacatgtgcacatcagttgaccacaaagttgatgccctctgtagtctcgaccttgactgcnacgcccataggattagacccggtatggtgagacaccatcgttcgtgctcggcacacttgcgatcacatgctagctagtgcgtttccagcttgacgtggacgatacganccgttggacgtgaaactcgtcctcgagtcgtcgcttagcaggattcgtgtgccatatagatagggactcttcgaaggacgatgatatggtatgccagcaggatgagtcaggattcagggtagtgatatgatatggatgagtagacactttagcgaatgactaggcttgattgaaggacgagcgcagataaagagcgtgatcgattgcttcggggctctgggagcccaaggatcacagtctcctgcgttccgaaaggtcttggtcaaaacaagttccgcaatgaacacttcttgaagggaaggcatgcgcttgacgcagaaagcgctcgagatgaactaccgctaggtgacggtttgttggagtccatgcgtatagatgcaggag

SEQ ID NO: 593959 - DNA, 885 bp, Homo sapiens
ctgtacccaacttttcctccgatcccctaacaacccccctcctaatactaactaactgactcctacccctcacaatcatggaccaagccaaagccacttatccagtgaaccactatcacgaaaaaaacctctatctctctatactaatctccctatccaaatctccttaattataacattcacagccacagaactaatcatatataatatattcttcgaaaaccacacttatccccaaccttggctatcatcacccgatgagggcaaacagaccacgaatccagcctgaacgcaggcacatacttcctattctacaccctagtaggctcccttcccctactcatcgcactgatttacactcacaatcaccctaggctcactaaatcatactactatctcactctcactgcccaagacactatggaaaactcctgagccacgcagagttgatatgactagacgtacacgatagcttgtctataccgtaaagataccctctttgcggactccacttatgactccctaaagcccatggtcgaagcccccatcgctgggtcaatagtagattgccggagtactctgaaaactaggcggctatggtataagtacgcctcaagtcattctcaagcgccctgacgaaaaggaggatagcgctaccccttacgtgtgtacttaagccctatgaggcctcctgtataacaagcgtccatctgcgcgtacgagagaagagacctagggatcggtcattggcgtactgcttccattgaggggccgtagccctcgtgagtagacagcgttctcgtgcgaagcccgtgaggttgacgggggcgagcattgtcgataatcggcgcggagtacacctcatgagcagtcggcgaggcgata

SEQ ID NO: 593960 - DNA, 212 bp, Homo sapiens
accatgttactctgctgcttaaaaatcttacaatgccttatttttaaattaaattcacactctatttatttatttattgagacagagtctccctctgtcacccagactggagtgcagtggcacaatctcagctcactggaacctctgcctcctaggttcaagtgatctcctgcctcagcctcccaagtagctgggattacagttgtgcacca

SEQ ID NO: 593961 - DNA, 105 bp, Homo sapiens
cgtgacgaggtaggtagatggagaccagtctgtatacgacggtgaaaccccatctctactaagaaatataaaaaaaattagccgggatcttggcctcgtgcctgt

SEQ ID NO: 593962 - DNA, 584 bp, Homo sapiens
  misc_feature (267)..(267): n is a, c, g, or t
aaaagaaattcttttttttgcccaggttggaagtcaatgggaatatttgggcccattgcaacctcaccttcgggttcaaacgattttcctccttggtttctagagaattggaattggattccaaggtaagggccctccgccgggttaattttgtattccagtaaagacgaagttcaccatttggtcaggctgtttccagcttcttaccttggtatcggcttgactcagcctcccaaagtgaaggcaagattatttaaaccacatacntgctaagtgtaagaacaaggtttgtaaccaagcttgtctggcccaaaaccagagttcttcacacttgcagtgacaaatttcagctgagaagctgtattccagcacagcttcacgtagtcttcttgaaatacacatgtccattgcatggtttacacacaagtctatttgcttgtctgcccacacactggactataatctccttgaatgtaggagactcatttctcaatgtctgggatatagatggcattcatgcagatggtaatgagggcagttgtagctatgcgtattttcttccttgcttgttatgtctcgtgccg

SEQ ID NO: 593963 - DNA, 608 bp, Homo sapiens
  misc_feature (588)..(588): n is a, c, g, or t
ccactacgtggtctgcgccgagcggaagcagctggtcggcagtctcagcctctccatgacgcaggtgaaggtgtggttccagaaccggaggacaaagtacaaacggcagaagctggaggaggaagggcctgagtccgagcagaagaagaagggctcccatcacatctaccggtggcgcattgccacgaagcaggccaatggggaggacatcgatgtcacctccaatgactagcggtgggcaaccacaaacccacgagggacagagtgctgcttgactgctggccaggcccctgcgtgggcaccaagctggactctggccactcccatggccaggcttctggggaggccatggaagtcaatggccctcacaggggcattgaagcccgagggcacgccaacttgaaacgaggagacaagcgaatgggctggctgaggccagggaccacgttggccgttctacctcggagagccatgctctgcctgggacgggcccgcccgccacagcagcatcaccagctgcatctcacgtagtctccaatgtcccttttgttttgagtgcatttctgttgtaatttattgtataggcantacgcagggtagtgatccca

SEQ ID NO: 593964 - DNA, 978 bp, Homo sapiens
gctgtcccgctatggccccagcaacttggagccggacagcgcctgtgaactgcctggagtgctgcctgcaaggtaccctgaagcctccactgagcactataaggctagctctctgcgtgccaggactaagaatagttggacaccgagtcgtgcccctgaagcttggagatcatcccctgcccttcacgcgcatcgccgtgggtgttcaatccccgacaagccaagcagagctccaccacaaccaagtgatccgcctgagcagtgcagtgcgtggtgcaaccatgactgcaaatggagagccagctcaaagggaccttgagagaactgaacctcttcgaaggagggcgcagccggagtgcttgctgggggatcgtctgttagctgtgcatgggtggtgacttcccaattcatccccaagtgcgcaatcaaaaccaagacttagatagacgtgaccatacttggttggagagcaccatgtagaggagtatacccttttcgatggtacttaacctaaagcgaaacttagtgagatagtcagagaccaagattcagggacctactttgtatgttgacctgcaacagcgatggaatggtttacccaccattcaaacaccatgggctctgcaagatctagggtcctgctagttgaaaccagattgaccaagttcgacttaatagtacgcggaacttggtcgcgttcggggagagctccagagacaatagccatgttgtgtgtgcatgcatggactagttgtactgaaggataagtgcttgctagttatgcacaattggccgaagtcacaaggagtcttgaggcctcagggatgttgtccagctctggctcatcagagccactggtccccttgcagatgcatccccattgaatgacttacacagaaatgggttcgtccagtttgccgtgaaaagtcgttggaaggtccccccgtctactggtcagccggttaccccgggccccgc

SEQ ID NO: 593965 - DNA, 138 bp, Homo sapiens
cgatggttacctgcaaccaaagtttccgaggggaaggatgttcttctacttgtcacaatttgccccagaatcttaccggctacatctggtacaaacgggcaaatgacgggacctctacctattacacttacactcacg

SEQ ID NO: 593966 - DNA, 208 bp, Homo sapiens
gaaaccagggtcccctttttttccccttttaatttaaaataatgcgggtcaaaccatttccggtaacggaagtgttaattttacgggacttttgggacccttttgggaatttaaggtatggtaaggtattttacaggggtcctgattttgccccaaccgggatattgaagctatccaggcttttgaaataaaatttaaaaccccccca

SEQ ID NO: 593967 - DNA, 273 bp, Homo sapiens
  misc_feature (81)..(81): n is a, c, g, or t
  misc_feature (116)..(116): n is a, c, g, or t
  misc_feature (225)..(225): n is a, c, g, or t
aagaatttcttgaacccggtagatggaggtttcagtgagccaaggttgcgcctttgcactccagcctgggcaaaaagagtnaaaccccatcttgaaaaaaaaaagaaaagtggctnatgtgacagaggaactgaattttaaattttatttaattgtaattaattttaatagttacatgtggccagtattagtatagttatagaggcttgaagaatgccaaatcanttttctagtgagtactacactgaatcaaaatattagttggaaagaagc

SEQ ID NO: 593968 - DNA, 443 bp, Homo sapiens
tggttcactgaagacccaggatccagatgatagctcccagaatgccatgcaggctgctccccgcgatggcccctgcaccagcacgctcctacagccggcggccccgtgccaccgacgcccccctccctgcgccccatgctcactcttcgtgtacccttcccgagaataagcctaccatgggtcagctacgtgtttccggctcctgggcttcgtgtgcacttctggcgacgagccgaacctcctgctgactctgccacgctcccttccccctgccccctccaaccccgcatgtcctccgcccaccctggccatagcacctgcccttgctgcacgctgtcgggcttgacttccaacaccccccgccccgcgcacccccgcgctcccgcccccatgcccactctacccagcagtcacaggcccatgaccggaggcttgtgaggcgc

SEQ ID NO: 593969 - DNA, 202 bp, Homo sapiens
cgccattacaactatctatgggaaagacggtgagatgagtgaggctattgtgttgtaagtgaattcttcgagtcactggcccatttgggcaaaaagccaggttagcgggggcaggcctcctagaggagaggagggtggatggaattaggggtgttagtcatgttagcttgtttcacggtgcgagatagttgtgacagtggcg

SEQ ID NO: 593970 - DNA, 142 bp, Homo sapiens
tatgtgcaacatacatcaagatagaaaaggggacttaacatatcacgttgtatcttacttgcagtgaatgcaagggtaacttttactctggtggacctcccccatcacccaggtacctactgctgggctcccgactacccaa

SEQ ID NO: 593971 - DNA, 276 bp, Homo sapiens
tatatataagattattattcagaatacaagtaacattcaagcatcttttacagaaaagaaattagagtaggcgaaagaaccagaaaatgtattgaaagcaaaaaaaaaaaattctatttgggcacttggactggtaagttccggggttggaaatcatagtcctaaaaatgtagaaatggtgtatatcagatcactcatctaaggctgtagtgacccagcccaagatgaccaacataccccacacctactaacatctctgtacccttagtatatctc

SEQ ID NO: 593972 - DNA, 186 bp, Homo sapiens
agaagatccccctgttatctaatgggaaacaaaggtctgcccacaggggaaggcagaaaatgcccgcggctcttaaactgaatgctaaaagctttattctcctgggttccccctggtattctttgctcattgtcagtccacccaactgtaactgagcaagctctgggctgaagtctgacgtcagaa

SEQ ID NO: 593973 - DNA, 252 bp, Homo sapiens
gatcccacgtatatgtacagtaagaaggcccatcagtatgtacaaaagaaagggcatggtattctggtggtgaactgctgtttataattatgatactccagggttcggagagggaaaaaaccaacttccaataaagctaaataattaatttggtttaaaactcttgtgttaacatatttacgggtggggtacccgaggctccgaattccgtaatccatgggtcattagcttgtttccctgggttgaaatttg

SEQ ID NO: 593974 - DNA, 332 bp, Homo sapiens
tgatgctgaggtgatctagaggatcccggaatgtgtggtgttatggtcaccctgtacacatcggggacacaatactccgtcctcaaagacaacccacgggctatcggccccagcgacatttgtggtgactccgtcgccgtcctcaccgggtccgtctacgaagaaatggccaacgacaagaacgacgactgcaagcacaacggcaaaaagggagtcacgatccagtcgtacaaaaactctgccgacgtcgccaccgccgtcgccggagggaaagctgacctctggttctccgactctcccgtcgtcgactatgcataacaccacacaattcg

SEQ ID NO: 593975 - DNA, 814 bp, Homo sapiens
  misc_feature (3)..(3): n is a, c, g, or t
  misc_feature (71)..(71): n is a, c, g, or t
  misc_feature (117)..(117): n is a, c, g, or t
  misc_feature (125)..(125): n is a, c, g, or t
  misc_feature (165)..(165): n is a, c, g, or t
  misc_feature (172)..(172): n is a, c, g, or t
  misc_feature (192)..(192): n is a, c, g, or t
  misc_feature (202)..(202): n is a, c, g, or t
  misc_feature (231)..(231): n is a, c, g, or t
  misc_feature (245)..(245): n is a, c, g, or t
  misc_feature (263)..(263): n is a, c, g, or t
  misc_feature (272)..(273): n is a, c, g, or t
  misc_feature (284)..(284): n is a, c, g, or t
  misc_feature (290)..(290): n is a, c, g, or t
  misc_feature (296)..(296): n is a, c, g, or t
  misc_feature (303)..(303): n is a, c, g, or t
  misc_feature (307)..(307): n is a, c, g, or t
  misc_feature (319)..(319): n is a, c, g, or t
  misc_feature (327)..(327): n is a, c, g, or t
  misc_feature (332)..(332): n is a, c, g, or t
  misc_feature (354)..(354): n is a, c, g, or t
  misc_feature (357)..(357): n is a, c, g, or t
  misc_feature (367)..(367): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (382)..(382): n is a, c, g, or t
  misc_feature (385)..(385): n is a, c, g, or t
  misc_feature (388)..(388): n is a, c, g, or t
  misc_feature (397)..(397): n is a, c, g, or t
  misc_feature (399)..(400): n is a, c, g, or t
  misc_feature (416)..(416): n is a, c, g, or t
  misc_feature (453)..(453): n is a, c, g, or t
  misc_feature (459)..(459): n is a, c, g, or t
  misc_feature (474)..(474): n is a, c, g, or t
  misc_feature (489)..(489): n is a, c, g, or t
  misc_feature (514)..(514): n is a, c, g, or t
  misc_feature (523)..(523): n is a, c, g, or t
  misc_feature (552)..(555): n is a, c, g, or t
  misc_feature (560)..(560): n is a, c, g, or t
  misc_feature (569)..(569): n is a, c, g, or t
  misc_feature (636)..(636): n is a, c, g, or t
  misc_feature (674)..(674): n is a, c, g, or t
  misc_feature (722)..(722): n is a, c, g, or t
  misc_feature (780)..(780): n is a, c, g, or t
ttntaagatactgattggttacttgttgaagaaaacatacaatacaaaatacagaaaaagtggggtccggnccctcccactcccccccttacccacccacccccaaatactcatcancatgattnggtcagaacagggctcagagccagaggttggggtgaccgngggtggnggggttgtgggcaatgggtncgtggctgtnacaataatgctgtgataatgctgtggttncccagcggggaggngggagcggggagggggcngcagcgtgnngagagcgagcngaaggnagagcngcctctncctncctaagcccctncccaaggnctgcnccaccgcccaaaccaaagaccnctncgaacaaagngnggntgtggntgcnctngcngggtccgcngnnccgcagagggaaaganagggtagctgctctgaccccactgtccccatatactngggttngggggcaagagcttntggctactcccagcnagggtaaatgggagagctgttgtanggggaggtngtgggaagagcagttgatcattttttttnnnntagtnacttaaganttaaaattgatttagtatttgttcagaaaggtgcaggtggaatgactcactccggcctatgatcaanattatatggagatatcttggtggacccctccccctgcncccccagtggtggcccgtgtcgtttagtgcgattggttagagtggatnccagttgggtcattcaggcggaggaggcgggggcagcgggcaggcaaggggggctcanttgctgcagcactggctccggctggctgggttgt

SEQ ID NO: 593976 - DNA, 508 bp, Homo sapiens
gtcaatcaaagcgtcagcacgtgtatcctgacaagccacaactgcctggatcctggggcccccatcactggatcccagatcccctcactccacgccactggattcctgtattggtttttggtttgttgttccgttttaacctcgacactgggtctcagactccttctgctgacatgccagatccctgcatttcaagcactatgccttccagacccaggcactggatcccagattcccaagtccttcacccaccagattctggctccataaaacaagtgcggtgggtcccctagtgtgcacagcaatgtggtatcctggcaaacttgcagactgctggagttccagattctgggatccccaaatcccgtctgcccagtccctcaattgttgaaaccgtcatctctagaaggcagatcctgatattccaaggcactgaatcccaagccctgaatccccggatttctgatctgaagtcttccaggcgccgggtcccaaatgttcaggcccc

SEQ ID NO: 593977 - DNA, 982 bp, Homo sapiens
aaaaatatcctccggtggcagtatcattggttatggtatggtatatctagggattctcagatgcttagtgctaggtaatccaggttaatacgtcattggactacctttgtgcatctttctatgaagccttaatgggaacctgatgggtatgtgtagcagcttccttgtgaattctgtcagagctgcaacagcccctgcactgacactcagttttctaaggaactcctcctactaccatcttggctcagtctccctcacttaagccctgggttgaaaaattacattgccagttcccaggaaacatgttcagtttgcagattaagcctggcactcacctatccagacaaccagagctccacctgcttagcttgtttcaaagatttctgaaagaaaactaggggagcactcgtgaaccacaggagccagctggtgatctgctttcttaccctaacctcttgaaaaatgagtcgtctactatatttcaaagagtctggacggtctctgactctgcaataacaataaccctggctgtaacttcaataaccacccgatgtcgttaggaagagcctaacttctgacatacacttcgacttctatttccttacaatactgatatactctccttgcttacttcagggttcctaacttagattggaagtggcagcaacctggcacctaatcatatacgaaacaggcggtagtccaggacaatctagccattccataacgactatatacatcagtcccaacagggagaccacacgcctgcacacaggagagaaacaccacgcaaaacagccacccggcgaggaagaccgcacaaacagcctcaacaacacccgacggcacacgcaaccagacaaacgcaccagccagcgacgacccaccagaccacaacgcaccgcaaccaccaaggcacacacaagcgcgaccaagacgacaccagcagcacgcatcgcacacaaacatgtcagacgcgaga

SEQ ID NO: 593978 - DNA, 380 bp, Homo sapiens
  misc_feature (328)..(328): n is a, c, g, or t
ctccagctccccagtttgtggtctgagtagacagtgcccacaatctccttaaagtcttcacaaacagagagaagttgatagatagtgggcacagagccgatgtcaatcagcaggtctcccttcacacggtctagacagaatatcttgaaaagatttttcacaaggtgcttaagaatctgcctttggacagagtgcctagaaccaaccttgtaatatttctctaggtaaacccaagggttaaaatggcttagataggtgtccttggaggtacaccctgattccattatgtctcacttctgtaccactggagcactgccctctttctctntcctacaaaagacagagagtgcccctgcaaaagttgtcaccgtgagtctcag

SEQ ID NO: 593979 - DNA, 467 bp, Homo sapiens
  misc_feature (119)..(119): n is a, c, g, or t
  misc_feature (196)..(196): n is a, c, g, or t
  misc_feature (400)..(400): n is a, c, g, or t
  misc_feature (402)..(402): n is a, c, g, or t
  misc_feature (434)..(434): n is a, c, g, or t
  misc_feature (442)..(442): n is a, c, g, or t
  misc_feature (450)..(450): n is a, c, g, or t
  misc_feature (454)..(455): n is a, c, g, or t
ttccactgatactcgccgtcctccaaggctgaagatgcccagccaaggagagcctaacaagccgatgtcctgctcctttggggtttttcccaaccccttgggggcccttttgcttgctngccaccacccctgccgcagaggatgctgctgccaaggcaacagcccagcctccaacggagactggggagagcagccnagctgaagagaacatagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcntnctcacgtctgtgagtctgtcctttcccacccnctagcccnctttctcnctgnntggcaaacattt

SEQ ID NO: 593980 - DNA, 209 bp, Homo sapiens
agcgagattctcgttggatgggcatcgcaggcacgctcgaatgttacgacaagggcgacggctcctgtagatgtgcgctactggccgcaggaggctggcgagtatgccgttcacggtgctgtgcacccaggggaagacttccgcctcagccccttcatggctgacatccgtaacgcgcccccaggacttccacccagacagggtgaagg

SEQ ID NO: 593981 - DNA, 773 bp, Homo sapiens
cacggtggctcacacctgtaatcccagccctttgggaggccaaggcgggtggatcacgaggtcaagagatcgagaccatcctggccaacatggtgaaaccctgcctctgctaaaaatacaaaaattagctaggtgtggtggtgggcgcctgtaatcccagctgctcaggagactgaggcaggagaattgcttgaacccaggaggcggaggctgcagtgagccgagatcacgccactgcactctagcctggcgacagagcgagattctgtctcaaaaaaaaaactaatcacaaggagttaaggtgtcagccggatgcagtggctcatgcctataatcccagcactttgggaggctgaggcaggaggatcgcttgagcccaggagttcaagaccaaactgggcaagcaaactaatcacaaaatattagctgaacgcgggtagcacatgcctatcttacacctccagttacttgggaggctgagcaaggaggatcatttgtgagccctgggcagtcgaggcctgcagtaagccatgattgcacccatacattccaacttggcgtgaccgtacgaagagggtgaaaccccgtctctacttacaattccaaaattaggccaggggttggtggcaggcggcctgtatgtaatcccaggtaatcgggaggtgagaacaggaaaacttgctgtgaacccgggaggtggacgttgcctgagccgagaatgggcccttgcacctcacagccgggaaacgagcagaatccacctactaaaacac

SEQ ID NO: 593982 - DNA, 468 bp, Homo sapiens
  misc_feature (45)..(45): n is a, c, g, or t
  misc_feature (108)..(108): n is a, c, g, or t
  misc_feature (111)..(111): n is a, c, g, or t
  misc_feature (118)..(118): n is a, c, g, or t
aaattgtatattttttggaaaagtttatatactctctttaggaantcattgtgaaaagatcaagaaatcaggatggccatttatttttttttttaaaaaaaaatatantcnccaccanttttcaattctttttccccaacatgtggggttttatatgtggggactattaacttgtcaccaagcaggactctatttcaaacaaaatttaaaactgtttgtggcctatatgtgtttaatcctggttaaagataaagcttcataatgctgtttttattcaacacattaaccagctgtaaaacacagacctttatcaagagtaggcaaagattttcaggattcatatacagatagactataaagtcatgtaatttgaaaagcagtgtttcattatgaaagagctctcaagttgcttgtaaagctaatctaattaaaaagatgtataaatgttgttgaaacattaaaaaaaaa

SEQ ID NO: 593983 - DNA, 326 bp, Homo sapiens
  misc_feature (23)..(23): n is a, c, g, or t
  misc_feature (25)..(25): n is a, c, g, or t
  misc_feature (259)..(259): n is a, c, g, or t
  misc_feature (261)..(261): n is a, c, g, or t
  misc_feature (293)..(293): n is a, c, g, or t
  misc_feature (301)..(301): n is a, c, g, or t
  misc_feature (309)..(309): n is a, c, g, or t
  misc_feature (313)..(314): n is a, c, g, or t
aatatatatataaataaaaatantnttttttttggttttgtattgttttgattttgtattaattggcctaagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcntnctcacgtctgtgagtctgtcctttcccacccnctagcccnctttctcnctgnntggcaaacattt

SEQ ID NO: 593984 - DNA, 414 bp, Homo sapiens
ttacgctgacatgctgtacatcaggtgaaaaatgtccattaagaggtgatatagacagacacacaatatcgatcattatcttcctcttgcacattatcctgaattttcggtgcatagcctattactttcgtaccatcgtgccgcgactgcaatatgggagagcaaggtccagttttcgcagtagatgaggtacaccaagcgatacatccctatatcgacaaggacatctatattcgtgagcaatgggtcatatgcaaattacgtttccggaactccgggtgctatcagttaatatgttgaatgcccggcgaactggaggcaggaagacacacacagagctcttcatcattacaagctattaaatcttgctaacaggtatcgttaggaggcagggacccactcgggggatcctac

SEQ ID NO: 593985 - DNA, 110 bp, Homo sapiens
gtcagctggtgatacttgtctcataagtcgtctttcttgtgtgtcaaagtcaattcctaaaccaggaaagaaggctgtgcaaaaatgctattgaaacttctaaaactagg

SEQ ID NO: 593986 - DNA, 754 bp, Homo sapiens
  misc_feature (162)..(163): n is a, c, g, or t
gaacgggtgctcagtgttcttcccctcccctcgcctggctcgcagtcctctccccgcagctcggacggaactatgtatcccggaagtccggggcctttgctgtgtgggataaacagtaatggctggaggctgcaactcccggaacaacagccacaacatcanngagcaggagcggcagcggcgacggcggcagcagctcccccaccccgatccccacagtcagccgcccctgtccctgggggcggcgctggagctgtgggctgtgctgtgcagctgactgtgcagctggcgcgcggctgtgactaaacagtgtcacactgcaggtattttattgcatggggttttgtcacgtgaatgtgagaccaacttgtctgctacttctgcatgcacctcctctgacatgtcctgtatatgttgtacgctgtgccacaggtattctttcagcgcggatgggtactggctctcccactggacgacctgcctgcatgatactgacaccctatggcaaacgcatttgaacacacggacatgaacgcaatctgcttacacgcagcctacactaccacaatgttcactccctttgctggcttccctcaatgtcctctcactcagatagcttgtgacccatcttgctctgacacactgacataccctggcgacacgtctgacgtcacagaacactgcaccaccttctgcaacctgtacggagccacgtgtaccaacgacagcgacctgtgcgcttgaccctgcttat

SEQ ID NO: 593987 - DNA, 316 bp, Homo sapiens
atcccccacttcaattgctatcattcctcttctgatattggagccatatgacactagtaccgagaaattagtgtcgatctgaggagaacaggtcattgttgtatagaatatctccgagtcctatcaaagctatcaatctttgagatataggagcatattcattgtaggcgtgaacttattgcgaagctagtgatcagctatcgctgtgtagagtctgtcctattacttcaatgcgattattcccttctgctttttggaccatatgcatagtaccgagaaactagtgcgaagtagtgatcaggtattgctgttagat

SEQ ID NO: 593988 - DNA, 277 bp, Homo sapiens
tcctttttctggagaacggggtctcgctatattgcccaggcaggtctcgaactcctgggctcaagctatcctcccgcctcttagcctccctgagagctgggattacaggcgtgaggactacctgagttcagcagttcaagacaggcctgaccaatatgcagtatgcctggctctactaaaaatacaaaaaatttaactgggcttgggggcgcatgcttataatccaccacatgggaggctgaggcaggaaaagcactttaacctggggaggcaaagg

SEQ ID NO: 593989 - DNA, 385 bp, Homo sapiens
tctttcatcctggttgctgtcaccactgctggcacagactaaccataggcagagccactggggccatgacagaaggagtgcggtggtgcgcagcgccggcggttcccgcctggttcatgaagacatcgatggcaccccctacttcctctttcctctcgaagtactatggggcgcccaccaggaggtcctgccacccatcattgttcaggtctgccaggccaatggagctgccaaaataggcgcccatctgcgagccctccagcacctgcctcctccgcaggtctccgactgacccctggctcagcaagaacaccgagcccatatgtcggtgccgtggggcacctgtcacaatggtgatgtcattgagggatggccagggggatct

SEQ ID NO: 593990 - DNA, 488 bp, Homo sapiens
  misc_feature (98)..(98): n is a, c, g, or t
  misc_feature (102)..(102): n is a, c, g, or t
  misc_feature (171)..(171): n is a, c, g, or t
  misc_feature (207)..(207): n is a, c, g, or t
  misc_feature (229)..(229): n is a, c, g, or t
  misc_feature (243)..(243): n is a, c, g, or t
  misc_feature (245)..(245): n is a, c, g, or t
  misc_feature (269)..(269): n is a, c, g, or t
  misc_feature (272)..(272): n is a, c, g, or t
  misc_feature (296)..(296): n is a, c, g, or t
  misc_feature (371)..(371): n is a, c, g, or t
cgccacatcgagctttatttgtaatagctatggcatttttatcgtagtatttcttcttttcatatttatctctagtgaagagtccactactaaatctntctntggtcttcaaaagttctctggaaaattggcttcataaagtagtcttgctttagtatttcccatatcttncatgcactgtatctgttctgctgtccattggtctangttaactgatttgggggggtcngtttttattttcantncaaaaaaaaacacccattctaaancanaaaagggtttattcagcggtttcnggtcccaccaggtcactgcaagggctgggaaagctcctgcctctaatgccaccgcaaagctgcactggcccccancagcctcagaacacaccggagctggggacttcccttccaaagcgggaatccaggggtgaggatggctaagcaagaaactggccatgctcacaacagcttcttgaccctctggaagct

SEQ ID NO: 593991 - DNA, 559 bp, Homo sapiens
agagttccgtatcaattcagctgtcgatatatagatctaatacttctgcttatcaccgagcacgggtggacgtgagcgagcagctttctctttctgaattcagtaatatctgatgggcaaataatctactacatacttctggaaacgattctagtatttgaagtagatagcccgagcatcaatatagaactgctcctccgttatactttgaaaggcaaatttttaaagacatattccctttcggcctgaacaaatgagaaggcagaattaagaaaagtgaggtaaaaacacatgtagcaataacattagagtatgcaaagcctttgcagattttcccaaaatgctaaagtagttcaaaatgaaaacaggggtaactgatatccatcttcagtttataagctcataagccagagcactgacctcaaagcagatgccaaaccactgttactggggaacacaatactaatgatgcctttaaagagagaaacccgtgcaacactagctcctgaaaaaacaccttcctttaaagagctatacacccagaatgctctcataagtc

SEQ ID NO: 593992 - DNA, 351 bp, Homo sapiens
  misc_feature (174)..(174): n is a, c, g, or t
ctgatgctatagtgttggtggcttctgtctccagcctttaacttttcattctaggaggagtataaggctactaggttatcttatctttctccctgggttcttcttcactttctgtgattcttgtataattggatatggccctgctaattttacaagtcaacaggagctcagaanatggtgcataaacaatgaacggtcatagtagcctaacgatgtcacacggtgaagcggtaggagtgagtcctaatatgttttaagactttctataaagcccaggggagaaaacatctctttttctagggcctttgacatacctcagtcatttttatacaacatacccacctatctgta

SEQ ID NO: 593993 - DNA, 699 bp, Homo sapiens
gctcttttgttttgttttgagacagggtcgcccaggactggaatgcagtagtgcgatcatagctcactgcagaccccaaccttcccaggctcgagcaatccttgcaccctcagcctcccaagtagctgggactacaggtgcacaccaacatgacctggcataattatacttacatatatatagtagagatgggagtactcacatgtgtatgcctaggctggtctcaaatttctgggctcaagtgatcctcctgccttggcctacctaaagtgctgagattatgggcgtgagaccagctgatgcacccaggacatgatcgttccatgtctagctcatagaacatcacacaccaagacacacagaacgtaggtagaaaaaggtggccgtacatcaagaaaggacatagcaaaaacagaaactagcgaacccaggagcacgccacaccaagagacgcaatgagggagcaacggggggcatgggacataaccgttggcgcgaaccagatcggccaaggcatgcagacaaaggagaatcaaaaggcatgagagacagcgggtcccccgtgaagaagctgcgcgggaagaggaacgcaagcgcagaccagggaaccaacaacagaccaccgcagcaacgaacagagagacaggcacaataaggaagcaacaaccaaacagagacaagcgtagacggagaagaaaa

SEQ ID NO: 593994 - DNA, 339 bp, Homo sapiens
cgccacgcccagttagtgttttgtatctttagtagagatggggtttcaccatgttggccaggctggtctcaaactcctgacctcgtgatccgccctccccagcctttgggagccaaggccaggaattccggaccagctgggcagcatggcaaaaccctgtctctataaaaaaaaaccaaaaaaaaaacaaacaaaaaaaacaccctctccccgaaaaaccaaagttagctgggcgtggtggcacatgtctgtggtcccagttacttggggctgaggtgggaggattgcttgagctagggaggttgaggctacaatgagcctgtctcaaagataaaataa

SEQ ID NO: 593995 - DNA, 294 bp, Homo sapiens
caccaggcaacccctgatatgctttatgtaactaatacattaatttgtatttcctagaattttatataattggaatcacacattgtatattctgttttatctggcttctttcactcagcaaaattattacgagtttcactgacgttgtagcatgtatcattagttcattccttttattactgagtagtattcaactgtagggatacaccagtgattttacccattcccttattgatgaacattttggttgtttctagattttggctattgcaaataaagctgctatgaaccaaa

SEQ ID NO: 593996 - DNA, 643 bp, Homo sapiens
  misc_feature (329)..(329): n is a, c, g, or t
gaatcgagctctgtacccgtcgcgaaggtgtgagtccacccagattatgaagctaatctggtccccctaggaacacctcccaaaaggctgaagtcatcgtcctcacttgagctctcactcgagcagctggacatgcattcagattctcattatgtgttccacgtagtgcagtcacactggtccatctggaaagaagggggttcctaactgcaaacaacacccccgtcatgaatgctctcagtcagcaagctccttcaggttgccaggctcccgcagaaacttgccatcattcactgcaggggccaccaaaccccagacaatcctatatnggccagaaatgctttagcagatagagtagccaaacaaatggccctacaacccgtgcaaggccagtttctttccctgtcctcgttctctcctctttactccccagaagaaaaggaggactgccaagcccaaaaccttcaaaaacaaggaccacggtatgtcaaggaagtgcgcttcgctgtcctcactctcaaacaatccctgtcctccaaagcctccacaactctttccatgtcgggtacaaacctgtcctgcaacgtctcctgcctatcctcatttgtcctcgtcgggtacaatgaggatacacgttcgcgag

SEQ ID NO: 593997 - DNA, 393 bp, Homo sapiens
gtaatacctggtagcatgattgtaacccgtgagtgctgagtgttccactgagcccgatgttaaccccgcagcccactgtaacgggctgctgtctgttcttctctcactccttattaacggtccccatctgtattggagtccctgtactttattgctccctcccagatcactccctgtggctagctcctattgtgattccctcagatctgccctaatcccggacatttgggtgggggaatcttgcctttccctttacagagccccagggatctcatctggggaactgtcattgcacagcagaggctgttccttcctgctagttaggagatatgactcattcattcactcactccaccctgcctctgcatcccttactgaagatcaaggcagcag

SEQ ID NO: 593998 - DNA, 361 bp, Homo sapiens
gcctttaagtggccccccccgcaagccgactggggttcgctacacccagaacgacatcgacacctgggccaatgtggtcgcccgctcgatccgtgccggaggcgggcgcaaaggcgacaaggtacatgtttcctacggctatggcctgttcaccggagggcttggtgcacactacggcgccgagcgcctgggctgtacagtcatccccatgtccggcggacagaccgagaagcaggtgcagctgattcgcgacttccagcgcgatatcatcatggtcaccccatcctacatgctcaacctggccaacgagatcaagcgccagtgcaccgacccgcacgagctaagctgcgcttggcatttt

SEQ ID NO: 593999 - DNA, 797 bp, Homo sapiens
  misc_feature (4)..(4): n is a, c, g, or t
  misc_feature (34)..(34): n is a, c, g, or t
gccncgctctgggcctctgctcaggctctgcgcnggacgacctcgaggcccttagttgactgggaccggaagtggcgtgtgctcggcctttctgtgttcctggcccgcgcgttcgggtgtgagctgcgccgaccgctctgagggttcgtggcccaccgctccttcgcggtccctgccgccaccgtccacgctcagcgttgtagagaagatggtgggtcggaacagcgccatcgccgccggtgtatgcggggcccttttcattgggtactgcatctacttcgaccgcaaaagacgaagtgaccccaacttcaagaacaggcttcgagaacgaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatgcaattgctgtgtgtggacagccacagcagttactgcaggtcttacagcaaactcttccaccaccagtgttccagatgcttctgactaagctcccaaacaattagtcagagaattgtaagtgctcagagcttggctgaagatgatgtggaatgagaaacaaatgtcaacataataaaatctcagttaaaaaatatttcaaaacattcttggtacgttgagcagctctgggggcaataagggcaaatatgcttgttatgaaactacactgaaatctaccaaacgttacatgttacttagggagat

SEQ ID NO: 594000 - DNA, 2489 bp, Homo sapiens
ggttgcagtgagctgagatggcaccaccacactccagcctgggcgacagaaaaatggctccaaaggttaaatgaagcaggaaaaatacatagatgcagccttgcagcctctccagatgtttggggataatattccagatagaaatattgatcccttggattaggtaactagtcataatgaagaaaattagtcttaaaaccttacggaaatcttttaacttgaataaaagtaaagaagaaactgatttcatggtagtacaacaaccatcgctagccagtgactttggaaaagatgattccttatttggtagctgctatggtaaagatatggccagctgcgatatcaacggtgaagatgaaaaaggcggaaaaacagatcaaagcgagagcctgatgggtacgctaaagcggctttctgcaaaacagaagtcaaaaggcaaggcgggcacaccctctgggagctctgccgacgaggacaccttctcctcctcctcagcacccatagtctttaaagacttgagagctcagaggccgataaggtccacgtcgctccgcagccatcactacaggcccgcgccgtggcctctgcggcccacaaactccgaggagacctgcattaagatggaggtgagagtcaaggccttggttcactcttccagcccgagtccagccctgaatggcgttcggaaggatttccacgacctccagtctgagaccacgtgccaggagcaagccaattcactgaagagctcggcttctcataatggagacctgcatcttcacctgtatgaacatgtgcctgtcgttattggacttatgcctcaggactacattcagtatactgtgcctttagatgaggggatgtatcctttggaaggatcacggagctattgtctggacagctcttctcccatggaagtctctgcggttcctcctcaagtgggagggcgcgctttccccgaggatgagagtcaggtagaccaggacctagttgtcgccccagagatcttcgtggatcagtccgtgaatggcttgttgatcggcaccacgggagtcatgttgcagagcccgagagcgggtcacgatgatgtccctccactctcaccattgctacctccaatgcagaataatcaaatccaaaggaacttcagtggactcactggcacagaagcccacgtggctgaaagtatgcgctgcatttgaattttgatccgaactctgctcctggggttgcaagagtttatgactcagtgcaaagtaatggtcccatggttgtgacaagccttacagaggagctgaaaaaacttgcaaagcaaggatggtactggggaccaatcacacgttgggaggcagaggaagctagcaaacgtgccagatggtcttttcttgtcggacagtcttgacgaccgtaccctttagctttgacttcgctccatggtaacacttcacactgaattgagcactcaatggagtagctttatgaacagcgaatgtgagcatacgtcatagtgatctaatgagcatcatcaggctcgaatgacttgtattcaaggttcggtgccgatttgcaacttccggtaaattgccaacagtcgtcagcagtgcgctcgtcagtacgtgtcgttggtaacggcagttccgataactatcaaactgcttgcaccatgaagattattcaggaaggctctgaagttgaaacctgatctgacctggatttagccagttgaatccagttcaaccttcaattgcatcaaatctttgcgccaatacattcagtttatgggtaaaaggtcatcagttgtttaggtgggaagtgccagcaagtgtctgggttatttggttctttaaaaaagggaagtcttaggtttagaggtgtggattatgtttcatcaatgtgcagatatcacatgtgaattatcaaattctcctcaatgcccccgccgcccagtcctttgctgctatccactgtgatttttatgcattaaaagcacatttcatgtgtattcaacctaagtaaagttgaatgaaacttacagaatggaaattgctatgtctttttaaatggtccattttcaaaagacagtgttgaataaacatacctgtgtgataaaacacagaatttacatatacactgaagatgagtttttaatctcttactttaaaaagatttatttagaatcgtgaattgacataatcttgggtaatggaacggagatctgcaacatatcttttaacaacacttttttataaattatttctaaggttgtgctaattcttttggttgtgaaaagttgaatttttctgttgccttcgttttcatcttctagtttgtctattttaataaatggccttacattaaaaaattgtaaagaaatgtataccaccaatttagaaattgttgccttttctgtaattaaactcgggtacaaattggcaaacatgaaaacctatggaactagaattattattaaagaaatattagatgatcac

SEQ ID NO: 594001 - DNA, 225 bp, Homo sapiens
tttgggcccccgggggggcccttttaaatcccttttttgggggcttttaacccgggtttggggctaaaaagggggcccccccccctggggggggggtttttttttgtttccccaggggggttttttaaaaggcccccggttttttttttccccagtcttggtgggggggtttttgtttttttgggccccccccccctttggggattaaggttttttttcccccca

SEQ ID NO: 594002 - DNA, 762 bp, Homo sapiens
  misc_feature (39)..(39): n is a, c, g, or t
cgaagaaacaagcacaatatattataggtcgataccggntttaattcgtacgaggctctgttcctggcccgcggccgtcgggtgtgagctgcgccgaccgctctgagggttcgtggcccaccgctccttcgcggtccctgccgccaccgtccacgctcagcgttgtagagaagatggtgggtcggaacagcgccatcgccgccggtgtatgcggggcccttttcattgggtactgcatctacttcgaccgcaaaagacgaagtgaccccaacttcaagaacaggcttcgagaacgaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatgcaattgctgtgtgtggacagccacagcagttactgcaggtcttacagcaaactcttccaccaccagtgttccagatgcttctgactaagctcccaaacaattagtcagagaattgtaagtgctcagagcttggctgaagatgatgtggaatgagaaacaaatgtcaacataataaaatctcagttaaaaaatatttcaaaacattcttggtacgttgagcagctctgggggcaataagggcaaatatgcttgttatgaaactacactgaaatctaccaaacgttacatgttacttagggagat

SEQ ID NO: 594003 - DNA, 991 bp, Homo sapiens
aaagcatcgggttagagacaacaaaacacatgcatctaaactgctagagcaatccagttgacttaaacatgtaacgaatggaattccacacacttaacacattcagctatatgacagaaagtaacatctactggactatggtattttgtgaatgatcttttaaataaacgaaaaccttacgctacataaacaaaaacaacaaatacaaacaacacaacaaaaaacaacacgggccggccccctcccttcacaactctcaccccacacggcgcccccaacccacacgccctcccacccctccatcattggaacaacaaggccccaccaacaaaccgagaacctccgcacatctaacactcccacgcagcagcgacgctcagcacccagcaccgccttccaacagatcacaccaccacatccgggaacagcacaccggcaaacacaccagggcaacaccctccccgaccaaaacgagaaaccccatcacatcaccacggccgcgatctcgcccaccaaaccaactggcaggaccaacaccccacaccccaacaacacacaagacctaaacgcacacgcccatcacgcaccgccctcaccatcacaatcacccgcttgctccaaaccgcccgcacacaaacacgcggcgtcgaacacacacaccagcaccgaactatctactcataccggcccacgaatactcacccaatattcggccgcccataccgagcggaaacacacagacaccctcctcgcagcagccagcgctctccacacccgcaccgcgaccaccactcctcctcgccaaacccaccctgctgtcgcgtcctcccgctcgcgcgcgaccacccgcggcacgacgtgcgctcagccgcacccacacccccctacaccaccagcccacaccacacacacgctgccgcgaccagcacaagcacacccaccaccacacacccactcccacccacaccccccaccaccgacgccaccgcaa

SEQ ID NO: 594004 - DNA, 807 bp, Homo sapiens
ggagctcactttgcatcagggagcacaaggaccaggccgtacagacactccgcctcccagcacttgatcagagattgtgtttatcctacagaaacagatgacatgtgttgggcatcactccccacggtcctgggtagaagagtccttcacttggcagggctttttcaaccaatgaataaggcaaattatatataagttaataatgccatttcgaaccgagacagatggcagctaaatgaagtttaattaaagaatgagtgctggggccctttttattgggtactgcatctacttcgaccacaaaagacgaagtgaccccaacttcaagaacaggctttgagatggaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatgcaattgctgtgtgtggacagccacagcagttactgcaggtcttacagcaaactcttccaccactagtgttccagatgcttttgactaagctcccaacaattagagaattctaagtgctcagagcttggctgaagatgatgtggaatgagaaacaaatgtcaacataataaaatctcagttaaaaaatatttcaaaacattcttggtacgttgagcagctctgggggcaataagggcaaatatgcttgttatgaaactacactgaaatctaccaaacgttacatgttacttagggagat

SEQ ID NO: 594005 - DNA, 865 bp, Homo sapiens
  misc_feature (4)..(4): n is a, c, g, or t
  misc_feature (34)..(34): n is a, c, g, or t
gccncgctctgggcctctgctcaggctctgcgcnggacgacctcgaggcccttagttgactgggaccggaagtggcgtgtgctcggcctttctgtgttcctggcccgcgcgttcgggtgtgagctgcgccgaccgctctgagggttcgtggcccaccgctccttcgcggtccctgccgccaccgtccacgctcagcgttgtagagaagatggtgggtcggaacagcgccatcgccgccggtgtatgcggggcccttttcattgggtactgcatctacttcgaccgcaaaagacgaagtgaccccaacttcaagaacaggcttcgagaacgaagaaagaaacagaagcttgccaaggagagagctgggctttccaagttacctgaccttaaagatgctgaagctgttcagaagttcttccttgaagaaatacagcttggtgaagagttactagctcaagtatttataggaaggaatggctaatgtaaggtcccagagaaggttaatttacctaatcaaggtcacacggtgaatatgagaagggcgtagaccatctgacaaatgcaattgctgtgtgtggacagccacagcagttactgcaggtcttacagcaaactcttccaccaccagtgttccagatgcttctgactaagctcccaaacaattagtcagagaattgtaagtgctcagagcttggctgaagatgatgtggaatgagaaacaaatgtcaacataataaaatctcagttaaaaaatatttcaaaacattcttggtacgttgagcagctctgggggcaataagggcaaatatgcttgttatgaaactacactgaaatctaccaaacgttacatgttacttagggagat

SEQ ID NO: 594006 - DNA, 1084 bp, Homo sapiens
aagcaggagaatcacttgaacccgggaggcaagaggttgcagtgagctgagatcacaccactgtactccagcctgggccacaagagtgaaactccatctccaaaaaaaaaaaaaaaaaaaaaaaaaccttaaatttaaccatttttaaaaattaaagggaagtttggaaaaaaatttttcacaaatagaaatttcataaaattttaaaatttttttgaagaaaaaccaatataggactttcgtggaattttaagggtgtaggaacgtgaaattgaaaaattatcaattaggggggcgtgaccaggatagaatttggaccttggcgagaaagacagaattcaccaatacttgacgattcggttgtgatggacaaagtgatttcagttattgagaaagagaagggaaagggacagtgaggaaaaagttgattagatttctgtcagaattcccgtgtgagaaacccctttaaggttgtgccagtgtttcccttaggggggagttcccaaaaaaacgggagcaagaacacaacagaacagaattaacaaggaattattggcattcaacaattggcttgacacacgtgtctccaatttggatggacaacattattagtctggcatttcaaccctaggaaataataaggtggtataaaactcacacaggtttcccccccagggggttgtaataagccaagtgtgttaaaaaggccaaggaccagattttggaaaggcgtgggacaccaatcgcgcacaggggtccccccataggggtttaacacagggaaatttctcattacagaagcccttcggagccaaagggtgttgagcggcacatatcctcacaatggtgtgggataaggatgggcgaacacattttccaatccggaaatttacagcacgggaacactggggttggacgaaaaaattagatcaggagtggggagagacgtcgacacagcatccaacccatcaggagcagtgacagaagaataccaagcggacagaaccacagtgccgagaccggcattcaacgtgatgccgccgcttaactaagacaatggcgaggcaatcagacatcacaggtg

SEQ ID NO: 594007 - DNA, 570 bp, Homo sapiens
gcgaagcattctaccaggaagcgaggtgactgacaagccctgtggagccccgtggagcgtccctgcagaggactccggccagctgagtgacgcaatccaaagagcgctcccgggtaggaaatggccccggtggaacgccttgccagagcagcgcatagcaggctcccgagaaggattaacactggctgaacaccgggaaggaaatggcacttgaagtccagacatcttgaagcttgtcaagactagtctttggaacttgccccactccatgtgagtggaagcatggcctgatcacccacggtgtgcctgtattgacatctttgttctggttttgacttggcttgacttggtaagactagtcttcggaacttgccccactccatgtgagtggaagcgtggcctgatcagccacggtgtgcctgtatgggcacttttgttctggttaggagcttgggttgacttggtaagagtagtctttggaacttgtgccagtccatctgagtgggaccgtgtgctgatcagccacaggatgcctgcacggggactcttgttctgggttagggatgctgt

SEQ ID NO: 594008 - DNA, 300 bp, Homo sapiens
tgctatcacattacagcatacagacacctaagcttgacagcgactgtaggggtcagcgtgcgggcagaagagtcagcgggatggatccacttgggcatccagtaagggcgcagccagtcagaccggcctgggtaatggcgtacaaagactcgacggtagtcatatccttcttgggtttcaggagtatagaagggaaatttctgggctgcattcgccatcatggcatcatcaacctgatgttcaacgtattcctgtcaaatcttaaaccaggaattcttaactgaagttattccatcactg

SEQ ID NO: 594009 - DNA, 1678 bp, Homo sapiens
tggggacttgggttcgggtttattggcccctcagcagggcagcggggatgtcaagggcctaaggctgggggctggcccgggctcacgccagggggtgtctaaacaggtggtgtgtggcacgggcgccgccgttcggccgccctcccaggaaaatggcggcgactgcgggaagtggtcctcgaaagtctcagctccgacggaaagaagctgcggccccttagactcgggggcggattggggcccagggaagagggccagggcgcggggcgcggggccacgcgcgcgcgggcccagttgcggtctccgcgcccctgcgcgcaacgcgaactccaaaagcgtcctcgagagaggagagagagagaggcgcggcggccaaccagcgcgagagcgggggggtttctcgccagagaggggcccgtgtggcgcgcggagcgccgcgtgtgcctcgcgagacggcccccacaagagcggcccccagagacacacttgcggaaccccagtgcgaggaaaagatagtgggcgtgagagcgaatccctctgggtgcggcgccaccccacacaacggacacaacacacagagaggcgcgaccgaaaagtttccgaactccagcggcacgcgcgtgacaccctgccgcgcacaacgcccgtgccgacactccccacgcgtgcgcacgatggccccgcgacgagcggccccctccccagcggcagacaacacacgttcgacgaggcagctcatcccgaggaccgaccccagtcgtggagcacaacacagaaccgaccgcgacacacgcgggagtagcatcacaccatggtctcaacaaccaccacgtctttaggaacaacaacgcgccccccaagcaggcccacaacacccacacggcaggctacgaatacacggcgatcaccagccccacacattccccccacccagcaggatccccccacgctactcccctcccacctactggccccagcaagtacccctactacaccccacggttgactgcttatgaacgacggacccccctcccccgaagacgcgaccaacaccgcccccccccccagaccaacaacagacagcacaaccctccctactaagtgagcgagctcccctcacacagagacaattgcgcgggcggcaccactcctgcttctgtcggcacatcatctcctccaccacagtcccacccctggtgggagacaccaccaagggatcaccacaacaatgcgaaccggtcggaacctggacagacgccgctgccgcagctgttgagcccctcataccatcatgagccgaggcccatcacacacgacgggggagcgatcgcgcacgattatgtggagcgcacccaccaagctacaccgtgtggcgacaaccaccagcccacacacaccacaacttagccacacagaacaaccacgtgcacgcgccccacctggcgcgaaaccccgcattgtgcggcccccgatgcgtaccaaccaccaacacctacgcgacaccggacacaccggagccccacatacgcacaggaccgcgacacaccactggcgcaccacacaccgcagcacctccaaaccccacagcctccccgacggcacccctgcgttcccacaacacccaccaccaccacctcccgcggcatcaacgacctcatagcgccgcacaccctgcccc

SEQ ID NO: 594010 - DNA, 357 bp, Homo sapiens
  misc_feature (55)..(55): n is a, c, g, or t
ttttgccccctcccccatttctcaaacccaaaaggggccgcctttgggccttttntttttttcccggttccaaccctagggggtccttccaaacccgcccccaaaaagccagggccttgggggcccccgtgttcccccggttttggccagggtttttgggggccattttttccccctttcccaggaaaaccccccccagtttggtttttttttgccccccctccgccccgtgggccccccaaaaatggccttccccgggatttttccgggattcccatttttggggaccccccctggttttccccccttttcccgggtttggggggggggttttcccccccccccccatttttttta

SEQ ID NO: 594011 - DNA, 380 bp, Homo sapiens
catttttaaagcacacctcacatttttgtcccaactgtaaagtaaacattatgaaatttggtagttaactttctattcaatttgactgctgtttctcgcatttctacttgagaaggtcactgtgtttgatcaaattctgggagaaaaagatgagatgaggcttcttggagcaacttcttcttgtgtggtgcttcactgagcttgtggcacatgttagtttggaaaggagatttgccttgaaaatggggtctctgaaccttctgggagggataaggtagtacagtggagttggtcatgcaaggatggctcttccaggttccaggcaaatctcctttccaaactaacatgtgccacaagctcagtgaagcaccatacggaaa

SEQ ID NO: 594012 - DNA, 779 bp, Homo sapiens
gcttgtaggtgcaagaattacattaattaatttacagtatgttaaaacagcacttgaatgcctgggaataaattcgtacttgttcatggtatataaattagtctatatacatttgttggacttcggactttgataactacttttgttcgacggcttttggtatctaatgttcatgaagagatactgttttccttgtactgtctttgtctagttacagtattcaagggtaatactggcctcatagaatgagttaggacatattcgtatttgcttctgtcctctcaaacgaacatcgtcgacagttcggcataattgtcttccttcagtactttaatagaatttaccagtgaattcatctgggtctgatacttgctgtatggcacctgttcttaacttatggatacgactttctttactagcatgcaggcctattcagattatctaattcttactcatatacagttctagtcatattgtgtcttatcaagccattctatccaggctatcaaatttatgggcactagccatggttcatccgtatccctttgtcatcattttctcgtctcatggggatctgtcactgagatctctctccatttctgctaatatcgcaatttgacataatcttttctacttaactcgctcaccaggcttacttggatccaatccatcctctgccaaggagccaacctacggcggtaatgtgatctctttgaatccacctgccaaaccccatcgaacctgcaccgattaaccccctctactcactccaacctaca

SEQ ID NO: 594013 - DNA, 313 bp, Homo sapiens
ataattcccacaccttattgtagcatcctctgaagcagagaccataacactgaacacaggatggaaaatgactcgagtgactggactcctttgaccaccatgcccagttaagttttgtattttcagtagagacagggtttcatgttgggcaggctggtctcaaactcctgacctcaagtgatccacccgccttggccacccaaaatgctgggattacaggcgtgagccactgcacccggtctaatccatgtagctttatataactttacaaaacaatgccctaaattttttttttttaaatcgtatcacagtg

SEQ ID NO: 594014 - DNA, 111 bp, Homo sapiens
aagtgctgttgtgacaggtggtacaattcagctattaagcaccgagacagggcttcaatttagtttgtgaatcctttaattgttgtgcagctaattacctcatcactgggg

SEQ ID NO: 594015 - DNA, 460 bp, Homo sapiens
tcgacattcaaacttggtctcaggtgtggtgagcagcagttttccctccatgcccattggtccggcacagcgggcgatgccaggctccttgtacccactcttcacccagccagacagccagcgcagatgacagtcacagtacagggggttggcaccgattgccctgggggttcgaggtcaaagatccgggtggaagggttaaggtcagtcgctcaattaaccaattagactgacagccaattcagatgaacgtcaggtagacaagtacaggcatgctctgaatgtggtgtaatactttcacctaccacaagagggggtcgtcttgcctcaaatacagttaaagctgcaatatgtacatttttggccattctaattgaaagcaagtctaagaaccaggaaatataaaagcaatttctgcatagtgcacctttaagttccatcactttaacatggtcgacgc

SEQ ID NO: 594016 - DNA, 362 bp, Homo sapiens
  misc_feature (42)..(42): n is a, c, g, or t
  misc_feature (68)..(68): n is a, c, g, or t
  misc_feature (108)..(108): n is a, c, g, or t
  misc_feature (308)..(308): n is a, c, g, or t
  misc_feature (339)..(339): n is a, c, g, or t
catttcgttccctcaaaactactgaactattggctgggccangcacagtggctcacgcctgtacttanaatactgggaggccaaggtgggaggattgcttgagctcangagttcaagacaagcctgggcaacatagtgagacctcgtctctactaaaagtaaaaaaaactagctgggcatggtggcacgtgcctatagtcccagctacttgggaggcttaattggaaggatcgcttgagcacaggaggtgtgaaggctgcagtgagctgtgatggcagcactgcagtccatcctgggcaacagagcangaccatgtattaaaaaacaaacaattggccnggcgcagtggctcacatttgtaa

SEQ ID NO: 594017 - DNA, 328 bp, Homo sapiens
catacattaggctagtgtttggtaggacaaaatctttttaaagccttgagaaatgtcatcccgttggtccacttttaaatacaaatgtttgccctggtaattagcaatgaaccgctggcagtttcttcacctggggaaaaacggatctggcttttaattgatgaatccacttttacaaaaacttttgcaggggcagggttgattaggccgtttagcctgccagggggattataaaaccccgggccccgcaaggaaagggctcttttaaaaaaaaagcctttttggaccaccttacctttttaaaaaccccataaaattttgcccccca

SEQ ID NO: 594018 - DNA, 114 bp, Homo sapiens
tgactttctcctgcctccagcgtcccacgcagctgggactacaggcgcttgccaccatgcccggctaataccttttttttggttttttggtaaaaccgggttacccctggtgta

SEQ ID NO: 594019 - DNA, 916 bp, Homo sapiens
gagtgttcgcgggagcgccgacctacaccagtcaacccagatcccgaggtccagacgaggcccggtccagaatccccacggccttgccaggagcaagccgagaaggcagcggccggacggggcaactcgctgcactccggagcgagatcatctgtgcttcgtaccggagcccggggccctgtcgcgggacccctgcgcccggcggggctaggagcttgcccaaaccggcccgggcccatgggtagaccgccagtccacaagacgggagtgcggcccacccacggcatgagggggtcgcaagagacaagggcccacctcgggatgtcggccaaccggagtcaccccggagtgtcagggagcaaagcgagggacctgcagggagctctgccaatgaatcggcttggtcgaaccttaccattcggagcgaggtgccgctccaccgtgggtaacacgggacgcaacgctaggggcatgcgccatttcgacgagtcaatccggagttcttgaaaccaagggggtacagcccagccagaggtggtggtcccggggcgcttccaagggccgcccatacaggaggcccgaagcgtcagaggatatagccccggatagaacccctcgtgacgccggatatagcgcaatggggaggggcagccctcggcgtgccaagtatgggcagccctggccccaagggtggcgaggaccgacgtacataacggggcgcactggacaatgcggacgcccaacaccccaaagtgaatggaggcggtgacgcaggagtaagcctggactcagagccttccgggcagtggaaacgaactcagggagaggctcatgagttggaacgctcccaaggcgacgggcccgaacatggaggagcacgggctccacagagagaaacgcgcgcaggccgggcaaa

SEQ ID NO: 594020 - DNA, 302 bp, Homo sapiens
  misc_feature (123)..(123): n is a, c, g, or t
  misc_feature (155)..(155): n is a, c, g, or t
  misc_feature (288)..(288): n is a, c, g, or t
  misc_feature (295)..(295): n is a, c, g, or t
gcctgtcttgaggataaaagccatgttaactagggtgagatgatatttcattgtagtttgtgatttgcatttctctggatgatcaataatgattgcgcatgcatttatattacctatttaccnatttatatacacttcttttcagcaaatgtctngtttattaccctacttttagaatcagcattatttgattgttttttccttataatagttgcttgagacctccttatatatacgtggttactaaagttgccaggatgggctagtttacataacattttctaccanttctatnggtgtgt

SEQ ID NO: 594021 - DNA, 317 bp, Homo sapiens
ctcatgttgaactgtaatccccagtgctggaggtggggcctgctacgaggtgtttggatcatggggacgggtatttcatggcttggtgctgctttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataat

SEQ ID NO: 594022 - DNA, 284 bp, Homo sapiens
tatcccccaaaaaaagggcctttttaggggcctgatccaaaagcggggaggggttggcccattttgggccccagaggctagggtccctgtttatttgggaacggcaaaagctttttttgggggtctgcctctaatttggggggaggtggaacaaaaatccccccgggggtccaaaagaaaatcccatttttaattcttccgggggtttttggggaattttcggaggggttttttccgccagggtctcaataattaagggttttttctgggagatttttaaggga

SEQ ID NO: 594023 - DNA, 558 bp, Homo sapiens
acacgacgtcgtgtgaggagttcgaaggattccaatattgcctggggacaagccagcgagagattgtgcacgcgtcgttgatagatcggccctcggagctcatcttcgcgggtgatagttttggccgccccaacacgcagttttcaattcgtctgcagaatgtccctatcgggtctaataacatgccgcacttccgtcatctggagacagcgaacttcctctttgtagatggacacgtcaaggcttttaatgacggtcagcgcgataaatgcgagatgtggaatcgcgatgcatccgtctgtccgtaactcgaattccatctgttgcccgaatcggaattcggtcaaagctcattaataacggccagtgaaagcaagcctcaatctggggacgttagctgacgcctcgaaagtaactctcattattattaaccctggattcaagtagtacgtgcaccaggttgtacctcgtagaagagttggttgggggtcggaacgtccagagtttggcgcggccggttattgagtcgctgcttgacatgatcgatgtgctgctgag

SEQ ID NO: 594024 - DNA, 1289 bp, Homo sapiens
  misc_feature (1124)..(1124): n is a, c, g, or t
gagtgactcggaggcgctcgtctgaggggtggactacctaagccgcagcgtggtttactgtcgttggctttactgcctcttctgatcaatctatgctgcaagtctgtgctcgtccctatctaggagcatggtgctctaagcgttgtagtcctgggggctcatggttgtcccttgtccgcgcgttcccgttcgtctgtgcgtcaccggttccttcgcataggtcgtgtgcctcgtgggagggctcgccgaccagtgcgtcctcagtggtcctggcgcgtatgtcgtcgtggtctctgccgctggagagctggtcctccaggcgatgttccttgatcatcggagtcttatggctctgtgcacaaggtaaagggatgtggtgcgcctgtgggtgttgttggcgctgcgtcatatccgagtcgggaataccagggtactcgcctattaagatcgtatgagcagaattcgggttaccaggacagcgttcgtagataaagatctccatcacctttaagagggactcgcgaaataagtagggatacaatgagttgagctggaaagctaatttctttcgcccgtgtcgaatcgatgggttagtcgtcatgaacgcacaatagatgcttcgaggaaggaggtctttcacattacagtcaattagaacgcaaggatggcccttcactggcgtgagcacattacggaagggaagcgatggattgtttgccttggtcccaattttcgtcacaatcagaagggtttgctttcaacatgaaggtagtatggtacggccctagaaagttcttctaacatgttggcacgttccatccatgtcattgggatacaacaccgcaaagggcaagagggcacctcaaaggggtaaatcctcgctgggtatagaatccccgctccggggcgagaggcgtatggaccaaggtaacagaagggggcccaaagtgggaacactctcaaagtggggtctttccaagtaccctttgtgaattcgattggttagcggccaactacgaactcagggacaggctttggactgctttttcaaaggagccagaggaatggttaaccaaccaattttttggcttcgttcacgtaaaagcactcagaaacaaacagtngagtcaccaaaagtcacttcgaagtggccccacatgagatggtcccaagcttacctttggggtacagggaaagcacacggccagcaagttagggaaaacaagctggcctaaaaacattaggtgggaaaggcctaaggggtgaagcgcctggagggtttagccaag

SEQ ID NO: 594025 - DNA, 148 bp, Homo sapiens
  misc_feature (13)..(13): n is a, c, g, or t
  misc_feature (105)..(105): n is a, c, g, or t
  misc_feature (116)..(116): n is a, c, g, or t
actgtcactggtntttacagaacatacacagtgaatatcttctttgtacatcatttcgaatgtgttctgttgctatatctgtaggtcagatttccagaattgaanctcctggaacnaaaggataagaatcgggtagttacagcatgca

SEQ ID NO: 594026 - DNA, 1255 bp, Homo sapiens
gtcaaatctcgcactctgttcttccgtcgctccgccggtcgcgattatctctgccggtcgcaagtggacagaatgagatcgcccgcgcgtgtgtcagtttgacaagtggctcacggccatgtgtcaacacgtgtggattttgcctggcgggacgacgtcgtccccggagccagtgtttcgcttccatcgtgcgtgggcgtcgcccagatcagccaggccgatcagtggctgcgtgcgatgggcccatgaatggacttcctaccagtgggccgaggacgagccccgagaagcataggcgtgcgtcactcctgactcctggaataggtaccccagttgacgtcgatggcagtcggtcactcaacatgagactgaacatgtgatgaatgactcatggcaaccacaacacttcttacaagacagacgcttgcgccgatggcccccaggaggagccacgctcaggtagctagcatgagcagacggcccccaccggaacccccgaaggcccagacgacgaggacgacgactgactccagaattgagtgttatgatgcaccatttcaaacaacactccgggtccaatggtaccgcttggcccattccaaggggccgctgcttgtttccctctttaacgcactcatgggacggcagcgactttgggtcgatatgattcagttgcgaccttccgtgcgaggaacggggggttcaatccacgagtgaacgggtttgtcatccagttcgtaccctaagagggacttaaagacgccttcgcgcatcaaagtgccctaattccgctggacggatatggggaatccctgtggcattgagcaccgagtcgaaactcttgaaaccagaaaataaaccttccaatttgaaaggaattgcgtacaactttgaaggcacgaaaggagctaaacagcacttacgaagcgaaaggccacacaggagacatagaaagcctgggggaaaaacaccccgaggggcgccccgaaagagcatccaaaagagggaggagaagccacaggagagctcctacaggagttcgtcccccttgaaacatatcgagaggcagagcataaagatgacgacaacacccaaccaggaaaacgtaccgacaatactttctgggaacgaaagaagacgaaccaagagcagcgacccccgacagtagagccaacagcgtcaatatacacaacttgggtggtcgaagaggacacaggactccgagacggaccccagagggaccacagcatgtact

SEQ ID NO: 594027 - DNA, 563 bp, Homo sapiens
taatctccagaaggttcgcctcttacggtgcccgtgcttccatgagtagccgtgaccaggtgaaaaagtggagaggaaccagccggcacagggaggggtcatactccacaacattcccttacaccccagttgccaaacagaccccccacccccgtggatttctatcatcccttccatccctgaacggaattcgttggcactatcccaaatcgtgactattgtgactcatatttagatatccatcattggagccctagaatacaatcaccacagatgcaccacacaagagacaccccaagaaagaagagagagaacgaccatgtaaatgatatcatacaaaacattctccaccataatcctccaaaactcattagagactacctatccactcatcttttcccccactagaaaaatatcccctaatttcaccatccacacgcccaaaataaacaacgacatcttgagtcacaaaaagccatcatacattatataaaccaccatagcctaatacatcaccctacaaaaaaaataccatagcccaaaatcaaaccacatctcatctg

SEQ ID NO: 594028 - DNA, 273 bp, Homo sapiens
  misc_feature (36)..(36): n is a, c, g, or t
  misc_feature (79)..(79): n is a, c, g, or t
ggcacgagaggttcttagacagcaacattgactctncagtgccaaacgaagataggccatgggtagtggcatatttttnctgtggggccacattctttcgctctctttttctttgtatatatcagagagagaagtgtatcatacacttagaacaatgcagaagacacagagtttaaagaataatgacaaacatcccagcacccaccacattcctagtgcctaagaagccccctgggtgtccatatccctttgacacccagagttcactgccat

SEQ ID NO: 594029 - DNA, 429 bp, Homo sapiens
cagccgattcgttatgaggcgtgcgcctccgggttgccactgtacattccactagcattgccttcttatttaacttctttgagctgtttgactttgtaagatgcaaagaggttggatcaagtttcaatgactgtgctgcccctttcacatcaaagaactactgacgacgaaggccgcgcctgcctttcccatctgtctatctatctggctggcagggccgccccccccttgcatgttggttttgcccgaagtggggtggaagccccccggtggcccccccgtgccctctcgcgtgttccccccccggcccggggtgtcctgcaggcgccccccagtttattcagagtgccctttttttttttgttcaaatgattttaattattggaatgcacaatttttttaatatgcaaataaaaagtttaaaaactt

SEQ ID NO: 594030 - DNA, 431 bp, Homo sapiens
acgtttgaatacattctcccaagactgaggttgttcggttttaattcctgtagtccaatcacacaatttcttatggaaaaccttttgtgtttctggtatttaataacttgaagggatagcaaaatatcctgtgtattcaggaggccctcttcgcaagctggctaagctcagagcaccaaaaggtggtaagtgcccaaggacatttcattatctattaaaagcgtgcacaaccgtggataacctattaacactatttaacaacaaagtgtctatatgggtgtaacacctgaccttgttataatttggatgtctcaaatgtagagattatctaaaaatcgtaacttgaataccttgtaatttttctcttaaaaaagaagacttgtgtaagtctccgcatctacgccaatgcgcatgttgcttggaggtaaaaa

SEQ ID NO: 594031 - DNA, 3323 bp, Homo sapiens
ggcctctggccgcctggctccaacatcaagcaccgggctccgagtggccgggatcagcgccccgaggcagaggccggagggcgcgcgcactgctaggaagtgctggtcccccgcgccgctctgccagcttggtcccccggcagacgcccctgtacgatcgccgctcgccccgcgggcgaggctgcggtggacagcgcggggctccggctggctcgccttcccgcctgccgtgtcctgctgagcgaccctggagtacacatccagatgccagcccagctaccacaggggatccctctgggagactgaaagtacaggttctggggcccaggttgaagccgaccaaccctgagcctcaggccaggggaatggcagcccccttggaggcccaggaccaggcccctggggagggagaagggcttctgattgtgaaagtggaagattcctcctgggaacaggaatctgcccagcatgaggatggcagggattccgaagcctgccgccagcgcttccggcaattctgctacggggatgtgcatgggcctcatgaggccttcagccagctctgggagctctgctgccgctggctgcggcccgagctgcgtaccaaggagcagatcctggagctgctggtgctggagcagttcctgacagtgctgccaggggagatccagggctgggtgcgtgagcagcacccgggaagcggtgaggaggctgtcgccttggtggaggacctacagaagcagccagtgaaagcctggcgacaggatgtgccctcggaggaggcggaacccgaggctgcaggccggggatcccaggccacggggcctcccccgacggtgggggcacggaggcggccgtctgttccccaggagcagcacagccatagcgcccagcctcctgctcttcttaaagagggtcgtcccggagagacgacggacacctgctttgtctctggggtccatggacctgtggcattgggagacatcccattctatttctcccgggaagaatggggcaccctggaccctgctcagcgggatctcttctgggacataaagcgggagaactcccggaacaccaccctgggttttgggctcaaaggccaaagtgagaagtccctgctgcaggagatggtgccggtggtgccaggccagacaggcagcgacgtgactgtgtcctggagccccgaggaggctgaggcctgggagagcgagaaccggccgagggcggccctgggcccagtggtgggcgcgcgacgggggcggccacccactcgccggcgccagttccgggacctggcagccgagaagccgcacagctgcgggcagtgtggaaagcgcttccgctggggctcggacctggcgcggcaccagcgcacgcacacgggcgagaagccacacaagtgccctgagtgcgacaagagcttccgcagctcctcggacctggtgcgccaccaaggcgtgcacacgggcgagaagcccttctcctgttccgagtgcggcaagagcttcagccgcagcgcctacctggccgaccaccagcgcatacacacgggcgagaagcctttcggctgcagcgactgcggcaagagcttctcgctgcgctcctacctgctggaccatcggcgtgtgcacaccggtgagcggcccttcggctgcggagagtgcgacaagagcttcaagcagcgcgcgcacctcatcgcgcatcagagcctgcacgccaagatggcccagcccgtggggtgagcagctgacttggccggaaacccgggggaggcccagccacggcacatcctgctttgttcaccactgggactctccttccatctgtggccacctcccgggctgtccgagggaccccagggtacctcacactcggagctcgcctgccctgcttggctctgaggacctgcccagcgctcaaagggaacggaagccttcccctcccgcccccgatcttgtcctctttcccccttctgcgcctagcgttcctcttcccctctagtttcctggagccccaacacattcctggcagggacagcagggtggcaaggactcaggtctaggtcccttcccagaagcccccgagcctcatttgactgtgtggctctttggcccccaccctgtggggtgggtccatgggtcaggcctctgccctaccaacctgtgcctttcagtgggcgtggaggactggccttggccccccagggggctgctggactttgggagagacagcccacacctgtgggaccgcgggtcttagtcacggcggcaggggctttctggccccctcccactcccgtttccaggccatgaccactctgccctgtcctggccatacggactcggcctgcctttgccctcggcctacttgccctagcatgaggctctgagagccacctgcccaccaatctggtgaggataatggtggctccagcgacaggaggccaaccctggagaccaagaacagggcgcctggctgccatcttttcctccagaggtggggctgcaccagactcagcactagcactccatcagcactagcacctcactccatcagcactagcacctcactccatcggccccggcaccctgctccatcggcactggcgccctgctccatcggcactaatgctccactcggcgccccactccatcggccccgctccatcggcactaatgccccactcggcgccccactccatcagcactaatgctccactccattggcactaacgccccaactccagcggcactaatgccccactcggcgccccactccatcagcactaatgctccactccattggcactaacgccccaactccagcggcactaatgacccgctcctttgacattggtgccccactccatcagcactaacgccctgctccatcggcactggtgtcccactccattgtcactaacgtccggctccatcggcactaccaccccgctccatcatcactatgtccagctccgtcggcactaccaccccgctccatcatcactatgtccagctccgtcggcactaccaccctgctccatcatcactacgtccagctccaacggcactggtgccccattccatcggcactaacgccccgctccaccggcaccagtgcctcgctccattggcaccaacgcccagctccaccggtactggctccccgctccatcggcactaacgccccgcttcattggcactttgctgctgcctcctgagcactgccttccatgaacagggacagaccagaggccgtgcaaggactccccctcagacctccaaagggcaacagaagagtattaataaacgtgaaaactt

SEQ ID NO: 594032 - DNA, 695 bp, Homo sapiens
aaaaaaagaaataatatattcaatgtactaaaaagaaaaatattgccagtgaagaatatggctttaatattctttattaaatataagcaaagctattcctcagaaatgaaagaaagataaagtctttttcagatatgcaaaaactaagggaagactaggcttacagaagaaacgactcaaggagagttttagatctggaagtgaagaagacaataacctactcaccatgatgaaagacgaagatgaagattataagaaattcactggtagagctgatatgcaaaagagaaagagaagaggaatcgaaaccttatcactacagaaaaccactaagccacaaaaataagcaataaggaggattagagagaaacggaagtatacaaccggaaaaccatcaataaaacgacaagagttaagtcctcagcgtaccaataaataaccttgaatgtaaataaattatattccccaattgaaaagacgttgaagtgaatgaatgaataaaaaaaccatgcaaactatatgctggcaatataaaacactcacctcacctgtaaaagacacaccaaagactgaacagtgcagggcatggcacagcaattactcaggcaaaccagaaaccaacaagtgagccagaagtagctatgctgatgtcagataatacaggctatttaagtagcaaggtgatcgagacacag

SEQ ID NO: 594033 - DNA, 3322 bp, Homo sapiens
ggcctctggccgcctggctccaacatcaagcaccgggctccgagtggccgggatcagcgccccgaggcagaggccggagggcgcgcgcactgctaggaagtgctggtcccccgcgccgctctgccagcttggtcccccggcagacgcccctgtacgatcgccgctcgccccgcgggcgaggctgcggtggacagcgcggggctccggctggctcgccttcccgcctgccgtgtcctgctgagcgaccctggagtacacatccagatgccagcccagctaccacaggggatccctctgggagactgaaagtacaggttctggggcccaggttgaagccgaccaaccctgagcctcaggccaggggaatggcagcccccttggaggcccaggaccaggcccctggggagggagaagggcttctgattgtgaaagtggaagattcctcctgggaacaggaatctgcccagcatgaggatggcagggattccgaagcctgccgccagcgcttccggcaattctgctacggggatgtgcatgggcctcatgaggccttcagccagctctgggagctctgctgccgctggctgcggcccgagctgcgtaccaaggagcagatcctggagctgctggtgctggagcagttcctgacagtgctgccaggggagatccagggctgggtgcgtgagcagcacccgggaagcggtgaggaggctgtcgccttggtggaggacctacagaagcagccagtgaaagcctggcgacagggagtaaactctgtctcccccggtctggtctcgggctgatgagcatgttgtggttcctgcacaggatgtgccctcggaggaggcggaacccgaggctgcaggccggggatcccaggccacggggcctcccccgacggtgggggcacggaggcggccgtctgttccccaggagcagcacagccatagcgcccagcctcctgctcttcttaaagagggtcgtcccggagagacgacggacacctgctttgtctctggggtccatggacctgtggcattgggagacatcccattctatttctcccgggaagaatggggcaccctggaccctgctcagcgggatctcttctgggacataaagcgggagaactcccggaacaccaccctgggttttgggctcaaaggccaaagtgagaagtccctgctgcaggagatggtgccggtggtgccaggccagacaggcagcgacgtgactgtgtcctggagccccgaggaggctgaggcctgggagagcgagaaccggccgagggcggccctgggcccagtggtgggcgcgcgacgggggcggccacccactcgccggcgccagttccgggacctggcagccgagaagccgcacagctgcgggcagtgtggaaagcgcttccgctggggctcggacctggcgcggcaccagcgcacgcacacgggcgagaagccacacaagtgccctgagtgcgacaagagcttccgcagctcctcggacctggtgcgccaccaaggcgtgcacacgggcgagaagcccttctcctgttccgagtgcggcaagagcttcagccgcagcgcctacctggccgaccaccagcgcatacacacgggcgagaagcctttcggctgcagcgactgcggcaagagcttctcgctgcgctcctacctgctggaccatcggcgtgtgcacaccggtgagcggcccttcggctgcggagagtgcgacaagagcttcaagcagcgcgcgcacctcatcgcgcatcagagcctgcacgccaagatggcccagcccgtggggtgagcagctgacttggccggaaacccgggggaggcccagccacggcacatcctgctttgttcaccactgggactctccttccatctgtggccacctcccgggctgtccgagggaccccagggtacctcacactcggagctcgcctgccctgcttggctctgaggacctgcccagcgctcaaagggaacggaagccttcccctcccgcccccgatcttgtcctctttcccccttctgcgcctagcgttcctcttcccctctagtttcctggagccccaacacattcctggcagggacagcagggtggcaaggactcaggtctaggtcccttcccagaagcccccgagcctcatttgactgtgtggctctttggcccccaccctgtggggtgggtccatgggtcaggcctctgccctaccaacctgtgcctttcagtgggcgtggaggactggccttggccccccagggggctgctggactttgggagagacagcccacacctgtgggaccgcgggtcttagtcacggcggcaggggctttctggccccctcccactcccgtttccaggccatgaccactctgccctgtcctggccatacggactcggcctgcctttgccctcggcctacttgccctagcatgaggctctgagagccacctgcccaccaatctggtgaggataatggtggctccagcgacaggaggccaaccctggagaccaagaacagggcgcctggctgccatcttttcctccagaggtggggctgcaccagactcagcactagcactccatcagcactagcacctcactccatcagcactagcacctcactccatcggccccggcaccctgctccatcggcactggcgccctgccccactcggcgccccactccatcagcactaatgctccactccattggcactaacgccccaactccagcggcactaatgccccactcggcgccccactccatcagcactaatgctccactccattggcactaacgccccaactccagcggcactaatgacccgctcctttgacattggtgccccactccatcagcactaacgccctgctccatcggcactggtgtcccactccattgtcactaacgtccggctccatcggcactaccaccccgctccatcatcactatgtccagctccgtcggcactaccaccccgctccatcatcactatgtccagctccgtcggcactaccaccctgctccatcatcactacgtccagctccaacggcactggtgccccattccatcggcactaacgccccgctccaccggcaccagtgcctcgctccattggcaccaacgcccagctccaccggtactggctccccgctccatcggcactaacgccccgcttcattggcactttgctgctgcctcctgagcactgccttccatgaacagggacagaccagaggccgtgcaaggactccccctcagacctccaaagggcaacagaagagtattaataaacgtgaaaactt

SEQ ID NO: 594034 - DNA, 643 bp, Homo sapiens
  misc_feature (124)..(124): n is a, c, g, or t
  misc_feature (131)..(131): n is a, c, g, or t
  misc_feature (202)..(202): n is a, c, g, or t
  misc_feature (208)..(208): n is a, c, g, or t
  misc_feature (263)..(263): n is a, c, g, or t
  misc_feature (282)..(282): n is a, c, g, or t
  misc_feature (292)..(293): n is a, c, g, or t
  misc_feature (295)..(295): n is a, c, g, or t
  misc_feature (301)..(301): n is a, c, g, or t
  misc_feature (306)..(306): n is a, c, g, or t
  misc_feature (339)..(339): n is a, c, g, or t
ctcactcccaaaatcattagacaaacctctctcccaggtaccagctcctgaccctctactacaacaaattttcctcctgggtcagcaactccacgaccctcagtccaccactagacctttcccnccctggntcgccagctttctgaccctcgaactataacaacaatgctcctgcctcagtctgcagctccacgaccctganactagnacaagacgtctcctccctaagtctccagcttccggatcctcgaattgcaacaacnttgctcctgcctgggtctncagctccacnnanatcaanctagnacaagacctctcctccctgggtcgccagcttcntgaccctcgaactacaaccaaattgctcctacctggatcagcagctccacgaccctcagaccagaacaagacctctcctccctgggtcgccagcttccggaccctcgaactaccacaaaattgctccttcctgggtcagcagctccacgaccctcaaactagaacaagacctctcctccctgggtcgccagcttccaggaccctcgaattacaacaacgttgctccttcctgggtcaggcagctccacagaacgtcaaactagacaagacctctccctcctggtcgcagctgaggaccatcgtt

SEQ ID NO: 594035 - DNA, 416 bp, Homo sapiens
accgtgggacctttattccgagcatacacatacattttggtgaagcgacaactgatatggtttggttctgtgtccccacccaaatctcctcttgaactgtactcccataattcctacatgttgtgggagggacccattaagagatcatttgactcatggggggcagtttcccccatactgttcttgtggtagtgagtaagtctcacgagatctgatggttttatcaggggtttctgcttttgcatcttcctcattttctcttgccactgccatgtaagaagtgcctttcaccttctgctatgattctgaggcctccccagccatgtggaactgttaagtccaattaaatctctttttcttcccaatctagggtatgtctttatcagcagcatgaaaatggactaacacagatgttg

SEQ ID NO: 594036 - DNA, 427 bp, Homo sapiens
  misc_feature (124)..(124): n is a, c, g, or t
  misc_feature (131)..(131): n is a, c, g, or t
  misc_feature (202)..(202): n is a, c, g, or t
  misc_feature (208)..(208): n is a, c, g, or t
  misc_feature (263)..(263): n is a, c, g, or t
  misc_feature (282)..(282): n is a, c, g, or t
  misc_feature (292)..(293): n is a, c, g, or t
  misc_feature (295)..(295): n is a, c, g, or t
  misc_feature (301)..(301): n is a, c, g, or t
  misc_feature (306)..(306): n is a, c, g, or t
  misc_feature (339)..(339): n is a, c, g, or t
ctcactcccaaaatcattagacaaacctctctcccaggtaccagctcctgaccctctactacaacaaattttcctcctgggtcagcaactccacgaccctcagtccaccactagacctttcccnccctggntcgccagctttctgaccctcgaactataacaacaatgctcctgcctcagtctgcagctccacgaccctganactagnacaagacgtctcctccctaagtctccagcttccggatcctcgaattgcaacaacnttgctcctgcctgggtctncagctccacnnanatcaanctagnacaagacctctcctccctgggtcgccagcttcntgaccctcataaacaatccctactcatgaaatgtagcagtcaggaaaactgtagaggaaataaataaataaatgttttcctatcaaaa

SEQ ID NO: 594037 - DNA, 1385 bp, Homo sapiens
ggtggtcactactatggagtttcttccttaacactgattagatgatcttaactccctcagctaaaactggcattactgactcccagctatatttctccagacttgcattttttattatattattggaaacagggatctacacggatcgcccaggcgggagtgcaggggccgtgatcatcagatacacggcgtgaatattccctccgagggacatcaagcgagtcactcccacgctaccagcctactcgacataacagggacatagtaactactgtgacagacaccagtgcacgagcatacatttaacattaatggagaagagagagcagctccatcaaactagtgataacacacagggattcgggactacaaacataccgtgaaaacaccaatagagtgcaaccactaccataatcgatcaagaccaatcaccaaaaagagagaatagagagataacaaagacaaataaggacacaaacgagtatgcacagtgactcaataagaacatgagaaagcagttagacagaacgtgtcacgcaagtgatacgatcaccgatggatagtgacacacaagaggaggacacagacaagagaagaaaaaacacaaaaagcaaactatggcagtcacacaaagacagtataacatacaaactcaataagcaacagagacagcagtgataacgaacactacatggcggagaactacaataccacaaacaacaagatgtaataagacaacaaggacctacaaagcacaacagcggcagataatgtgaaataaacaacaaaacactaaagtgagaacaaagccaaagaaaacagcagaatcaaacaaaatatataacacaacaacatgacgtgtagacacataacacacacaaaacacaaaaaagatgacaacagagaataaggaagaagaggctagacaccgaaaacacacggcgaatataacgaaagacgcaacagataactaaccaacatacagaaacaaccgagagagcagaagtcaatacaaagtcacgcgcacagcatgagaaacaacaagagagagcgagaagcgcaataccaaaaagaatgcaaacagaaggctaacacaaacagtacacacaagaccaaatagaaacaacacacagtagaaagatgcacatagaaaacaaacaaagagaacaacagcacacaacatataacaagcaacaaaagcacccacgaacaacacaaaggaacacaccgcacaaaaagatatagaagaaacataatagcacaccacagtcaggcgaaacagttccacaactaacacacaagaacaaacaagccaagcaactataaaaaagagagcacaaccaccaacaacaaatcaaaaagaaactagtaggagagacagacaa

SEQ ID NO: 594038 - DNA, 128 bp, Homo sapiens
  misc_feature (82)..(82): n is a, c, g, or t
  misc_feature (97)..(97): n is a, c, g, or t
  misc_feature (105)..(105): n is a, c, g, or t
  misc_feature (109)..(109): n is a, c, g, or t
gcgcgagcacagagcctcgcctttgccgatccgccgcccatccacacctgccgccagctcaccgtgtatgatgatatcaccncgctcgccaccaacnacggctcnaacntgtgcaaggccgccttcaa

SEQ ID NO: 594039 - DNA, 410 bp, Homo sapiens
gggatgcgttagatgaggcgagatgagattgtactactgtcctccagtctgcctagatctgcacgactcagtgtgtagggatgacagatggcagccagactgctgtggacttaggaaatactcttcgttacagaaccttactgtggtgcctaacatattcccaagctactggactcatgagattattctgtcttaatcactagctgtgatagcactacagacagagctcacaagaccaatgattctgtcactgttacctacgttctttgacttaatagccaatcttatgacttcagagtacattgtacggcctagaccaggctgttaatggactgattgtcgaacagaaccgagtaatctgggtttactgggttctttacatgtgatgagctacggccgattgatgtatc

SEQ ID NO: 594040 - DNA, 282 bp, Homo sapiens
aacatgacgcagctcctcatccacggcgacgtggcagagcaggatgctattaaatgggaaagcagataggaccaagatgatataatactttggctttatctttaacatcctattttttttttttttttttggaaatggagtctggccctgtcgcccaggctggacctgcaggggcttgatcttggcctcacgtgcaagctcgtgcctccccgggttcacgttattctccgtgcctcagccgtgccaattacctggaactacgggcgcccaccaccagtgccg

SEQ ID NO: 594041 - DNA, 326 bp, Homo sapiens
  misc_feature (49)..(49): n is a, c, g, or t
caacccaacgcagattccaatcaggcaagccactgtgggactgcacgtnactcactttgtccagctagatcaggtacctttttagatcctgtgtcctcaattatactggactgtcaactgcctgaggtaaggaaattaatcttttacttcttcagccttcgccttctcaacttgttccagctacacttatcaacggagttgagttcttatcaggtcctcagacatataaatgatgcaaacctagtgccatttctggtctggcctaactctaaggtagaagagttagggaataaaagttaataaaagttttcagtacatttatctcc

SEQ ID NO: 594042 - DNA, 344 bp, Homo sapiens
actgacgctctgaagcaatgacctggtggaggcttggaagagacaagcagcaatgctagaaccgtctgttcatgcgtaaccagacacgccgtgcacgcgttagatacctttcttagaacactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccc

SEQ ID NO: 594043 - DNA, 134 bp, Homo sapiens
gtgatcaatatgtggggtgtatttaaagcattatgagtgaaatgtattttataagcatttaatattaatgctctgtagaatggaacgcagataacaaaccttataagtggggcctaaattaatctgaaccaata

SEQ ID NO: 594044 - DNA, 414 bp, Homo sapiens
caaataccttagtaccttacaggtagattctttctttctttctttctttcttttttttttttgggaggcgaatccgtcttccaccagaaatggagtgtcgcggggccaaattctgggttcattgaaagctctgcctccgggttccccacctttctcttgcctaagccttcctgaattagctggacactacagttcgcccgacaccacccccggttattttttggtattttaagtagagcacaggtttccccggtgtaagccaggatgttctggatctcttgacctcgtgatctgcctgcctcggccccccaaggtgctggaataacaggcgtgacccattgcccccggcccagtattgcttctaaccaggaaacccttatgcccgaaccatttgccccccgcccggtacccgag

SEQ ID NO: 594045 - DNA, 400 bp, Homo sapiens
aatagatgaaattaatacctatcttcattctgcccctggcttgtaatattatgattacctatttctcatataatagttatattttagttacagtttaatgattgaatctttgtggcatttcctttgtgataatatgagatctaaaaacttacttttcctccaaatgccacccctttcttttgtacattgggaaactgagccttaggctgtaattagtccagagtcactgggctggttagtgtcagagctgtttcttatgacttatagagtactgctgattttttttttacacggatagacctgggtttaactctgggatctgttactaactcgcctttcgtgtgttgtgccggacaggtcacttaacctctcaaagtctctaattaagtaaattagagaa

SEQ ID NO: 594046 - DNA, 377 bp, Homo sapiens
tttattttttgattctccttcaccccccaccccgggggtttcatcttttttgaacacatctttttttggcctctgtccccttttttcattttttagctcccctcccacctggggggcagtggggtggaaaaaccccaggccttagattttttttgctttccttcctggggccccgaggagggcagccaaagggggtggggtttcccccccccccgcccttgggaagaacgggggttttttcttttcccccccccctttttcccctgccccccgggttgggccccttttgggtggggccgtgggtccccgattggctcccccttagaatgttagaactcccacccaaatttttttttaatttaattttgggtttccca

SEQ ID NO: 594047 - DNA, 696 bp, Homo sapiens
  misc_feature (440)..(440): n is a, c, g, or t
  misc_feature (442)..(442): n is a, c, g, or t
  misc_feature (454)..(454): n is a, c, g, or t
ggcaggtggatcacttgaggtcgggagttcgagactagcctggccagcatggtgaaaccccgtctctactaaaaatacaacagccaggtgtgatggtgcacgctcgtagtcccggctactcaggaggctgaggcaggagaatcgcttgaacccggaaggcagaggttgcagtgagctgagattgtgccactgcacgccagcctgggcaagagagtaagactctctctcaaaaaaaaaaaaaaagagaattttaaaatctcccaatttataatttctcttaacctcttttaattgggattgttttttaaacacacagttattcaccttattagttattcccttattgttgtcttcattctatgtgttttgtgcgtacacagtggttacacttgcacattttagattattctagaaaggttcacttataccccctttgcctntntccttctcgccnatttttaatattctcaagtgcgcttacactttgtgccgagaaaaagagctacaaagagcgagacacacaatattcacatgagctttatatccgaggctgagtgtgtctcccactgtgcgcacacagagacacagaaagagcagcgcgagggccacaaaaaacactgtgagactcagagtcgaggaaaatcccggttatttgagacacatttttctcaccgtttttcaactttctctttaaaa

SEQ ID NO: 594048 - DNA, 241 bp, Homo sapiens
ggatccggttgcagtgagccgagatcgtgaccattgcactctagcctgggtgacaagagcgagactccatctgaagaaaaccaaaacccacagacgtctagcgccagatggtctggggcttagcatcacagcgtttgcctgctttgcatctcccagcatttgcgtgagcagctgttgtgggctatgagctcgtgtctctcttcctatctcttgccttttttttgggggggggggggaattc

SEQ ID NO: 594049 - DNA, 165 bp, Homo sapiens
tcactcaacagagactgtactacgcaaaattgtcgttcattcaagcggaaataatgatcaagcggcacgaggtaggagcagcagaacattcgggaggaactaaataaaaagaggaccccagaaggagatggacgcatgccatgctaatccggcacggcgagtcca

SEQ ID NO: 594050 - DNA, 295 bp, Homo sapiens
  misc_feature (19)..(19): n is a, c, g, or t
cttttaaaggttttttttnccatttttttttcccctttttgggtccccccccctgggtttctaaagggaaaaccatttgttgggcccatttaatggcccaattttttttttccccaggccccgtttaaagggggggcttccgggggttaaaaaatttttttgggggtggttcccctccctccccaagggcttaagggggggttacccttagggttgatttttaggggttcccccatttgggtacctttttttttttttgggggattaattacccctggtttttggggggcccgga

SEQ ID NO: 594051 - DNA, 139 bp, Homo sapiens
agagtgatggcagagtaagctcagtgtacagagtgtcagtgaatgtgtagagaagtgccaggtgcagagggatcagtgtccttgattcagcataagatcacactgtgtcagcgcgtggacatgggcagcaagtgctggg

SEQ ID NO: 594052 - DNA, 885 bp, Homo sapiens
ctttttaaccccgatttttccccccctctcgacgatgtggttgttcctgccccctgttgccaccatgcgtgttcccccccccgccaggaatgactatcatggggggtcgtagaacactatttgacgcccccttcattgggccgttttaaacaaccccccatttctccttgcgttttaattccccacaattttgtcgatcgctagccttctatatcattgtacacaagcctgtgcaacacctctcccaccttttgttgccccccaatctctgaggccttaaataacaagcatgctaacacacggcgcacacaattgttgtcctgcaataacattctcctcttatgcaccgccggttctcccccccattggtacattatttctgacacccgactgtgccctccaacaccgggactacttctattaggagcgagtctctcctacaatcttaaggggctggaggccccaccatgtattttctttgtatgcaccacgcacacatcgcacaccactttctctgtgtgcccaggcaaatgtgcacacttcgccgcaaatgtcttctctgccacactctccaaacgtcgtgtcatcacaaaattctttcacgctcgcgctcaaattcaatctcccgattgccactgaatcctcccggtacaacattatcggggcaaaaattatgaaacataatacacattcctccggctatatggacatattattaacaatagaatacggcacccttttctgctacaaataagcactcctattattcactctttgtatagacgaacttatgcgcgaacaacaagccctctggtctccgggtttcaatacggtttcttttttgttccccccccaagtgttaaaaaacacaccgcccacataaca

SEQ ID NO: 594053 - DNA, 354 bp, Homo sapiens
gttatttcttcggctacgactccgagaccattcgcctgttcaagggcaacagcccggacggtgtcggcaaaagcttcaaggacaaccgcgacccgaatggcgtctacgtcaaccgtgacctggtgaaagtcggcaaggacggcacccactatctgcaatacagctcgacgcagcccggccagaccgaactggtgcccaagctcggctacaccgaatacctgcccaagtgggacatggtgatcggtacgtcggtgaacctggacggtatcgatgcacaagttgccgaggttcaggccaaggtcgagaagcgcatggaaggcgtggtgctgagtattatcgggattgccgtggtag

SEQ ID NO: 594054 - DNA, 207 bp, Homo sapiens
actggggaccccaagcatgtgtgacacagtcttaagggtctatgtatgggtgtgccagtatttacatagtagctaaacaggtaatagaaggtgcttagaatgttcagaaagaccaatatttaaaagactttatagaaaacagttaccgtaggaaggtctctcagtttaaggcctttccagagtatccaagtcgactacactgaaatg

SEQ ID NO: 594055 - DNA, 127 bp, Homo sapiens
ctcggcagacagcgcagtagtgagggggcagtgagagtgcgcacagagtccttcacaaaccacagaacacacgtggccttcaacacaattcccctctcctcttccaaacaaaacatacattgatctc

SEQ ID NO: 594056 - DNA, 207 bp, Homo sapiens
ggacgtggagcggggccatgaagagcctgccttgatttaaagcaaggtaggataactactttggactttgaattaaaggagaaggacaattctcggcgaaagtgccttaaacttcctttttgcttaaaaagagtgtatatctttcccctcgtaagagagagagctggagcgtcggctttgacaaaactgacgaacagactgtgcaaa

SEQ ID NO: 594057 - DNA, 668 bp, Homo sapiens
gcactgtaattccagctgcttgggaggctgaggtgggagaatctcttgaacctggggggctgctgtgagccgagatagttccattacacttcagcctgggtgacagagtaagactctgtctcaaaaaaaaaaaaaaaaaaaaaaacaaatcctggacaattcaaaaaattttccgggaaaatttggtccagggcccaccaattgaaacctttggtcggggtagatacacttttcattaattatacttactccatcacctcttctcatatattttcagaaagtactagtagcaaagtgtttgcaggagttcactgggagaaccttatttaaaatgcagcttctgatccaggtgcaccgtggggtggggcccgtgagaagtctgcatttctcccaggctccgtggttgctgccagtggtgctgcctctgagttaccaggggggtggggaatgatattggagccgctccataatttatcccatctgcacaaaatgagtcacagagccctttaggtaatggacggggggactcaggctgattctgtaagcgggtgttttcagaccacagacgtttgcctgccaaaccttggagtaggtaatcatgaagggtcccttaaacttgctgtgcaggttgaaatgacgctcaaaagtaaaaggggtccgcaaccccg

SEQ ID NO: 594058 - DNA, 708 bp, Homo sapiens
gcggccctcatgggacagactgtacggcccaggctcctccgggcctggccagcgtggttatttataagccctggctgcctccagtgtgcctggatcagactggcttgtttgggtcaccggtgccaagttttttctttctttttctttttttccaataagaatctacgtctgagcatggacggaatcccagaatcaaatcactggatcaatacttggtcaccaaacacattcgagacctcaaaagctcaaaggctgtagggtaggtacccttgctacctactctacctacagacaaagacgctgagaaatcagataacttgtccaaggtcatggacagctgggactagacccatggcttgtcacactctaccagccttattcttaacctctctgcctgatgcctcttgacccacattcgactttgaaaaagttttcgcacttggttcatcggaaaaagccacacacagctgcccggaggactctgttaatcagtagctggttgcttctggcccagtgggcaacatcagaggcagaaagtacagtacagagagaaccgcaggccagcagttgcatctgaacccacgctcttcctcccagccctttcccttgtcttgactcacaacctagtgtcctcagtatcgcccagcacgtgaggcagccggttcactccagccttgaccagggccatcgcgggatcagagcctcctc

SEQ ID NO: 594059 - DNA, 323 bp, Homo sapiens
cggccgccacaggttctccagtccattcctaatacactgcccccgcacctactctaggcccctcgctcatatgcggaggacgagccgtgctctgcatctatctagccctcacggccctcctcaaaccgagactctccactcccgtgagcccttctgtgaggcctctgggcttccaggtactgctcttctgaccggcatggcttccttctctggcagcgtggaatgttcctcttcactattcagaatgtccaacatcactcttaggcctgggcgcagtggctcacacctgtaatccctagcacttagagaagcggtgacggccg

SEQ ID NO: 594060 - DNA, 347 bp, Homo sapiens
  misc_feature (203)..(203): n is a, c, g, or t
cacacagcccggttcgcaacatctttctggacgaagttgaagcgcccctggacacgtgagactggggctctgagcccacctggctccccctgcagccccgattcccaccctctgccgacgaccttccgagccgcggcttactcgccctgtccctcaagtacgtccccgccggctccgagggcgcaggactgcccccgagcggngagctgcacttctggttgaaggaggctcgggacctcctgccgctgctagcagtatccgtggacacttacgtacaatgcttcgagctgcctgatgacagccgacccagcctgcagcgtacaagagctgtgcgacgcagcctcagc

SEQ ID NO: 594061 - DNA, 616 bp, Homo sapiens
tgtatgcaagtgtctagtgctgtaatgggaatcgtcactagagaattgatgttggtcgacacatgccagggtggcaagggctagctgtgaagatatttaatcggcacaaagaaagtcaacaaagcaggaagtggcagttgttggtctgtgataaaaaactgattgacaagtatcagaaatttgaaaaggatcaaatcattgattctctaaaacgaggagtccaacagttaactcggcttcgacacccgtcgacttcttactgtccagcatcctttagaagaatccaggtaaatttttacaaaaacttacatagtagacttcctgaacaaatagttaaaaataatttgatatttgaaatctgtttcaagtattgtcagtgaaaaattcttatactctaagtgttgagttcttatgcattagttttctccctaaaatttatttgcattgtctacgtatatgtctctctttgaaatattaatactttctttactttggccatgattctgtacttcagtggctaccctgtgctcatgactacaatagtcaaaatagaacatacaagggtatagaatacagttcttgcctgaaagtagctgtccttgctaatttgctagaa

SEQ ID NO: 594062 - DNA, 804 bp, Homo sapiens
  misc_feature (310)..(310): n is a, c, g, or t
  misc_feature (565)..(565): n is a, c, g, or t
ataatatgggtgacagacttgcgtgcccttccttctaaaaggtgtctctttcaccctcccgatgttaatcttactcgcctcacttggtgtttgctccgcctcggctcgtggatatatacttatcgcacgatattttttatcttgctggctcaatcaaacagaggcgtatatctataaggaagtaccacccgggtgggcctcgctcccacttcatgtgtttgtatgacatgaattaatgcgacgctccctaactgcggcatagccacactatgtatagtgatggtactcccactgctgtttaaagttgcancccgcctgtcttatatatccggtcgcgctagcgttgttcaattgtattggtccactccccccttatggacttctctctctcacggttgattccgactatgagacttgttcgcgctctggctcaccacgctttgttctgtcggcagctctctccttcgggctactcccaccactcttgtcttcggtggtgtcaccactgcacggcgtctcactccccgtttgtgtcactcactctgtgctcttatgtgtggcggcngccacacatgttctctctcctcactgctctctctcatctgtcgtctcctctcctccgcactctgtatatgttcctcttctaccacttcccccacgcactctcatcatgttcgattttgaacaccccgccgccggaaactcttgctctatttgttctaataagtcgtgtttgtcttaattatattgaataggccaccctcattttgtatgtgacagtctctacaaacaattatcaaacac

SEQ ID NO: 594063 - DNA, 174 bp, Homo sapiens
tctagaggatcctgtgaaaatagccgagggggcggctgaagctgagttcaacccactggtgggtcgagcttgattcatggctatggctgaggtgtccaaggtattctggaggtggtgtggcctgctggtggatagggctggggcccagtggtttcccagtggctgcatactggc

SEQ ID NO: 594064 - DNA, 374 bp, Homo sapiens
  misc_feature (120)..(120): n is a, c, g, or t
  misc_feature (125)..(125): n is a, c, g, or t
  misc_feature (130)..(130): n is a, c, g, or t
  misc_feature (132)..(136): n is a, c, g, or t
  misc_feature (139)..(139): n is a, c, g, or t
  misc_feature (150)..(151): n is a, c, g, or t
  misc_feature (153)..(153): n is a, c, g, or t
cgtcgaccttctgctctcatggtatcatgattcttgcagagtgaggcaggggcagacattcttccataaatccagcttgtttccctgcatctgccctgggccagcactgggctagtcgtnggacntcctncnnnnnccncttcctctccnncncctcccaggaacggaagtgctctcagagagagctacgttaaacctgccaccaccccttattcatcaagacatttcagcttaattgttccttcgacaaatagttactgagtacccaccacatgctctatgttctggaaatacagttgtaagcagcacagaatgatctccactcttgggtagcttacattctgggggtgggatgagagaaagataataaccag

SEQ ID NO: 594065 - DNA, 168 bp, Homo sapiens
ccgcattctcccatcagcggatctatatattgacctctgtttggttataacaactgatcgcatcttgctcccatcaggcgtactcaggccggtgtggtcgtaagcgagaaactatctcttggtgcacatatacagtctgatgggacgaagatggctgatgggactgat

SEQ ID NO: 594066 - DNA, 699 bp, Homo sapiens
ggagagaactagtctcgagtttctttgtaggttttttaacaaatgaggcaatttattaacccagcatggttggtcctaatgcttcttgtgggcagcgtgccacctgtccggcgattctgtccaaatctcttggtccctgcaggtgtcagttggcggccgccatctgggtccttttccaccaatttatcagcgccctccaggggcttggaggacccggggggccacacttcttggagcctcggctgaagtggctgggcatgaagccgtattctctgacgtcccccaataaactctgggctcatggagccaaccccagggccaccccggaggttacaggttgccgcgcttgtgagaagcagcctcgcgttgttaaaccagttctcactcgatagggagcaagctcttgggtgctgtggccagctttgacgggtatccacccattcggggaacttccacagagcttccgcggaacttttggaggaaggtctgccagaagtctctgaacaaactccctggcgggtccacgtccttttaccagtaatctccgaggcatcgtgcggactaaactggagcattgcattctcttgatcaaccagatgatcaacggttcgttcttccacaaagaccccgttgtaaccttatgaggcccccggacccccgcacgccggaaccaccacaccacgacgagaacgtgggaga

SEQ ID NO: 594067 - DNA, 958 bp, Homo sapiens
gaggtttgtcgtgcgaccgttgctgcaggtggtccaggcttgggaccttgacgcgaggcggctgggtccgggcgctgaggcgggaaccccagtgaaagtggtgtttaccttccggataggtgttggaacacgaaagcgcgctcctgggaagtcagccccgcacaggtccacccatcctgaagggccctaagtgcccagggagcaacgaggagtaaacaacccgctcgaggaagtccgacattcccgcgctccccaagcagctgggaaagagttctggggctttccgctcacgatagaaggcttatcccgggggcacaggaggcttgagcagttgttaatgacgcatagttaaagtccagcgccattctcggggaaaaaccaggggaagatcctgcttggaagggtcgccaggctcatttcagacgctctcaagggctgtgagcttgttgccaagaggatgtcttcttaagccgtcttagtaataacctagagaggagttgcccagtcgataagctgaaaagggttgtcagcctcattaggggtgaccactttgacggatatcagcggatttgctccgacccttcgttaacgccctccaaggacatactgggggatttttggcccaaggcctgacccattgtttaactgatagacattatccaaagatttcagtttcaggctatttcacgtcgccctttatttattgggattttgtgacaaattctcccgtgaccctgggaccccgtgggggaccaatttcttgagatctcgccggctggggcacggctggcagcaaggtgttgtctcccccaaaggctgtgttggattccttggaccccccaaatgctcccgggcgggtttgggcgccatttccgggtgccgtatcaaagacatctggttgggaaccgggccattacgtgccccgggcctcggtttattggtggacactggggctttg

SEQ ID NO: 594068 - DNA, 400 bp, Homo sapiens
  misc_feature (5)..(5): n is a, c, g, or t
aactncttcctatttctacaccctagttatgctcccttcccctactcatcgtcactaatttatcactcacaacatccctagctcactaagcattctactactcactctcactgtcctcaagaactattaaacattctgagccatcaacttaatatgatctagcttacacaatagcctttttatagtaaagattcctctttcacggactccactgatgactccctaattcccatctcgaatccgctcatcgttgggtcatatagtatttgctcgtagttactcttaaaactaggcggctatggtataatacgcctcacactcattctcaaccccctgacaaaacacatagcctaccccttccttgtactatccctatgaggcataattataacaagctcca

SEQ ID NO: 594069 - DNA, 427 bp, Homo sapiens
cgagacgagatgagacatcaatgccacctctctggacagagagatgactgggtgatgacactacaggtcagcatgggaacacggcgtcccagatggacgacgggtcgtgtggctgtctcgtccagctcctcacgttaggctagcaggaacgcagacacattcatggtgcctttgctgagagagatgcctgaggctcttgaagtcacaaaggggaggagtgaagaaatcctgcatctcagtccctcacaagatagctgtctcaggctttgcaagctgtgagagaaactatcagagccctgggcgactgtcgctggacgcagcctgagagtagctccctccttttccacctgagctcttcctcctgcacatcacagtagcgaccacagctccgatgagcacaactgctaggacagccaggccagcaaga

SEQ ID NO: 594070 - DNA, 677 bp, Homo sapiens
gtcggtccccaaatacttccagtcactgatcttgacgaagcaaacaaaaacataaagtggggaaaggacacccttttcaaaaaatggtgctgggataattggctagccacatgtaggagaatgaaactggatccttatctctcatcttatacaaaaatcaactcaagatggattaagggcttaaacctaaaacctgaaactataaaaattctaaaagaaacattggaaaaacccttctagacaatggcttaggcaaggatttcatgaccaagaacccgaaagcaaatgtaataaaaacaaaggtaaatagctgggacctaattaaactaaagagcttttgcatggcaaaaggaacagtcagcagagtaaacagacaacccacagaatgggagaaaatcttcacaatctatacatctgacaaaggactaatatccagaatctacaacaaactcaaacaaatcagtaagaaaaaaacaaataatctaatcaaaaagtgagctaaggacatgaatagacaattctcaaaagaagatatacaaatagccaacaaacttatgaaaaaatgttcaacatcactaatgatcaggcaaatgcgaattggaaccataatgcgattacatcttaatcctgcaagaatggccataatacaagaatcaagaacagtagatgtggcgtgg

SEQ ID NO: 594071 - DNA, 173 bp, Homo sapiens
aggataagatccagacgtccttgtcagcttgtctctagtcttcaggactttgtgaataaatcaggtggagtaagtaatttacatgttcgtgtctcatttacttttggcaacaaacaaccgcacctttactgataataggagattaagagctaatttctactcttattattttt

SEQ ID NO: 594072 - DNA, 121 bp, Homo sapiens
attctgctaatatcatatacactaagatagttgtcccttgttatcagcacttaactcttacttgagatgtacaaagtagatcctactaatattgctcctttggaagtagaacaactgggcg

SEQ ID NO: 594073 - DNA, 630 bp, Homo sapiens
  misc_feature (29)..(29): n is a, c, g, or t
  misc_feature (95)..(95): n is a, c, g, or t
  misc_feature (109)..(110): n is a, c, g, or t
  misc_feature (113)..(113): n is a, c, g, or t
  misc_feature (116)..(117): n is a, c, g, or t
  misc_feature (126)..(126): n is a, c, g, or t
  misc_feature (135)..(135): n is a, c, g, or t
  misc_feature (154)..(154): n is a, c, g, or t
  misc_feature (183)..(183): n is a, c, g, or t
  misc_feature (192)..(192): n is a, c, g, or t
  misc_feature (199)..(199): n is a, c, g, or t
  misc_feature (211)..(211): n is a, c, g, or t
  misc_feature (215)..(215): n is a, c, g, or t
  misc_feature (220)..(220): n is a, c, g, or t
  misc_feature (224)..(224): n is a, c, g, or t
  misc_feature (233)..(233): n is a, c, g, or t
  misc_feature (235)..(235): n is a, c, g, or t
  misc_feature (242)..(242): n is a, c, g, or t
  misc_feature (251)..(251): n is a, c, g, or t
  misc_feature (260)..(261): n is a, c, g, or t
  misc_feature (263)..(264): n is a, c, g, or t
  misc_feature (269)..(270): n is a, c, g, or t
  misc_feature (290)..(290): n is a, c, g, or t
  misc_feature (298)..(299): n is a, c, g, or t
  misc_feature (314)..(314): n is a, c, g, or t
  misc_feature (317)..(317): n is a, c, g, or t
  misc_feature (323)..(324): n is a, c, g, or t
  misc_feature (334)..(334): n is a, c, g, or t
  misc_feature (359)..(359): n is a, c, g, or t
  misc_feature (381)..(381): n is a, c, g, or t
  misc_feature (383)..(383): n is a, c, g, or t
  misc_feature (395)..(395): n is a, c, g, or t
  misc_feature (417)..(417): n is a, c, g, or t
  misc_feature (428)..(428): n is a, c, g, or t
  misc_feature (437)..(438): n is a, c, g, or t
  misc_feature (440)..(440): n is a, c, g, or t
  misc_feature (445)..(446): n is a, c, g, or t
  misc_feature (468)..(468): n is a, c, g, or t
  misc_feature (471)..(471): n is a, c, g, or t
  misc_feature (482)..(482): n is a, c, g, or t
  misc_feature (485)..(485): n is a, c, g, or t
  misc_feature (491)..(492): n is a, c, g, or t
  misc_feature (495)..(495): n is a, c, g, or t
  misc_feature (522)..(523): n is a, c, g, or t
  misc_feature (575)..(575): n is a, c, g, or t
ttttcatggtgcggaacacaatatttatnttcatttgtttcttttatttcattttatttgtttgcggctgcggttttattatttttactgaaggnagagggacctttgnngcncgnntccctttcncggtaggcngccttaggcgttcgaaatngggggcatctaggcaagcggaagggaaanggggggggngcaaaancactcggggggngggngaggnggcnttgttaatngngccctanggggggggnttaacggcnngnncaagnncgttgcacttttaattaatngtgcttanngctttaattaaatgnggngggggnngtcggggggnggcgcgggcgggggggggggcgggngcggaaggggggcacggcagtngnggggcacacggnggatgttctcagtgtccacagngcaggggaaanggggggagnngnagggnngcccatctccacgggcagggcngancctcagaaacncancgcgannganggacttggcccgggtcacgcggggggnngcgtccgggctcgggagtagcatcctcaggagtagtgtagcgagcaaattcnggaaaggagtcctcaatcttgcgagttcccagcaaggactttctcagcgagcaga

SEQ ID NO: 594074 - DNA, 1600 bp, Homo sapiens
catatgaccatacaatgcactgaattgacaggttaatcactaagacactggcaaagagaagctgtctaaaagcttcaaaatgttccacttttttttccttcactggagactgctttgtttggctttcttccattgttgctttttgtagccactttactcttcagcaaactgctgtactttccactaactccagcaggttgctaacaacccaccctacgtgctcttctagctgcgcttacaggccaaccactctctgacacactggcaccaccctacacagacgctctacgcgaacttctatactagcgcacgctactgcgcagcacttagcgcgctccaagcatacctcctactgtctaccaccccgtgttaaactgctatctacgcgcacattacacacactgctttaaaaaaatatattctggtagacccctagtgcaaaatttatccttttcctattttatatttaacaacttcttccctacaactctctacacacacatctcaaataaatatatccttctgccccacaaaaaaaccacaaacaaaacacatacacaccaacactacatgcagaccgcagagacaccagactctcattcctgattaacgagaaggtctaaaatttcccacactactacagagaaggggaggaggacccaccaaaaaagaacgtatattaccgcgcagcggtatacacccccgcacaaggtccctactgataacccacttgtgtcactacacaccaaaacatgagcggtgggggcactccccccctataaaacatgcagccgctgggacaacgtcatccaggctattaatcttatacatcattaacaccgcccacaattacaggccgcgcacaaaaccatgttgcgcaacaacccgcccggtagccaacgagactgtagctgctacctcacaacaccagccgccggcatcctcagcgagcgtaaagacaacatacacgttgcgcgccgaccaacaccaaaaccacctcggttggggctcgcataaaacacccatgcttgtaggacggccagcagaacacctacttctcgacgccactacagcaccacgtgtggaaccatccagccactattatacaaccactttcatcagatgtaggctgctcggcacctatctgccgcatgacacacgcgacagtactacaagcactgttactgcggcgcgacaacccaacgaatactcgactcatcaaccagcccttataaaccctcgccagcgacaacaccttctttcaaaaccagcaagcgcccccatcacacttaacacgcggcgccatcaccaccagtcaagtgcatgatgacaaaaccaaactgtctgtcatctcagcacgaccgccgtgcacctaatcatacaccagtcgtcgggctgacctatgcacaacccccctacacaatacccggcgatgaacacacatacatcgatgcccatactgcgagcatgcagtattagtatgaacacaacagacggtcatttgcaggcgcccacgtctcgacgccgacgagcaagacgcctttgcagtgcacgcctgctctctcctgtggtgccagacgacagcacagtactatgaact

SEQ ID NO: 594075 - DNA, 272 bp, Homo sapiens
taaaagggggtgggatgggggtacccaatggagtatgttttatggttccccaaaaaatggaaaggaacccaggccctgagtatggagcagcctggagaccccccccccctgcaggggtgccctgagggcctggatttttggttttgatgccaatactagtccccccaagtagtttgctcccagtaacccaaaccccaagtaaactcccctttcccccgctatgggccctgatatgggtttataattttttgaaagttaccccctgaagccca

SEQ ID NO: 594076 - DNA, 741 bp, Homo sapiens
ggcgggttggcaagaacaagcgtccttacgatagaggcggtaaaaaggggagccgagatagtaaagtggtagatccattttctaagaaagattggtatgatgtgaaagcaccgtgctatgcttcaatataagaaactattgggaaaggacgctcgtcaccaggacccaaggagaccaaaattgcatctgatggtctcagagggtcgtgtgttccgaagtgagtcttgctgattcgcagaatgatgaagttgcatttaggaaatattcagagtctgattactgtaggatgttcaggggtacagaagagctgcgctgtagctaatcgttccatggcagtggcagtcttaccctgtgacaaacatgtgttccatgggtcaaaaaactggcagacaatgattgaagctcacgttgactgtctagactaccgatggttacttgcattcgatcgtgtgtctgtggttggttttactatacaaacgcagacaatcagagtacggaagacctcttatgctcagtaccaagcaggtccgccaaagtccggaagaagatgagtggaaatcatgagccgagaggtgcagacaaatgacttgaaagaagtggtcaataaattgattccagacagcacttggggcaagacatagaaagaggcttgccagtctatttatcctctccatgatgtcttcgtctagaagagttcaaatgctgaacgaaggccaagttggaacttgggaaagctcatgg

SEQ ID NO: 594077 - DNA, 504 bp, Homo sapiens
cccatgactgttctaactcttaagcggtgtgtcaagctgtcatgactgaataagcttcaatgcatgattctaaagtatgtacacttcgagaataaggtgcttcacacatggtggtcgctgaacagttgattcttccattcttgactagatgaacctgtgcggtggactgatacattttatcttactgaatatgaattgtttatgtatctgtactgtcaaatagcctttttgaaactcaggaaagacaaaggttcaattacaccacttttgtcaataagcaaaccaggtatttttttttttctcctgttgtctggatatggcaatagattttttaaattgctgtgagaacccatatatgaaaagagaggagttgaattgtgtgtgccttttatgtcttgagatttatatgtggaaaagacgacatctacttcaaactgtattttctttttcgtttttttttttttttgggaaaggggggaaaacggggtctggctctgtacccca

SEQ ID NO: 594078 - DNA, 209 bp, Homo sapiens
ggcatctctcatcatcagcatccccaccatgatgtggtatgtatgttacagttgatgacgccgtcattgacacattctatcacctaaagtccatagtggacactagggttctctcttggtgttgtacttgctgtgggtttggacaaatgtattatgacatgtattcactattatggtgtcatacagaataatttctgtgcccatttcaa

SEQ ID NO: 594079 - DNA, 170 bp, Homo sapiens
gctatattatctagcccagagaactacgataatgttcagtgagatttactggactcgagtggatttctgaatcgtctgagatttgagtgcttattagaacggggccctttggcacatcccgtgccgcccgtcaccctcctcaagtatacttcaaaggacacgaatgttca

SEQ ID NO: 594080 - DNA, 222 bp, Homo sapiens
ccctgttcaccatggaaactggcttcatagcagccattttttaaggcagcttattataacatattcttcctgtgataattcaggagctacaagtctgccccattcctgagagttagctacaaagaattaaccatatgaccccctcacatattttctttatggagaggactataaatgttacttagtaagaacttccagctctatttaactcggacaactcgt

SEQ ID NO: 594081 - DNA, 116 bp, Homo sapiens
cattgagagtgcccgcactccacgcacacttcacacttgcccactcagccatgcactcacactaggtgcacacaccgctacttgctccacacgacgtaacatcatatcgtgcactc

SEQ ID NO: 594082 - DNA, 571 bp, Homo sapiens
  misc_feature (571)..(571): n is a, c, g, or t
ccttttaaatacttacgcagtaatctaatcagaaaagatacagaagacaccgggcatagtggtgcacgcctgttagtgccagtcacttgcggggctgaggcagaaggttggcttgagccctggaggtgtaggttgcagtgagccgagctcgcgccactgcactccagcctgagtgacagactcttgtctccaaaaaaaaaaaaaaggaaaggaaaagaaggaaaagacttagaagagtttctgggggcttcaatagctaagttgggagggatagaaaagtaagtaatagggccgatattttggagcccatcacaattctcactttctggctgagttaccacaaagatagtttctcaataaaggtctattacgcagtaaaggtatctcttaggggggtgaactcctttaaaaagtcgcttacattaggtctccttcatatacattgggtaaactattacggcgaattacactggggcagggtgtttttaccccccaaagggttatttttccattggaagaaacctatagaacaaattattacctaggttccagggagaaagtggcgctttan

SEQ ID NO: 594083 - DNA, 454 bp, Homo sapiens
atggcccagttcacccagtttgatgaagaactctataaggtgattggcaagggcagcgaaaagagcgatgacagcacctattgaccaggagccatctaagaagcagaagaagcaacatgaaggcagcaaaaagaaagcaaaagaggtcaccctggagaaccagctgcagaacatggaggtcactgaggcctgaacactgcctcctcccagtttgccagacttacttgctgcctgctgggatcccaggtctgccctggaacagagaggccgagtaccactcctcaccctgtcccatctgactgcacagcatctgggtccatctgccgggtactgcgcgggtgttcccatcatctcgaatgggcccagggtctcctcactgatgactggtgaagccacgcaataaagcatctctggggagggcacaagacttccccagtctcctccccaggcttga

SEQ ID NO: 594084 - DNA, 1794 bp, Homo sapiens
gctcagaggttcttgagaaccagagcagccaggccgagctgaaagaggcggtggatgagccatcatcctagacggtatgttatggtagataaatgatgaggagagacggaggaggaggaggatggtcaacaatcaaccaccctctcagccatgtctccccagtcggaaatatccgaggtcacatcagtgctcgaggcgggcacgagtgagggccgtctctcagcgtggtctggttggtacatgatgcagatacgggcccctgacgtagcgggacgcctcagaggttgggcataggacataagacgaagaaccaaggaccggcaggacgcgacggacgcgacggtacggtctcgcaggcctgtgagtacgtgacgggcatcgatcctcgcagaagtggaaacgtatatgcgcaccacaacatgatacagttagacttgaagacactccacaacaccagaagcactctgagcatagccataggattgacttccgggactcagtgccgactctgtctgagtctggacgagctctagagttcagtgagactagagacgctatgtgtgaagcgctcgttgcgccgcgcgattgacgttatgggcctctaccggaacccccacgataaaggggacaacgcgcgaacgatacgcgatagagatagcatcaatcctcaagccttaggacatccgataggaccgcgatgcgaccgagatccaatttgggcacaaggttgtgcgttcaccccgggcgcaacgtgtacaattctcattgtctgggagagcggttgggcggtgaatacgaaccagcaggggaaggcaaggctttgggtaaagggcattgggtaacgtggatgcggcctgacagtgctttctcctcaaaaaagagaaatgtcttggccctatttgaggacttctacatctaaaccatggcttagggaaaggccacaaacggaatggaggggccttcacaagtgcctatttgagtctctatacaatggcactgtctttgtacctattcgcgggtaatgaaagccacaaccggaagtgttctagtggcgaccgccgggggctattgagggggttcattgcgcaattgcgaccgcgcacggaattgccagcgtgcacacaacggtatggcccaatatgaaaaactgggtcacttggacacatctgccgcaggtggcgcacattagagagtgttcacctgaagtttctaacagaggccgctcacatgtgaggggctgcgcccgttttcccccacttaagatgtaggagtcaggcgccccttggagggttagacaaacttacaacgcatagggaacggccttgattgggggttccgccttaaaacaccggcttctctccacatgatcttgggaccgctactggcacatttgggacgccaaagggaacagtgctgcgcacacttttgcgtgggggggccacacctggacgtataaaagtggtggcaacaagcgacttcaaggcaagcaaggcatctgtcattggggaaagagaaacccaccctagttgaggggagaggcacggtataatggacgtcccacacaggtggcgatgtgtgaaaacccacccccgcgagtagtagacatatgttactagcggacgcaacaacacatcgggggagggaggtagatacacccagcgaagacatatcccgccgatagaaagcagataagactcgcttgtatacaccagccaaggaaataaacacgcgtgcgagaaagacaagagatagttgttaatagcacgagaggttctctacaacgacagatagcac

SEQ ID NO: 594085 - DNA, 251 bp, Homo sapiens
cgcccgtcaaaaccaaactgcgctgataataaagtaggtatagcaagtcagctcacccctgatctgtactaactactctagacccctctttctgcatttatttgaacttccctcccatgttgctcagccccccccctagaaactcccccagtctcttactatacataggtctcacagctaggcttgacccctgctatgtgtattgcaaagtaattgccctcccctaatctaacccattctaacatataatg

SEQ ID NO: 594086 - DNA, 147 bp, Homo sapiens
gagaagaacgcggaacccaagtagctttgtggcttcgtgtccaaccctacgtgccctatcgcctgtgtgcctggagccagacccaccacgctacgcgtctacctcctgatagtagctcacagagtcccacgcaccgatatgcattcc

SEQ ID NO: 594087 - DNA, 158 bp, Homo sapiens
cgtccttcctgtgtctgtgcggacgtcgactgacatgtggtcccacgccagtgcttctccctcacctatgacctaaactgtgacaagctgtgtactgacttccaggaagacattgagttccatttctctctcgggtggaccatgctggtggaagggag

SEQ ID NO: 594088 - DNA, 201 bp, Homo sapiens
gggcggacaggtgtaggtgggttgtgtcaccggcggagaggtcggcagcgaccggatctgcacccaccacagaaggcttttctcccagtacctggtggtctgagcgtcgtaggggctgcaagtgcaggcgctagctgtcgcgtgggatgcgtgcgtggcgccgtagcgtcgaggccagaagccctacagaagacttcgcga

SEQ ID NO: 594089 - DNA, 174 bp, Homo sapiens
taagagagacagtaataatgtcaaggatagccggtgtgggcagaaataggtagtctgtgctttggaatgtcagctgtagagccaactctgattatctagcgattgatcatacaaatggatagaaacattagtcagtaatttcaggttcgtgccaaatcgttcacaacatctaaa

SEQ ID NO: 594090 - DNA, 498 bp, Homo sapiens
  misc_feature (482)..(482): n is a, c, g, or t
agaatctgtaatgagaacacaacagaaccggttgcccgaaagtgacaggggtagaagggaagactggaaccagtgaaaggagtgccttcaagctccatgccgcccctcccgggctggggcctgctgcctgctggctgtgctcagctgcttcatgctgatgcactggggagtctcctgccgttgcccacgccctgtcggtgcctcactgagcccttcctgagtgtcctgtcctatgcaggtagcactggtgggtgtgtgcagtgtggggtggaggctgaggcggggagggatcgcttgagcccagggaagtcgagggacacccgcagttgagctatgattgcaccactgcactccagcctgggcaagagtcaaacccctgtctcaaaaaaagacacagtctgtctgatgggaggctgcacagttcggggggcccttgggtttgtggtgccagtgcagaccctgttccctggaaaccgtgttcncgatgacctccaggtg

SEQ ID NO: 594091 - DNA, 1006 bp, Homo sapiens
gtactccatcttgtgcctcttgccatgcgtgcctgtggtggccctgtatggatagatacttttactgcatgtgaagactcatgcgcggaaataggcagtgttaggcttacatctaggcgcaacggaggtccactatgctccatgctcgtatcaagggccatgtgaggaccgtccatcaagggaaaagttgttgttgttaagtgctttgacatcagcatttccgtggttgaaagtggatataccaacggggcggggaggacagattcaaggctccgtagatactttattgatcctatcaatcgctatatccagcatctgggacccgcgtcagaaatttgtaatccaagcgctgtaactagtgagcccttagttgttcactccaatgtgctgggtgtcccgtgtcaggtgctccttggcccttctgcaacgatggggcgacccgtagtctgcatggagccgggtgttactcgcgtggacggcaattcggtagtactctgatatggccgtcccatttggtttcccttaagaaggtcccgggggtcgcgagggcgctggggttgcctcttctggaaagggaggtgcagctggctccgtcgtgaggcatcggccatggccttggcgtaagggtacaccgtctctctccttggtgctcttccttttaggatgtacaatgttcaacgtgaagtcactcacctagtgtattcaagggtctaaaactgttaggtgggctcgtaccatatacgaggtccgccccagtagctgctggaggcgttggatcaggcaatctggcaccttgataccggtttacattgatactggaggggtaggcggttgggcactctcgctgcgtgagaagtcttggggaggctgtaagagacggtgcgagagcccgctgggtcgtggaccattcttcgcttgtcactggttgtagttggggccgtttgggggggaccatatcacatggttccctttttgccgtgggcgggaattgtttggggggcacagt

SEQ ID NO: 594092 - DNA, 891 bp, Homo sapiens
tctttatctttttctcgtggtccctcccgtttacgttcactatccccagaattgtcttccacttgatggaaaggcttgtgctggctggccctgaagcctgtggtttagaagcagcagcagcagcagcttgctgctgtgtccctgtcccttgatagtttttgatgaacccccgttccgtgctcctctcttctcctcgtggagagttttcttgtgctagctctccaaactcaactggaatctcctctccggggaattttggtccccaattttgtactctctgtggccctcgtgctgtgtctcgtgtgtgtgtgataagacaatataatgtgccatatacagagattaatctccgtgattcatatctctgtgatctcgtgtgagtgtgctcctcttgtgtgttttaccacggtttctacaggggatctctagaaggagtgctctgacacgatttgaacaatctctcgtgatgtctcacgcagcaaaatttctccatctccaccattcataacgtttgttgtgatagagctctctcaccaaaaacaaactttctcctcttttcagataaaaggaaaccctctgtgtgttcctgttttcacccacaccacaatctaccacgctgtagacccccttgtctcttttttggggtcatggggtgtctaaacaactgactttcattcctccgtaagacgacaacccaccaaaagttcctccctctccctggaaccccccgcttcgacattcttacgttcccacatttaactccccggggctattgcttcccggtctgacggtggggcatgtcgttttatcttgcgaaacctgtggctccaggcttacaaacgccttacatctaaacccaggcttctcctatttgttcttgccttgttctac

SEQ ID NO: 594093 - DNA, 128 bp, Homo sapiens
atcacagcacttgtaaatttgtgaaaatgaattttctctttccttaaaaaagaaatttttaatccagtcacacttttcttcccgtacccctttagttttttgataaatgataaaaatgagccagttta

SEQ ID NO: 594094 - DNA, 698 bp, Homo sapiens
tatttggttaataaaatcaatacaaatctttaattaaagatctactcataccagggctgaaatcatctattatggtggctagtaagcctctcttctatagtggggtaatgtggtctgtgccactgtgttggccatctctcccaagtgaaaagaacactttttaaaaaaaattaatggctccaagttttcaggcccaggggaggctctcccattctcctccttcaacagtcccgtccaggaagggtgatctgtgtggataaattcatcatacttcacttgtgccatggggtatcgatatctgctatccctagaagagatcatccatttccttgtggggtgagcttctacccccagactcgtgagttttggaccgcaggtacggacgccatgactgtaacctttcttctaccttgtccaccatcaacatgggctaagaacgaatttctttcttaggggtactacctaggtttaatttggcatgtgcataagggtcacgaaacagtggagaagtccaggtctccattaccgtctatcccgtgggtctgcaggtgccgttgaccctcccctggcgtcgggttggcccccaggcacctcatggcccccatgcaggtcgggggcttttaatcttccccctttgctgtcttgccactaccgggggagaagccttccttgtactcataaattggcgctgggggaac

SEQ ID NO: 594095 - DNA, 103 bp, Homo sapiens
cttcgtggtcgcgtgtattcaccactgcggtgcttgctccctgtacaagttccgtcgagaggtgagcactgtgctgacctccaaatatcgttcagctggagct

SEQ ID NO: 594096 - DNA, 498 bp, Homo sapiens
  misc_feature (171)..(171): n is a, c, g, or t
  misc_feature (245)..(245): n is a, c, g, or t
  misc_feature (325)..(325): n is a, c, g, or t
  misc_feature (434)..(434): n is a, c, g, or t
  misc_feature (441)..(441): n is a, c, g, or t
atgcgtatgttcactgcagcactattcacaatagcaaatatgtggaatccatccaaatgtccatcatagactggacaaataaaatactgtacacatatatatacacaccatgaaatactatgcagccataaaaaagaacaagatcttgtcatttgcatggatatgcatggngctggaggccgttatccttagcaaactaaggcaggaacggaaaaccaaacagtgcatattctcacttataagtnggagctgaatggtgagaacacatggacacatagggggaacaacacgccactggggcctgttgaggaggggagggagagantcaggaagaatagctaatgggtgctgggcttaacatctaggtgatggggatgatctgtacagcaaaccaccacaccacacattttacctatgttaacaaaccttgcacntcctgcntatgttacccctttaaaagttgaggttaaaaatttgtttttttagtgggtttctacc

SEQ ID NO: 594097 - DNA, 291 bp, Homo sapiens
accgacaactgcaccactgtgtaaatatcccatctccaatcaaaatcacatattaattttagcatacaaagacaattcttgctgggcacagtggctcacgcctgtaatcccagcactttgggaggtcaaggcaggcagatcacctgaggtcaagagttcaagaccagcctgaccaacatggtgaaaccccctctctacaaaaatacaaaagttagccaggcatgatggtgggtgcctgtagtcccagctacttgagaggctgagccggaagaatcacttgaacccgggagg

SEQ ID NO: 594098 - DNA, 346 bp, Homo sapiens
ggggcgactcgggaggatcccggagggtgaccttcgggtaatcgagtacagaagaggctccgctagagggatatgaagcaccgccaggtcctttgagttctaagctgtggctcgtacgggtctgggcgagcagctccggttgatttacctggtagaggtttagggctaagcatagtggggtatctaatcccagttggggtcttagctatggtgtgtccagatatgttaaagccacttgcgtagtctatttggtgtcaacgggagtttcatacaactcaggtgagttttagcatttagtgggggagggggtgatctaaaacactctttacgccggcttctatggccg

SEQ ID NO: 594099 - DNA, 691 bp, Homo sapiens
gagagagaactatcgtgtcctgaacaggctccatcaggtgcagaggataactcgcgaggctgcagcaggaacggaggttcctcatgagagtgctggactcctacggggatgactacctgggccagacagttcaccattgtgctggaaggatgagggcagcagggacacggatgccatacacatacagagcaatgcagagaagaatgagcctccagaagaaagagacagtgtacccggcccagaaaggacatcctgaagaaccacagaaaccggaagaaccagaaccccgaggtgaaggggcccagaagggcggacaaggaaggacgagatgcacacgaggatgaaacggcaacagaacaaggacatgagctgagatccagacgacgggccacggaagacagagtcacaggaagaaggaaagaaaaaacgagaatttatggaaaggaaggaggtgaagagaaacctgagaatataacagaagagtatgagagagacaacaagagagtcacagcgaacaaacacatggctgaaccgctgaacgcagagaacagtgaaacaaggcgaccagggcacagtgaaccaagaaggcatggccacagagaagcactggaacaccagccacgtcaaaaaaagagaaaacaaggaaaaaagcagaggaacaccgagacaaaggagggcgagaagaacgaac

SEQ ID NO: 594100 - DNA, 762 bp, Homo sapiens
cccgagtgcggcactgcgcaaggacccccaacgtggccagcaaccaagttctctctggaacaagaaggggggacactcgtttgccaccaaaaaggaagcctgaccacccttctgcatccgtctgctcctcgggggccccccggtagtgtttttacacaaacacccacacgccccgtcttttcaacggcgaccccaccccgggaggttcctcccgcaagaccacccctcgtgtgtcagaggataaagtatgtcggggaatggcggcccccttgaaaaaaacgcttcagtggtgtccccccacgtcttcgagagtaataaaagagtttttcaggccatcttcttaataattcaccagcatccctcactctagcgctcgttctggtgacaccgttcttttaacaatcccaccacatattaccacgcgaagcttgtttctgccctcccccaagattgtgctcccccctaccgatcaacatagggcacaagagattattttctctctgacaataccccacttatttgttcttgaaattttcctgcccaccacatcgtttcttgaaaacaatcaagaacccacaactctaacttatcgctttctgttacaccccgtagaggtatattttctttttctatcaacattctgggatctctattcaaaaaccccaacaggagttctgactcttaatacccgcctttgaagcattcttatttcgaagactcacaaagaaaatagcccgtttaacctcccccccacaatataca

SEQ ID NO: 594101 - DNA, 724 bp, Homo sapiens
ctatgtacgaggctggtgtgactcggccgagggctgaaagctgagctatcccaggacctgggaggtgaccctgtggctgccgagtttctctctggatgcacaccatgtctatgaaccctaaggaagggtccccactttgctggtgagcctcggagtgctggtgtggcaccatccccaataccctcgtgtggcaggctcagatcctggcacactgacatttgccagccactcctgtggcacttgctgtgtgcctgacccaggactaggagctgcacctgggccccagtgatgtcccctagttttgcaaatgtggaaacttgagtctcagagacttagtggacatttggcctctgtgaatctcatgtggctgcttctcctgagtgcctgaaccatgtgcctgtgcacttgtcttgcttggtgtgctgtgtgcccatgccctgggatggacccagcatgtggtgtgctcagacctcccatcccatggctaacccaccgctgggtgatgaaacctgtgtgacacttgcactgaaaaatgtcactctctacaagtatgcaaggtgagtctggaccatctcccatcagacctggacaccctgcctggacaccacatgcccctaacactaccggccaggtcgctccatgctgtcacattgtggcacccagccatgtcacacttaatgcagtgtttccctggcttaccatattatcactcccaaggatgacc

SEQ ID NO: 594102 - DNA, 304 bp, Homo sapiens
  misc_feature (7)..(7): n is a, c, g, or t
  misc_feature (124)..(124): n is a, c, g, or t
  misc_feature (129)..(129): n is a, c, g, or t
  misc_feature (169)..(169): n is a, c, g, or t
cccgggnagggtttcaccatattggccaggctgatctcgaactcctgacctcatgatccgcccgcttcgggctcccaaagtgctgggattacagacatgagccaccacacccggccctattctnttttnagttggagaatttattcatatgtatatgcccatgcatgtntatacattatgttagcggtccccagccttttaggcatcaaggtctggtttcatggaagacaatttttccacagacccagacaggagggataatttcaggatggaactgttccaccttcagatcatcaggctttag

SEQ ID NO: 594103 - DNA, 562 bp, Homo sapiens
cctgtttggtcttgaactccatgggctcaagcactcctcccgccatgggcctcccaatgtgctgggattacaagcataagccaccaaacccagcccaaaataatcacttttatatgtactatagttattgggcttatactttttacttccactggaagaaaatggagagaacataaagcaatattttctactagaaacagccttttctcccaaattcttgaaatggagaaaacaaattactgtctcaattctataaatgactgaaaaaatacactccccataatatttttcaaactcatctccagctcaagaatcttagataagcacatagaaatcgatatggtaagagaccttagagtgaaggcaagggaagggggtatttcctggccatctcttccaatggggtaaccataaaagacaatacagaaaggttcctaaagcttctttatcggaagtctctcctattctaaagtcctgctgtggcttacaattactgagcttcgtatatcggttactctaggaactgcctcttagggactgagctacagttagttgccaatgc

SEQ ID NO: 594104 - DNA, 339 bp, Homo sapiens
cagtactgaggtcacatgtgcaggacatgcaggtccgtgacataggtccccatgtgctgtggtgattgactgcacctatcaacccatcacctaggtattaagcctcgcattcggtagctatttatcctgatgctctccctccccctgacccatccaccgcctccagtccccagcgtgtgttgttcccctccctgtgtcttctttctattcacattagttcaactcccacttgtaagtgagaacatgcagtctttggtttactgttcctgcattagtttgtagagaatactggcttccagctccatccatgtccctgcaaaggacctgatgtagctcctt

SEQ ID NO: 594105 - DNA, 286 bp, Homo sapiens
ccccaaagccgttaatactaaactcatggcgtcgccacctttcaggtatttatctgttatcttctagcttcttggtgaagtgactgctgcatcttctgcccatttcatacagttgcttgtttcttactactgagttgaagaatctttatattttctcccagcctatgctttcgcgtttccttactatttctcaaggcgcagaagtccttaacttttgatgacggcctaacgtattaacattttcgttcagggattcacatggcttcgtggtatcctaatgaaatct

SEQ ID NO: 594106 - DNA, 2283 bp, Homo sapiens
tttgtgatgggaggcttctgtgtctccatgtaccccagacaacaaaacacaacttggaagatcttccgggagtgttggaagcaaggtcagccagtgctggtttcgggggtacataacaacagctcaagtctgacctctggaagccagcacagccctttagcccaggcaactttggcagaccagcgatgctacgcaccttggctgacactgcaggcaacctgctgctactaactcttccgcactgctgcacacagcttccgggaaatttcctgggaactggctcttccgacgaattcatactggcaacactgatcctaccggctccagcacagcactgcggccaaggccccaacctgcgcctgacgtccaaaccacctcaaaggggcaccctgggccccttcccctgagcggcgcacacgcaactctcaccccgcaacgcaaccactgcaactgccccacaaccacaacgcgcctccccgcggcacacgcacctccccttcggaaccctggcgcacgcacaacccccattatccccttcccgtggcccccacagcgaccaccttaactcaccccaaaacacccggaactccaatcgcgaccaacgcggccgtccacaacttccttggcgacccccatcccctcacgcggctccttcaaacgcccttaacgcgcctttaagcccttaaacggagttcacaacgctggcaccccgctcggcatacttcgccttgcgggtgcacaccaccgccctaaaactggccaacgtggccttcacccccacacgcagtggcccccattaaacttgcgagccgcaccttcgtcgcgaacgactctactcacccccacccgcgtccccaacggccacacccacccgccacacctccacccgcgtcaaccaccggcaacaacgagcgctctcctcggtgccggcactacaatagccccgacatatcgcctgagcacgacaatcggatctcccgcgattgatcgtacggacgacaccgatgtatcactcatacggcgtcacgatcgatctgcgcccatctgcgcctttccccacctactggcacacctctctcgcgcccccgtctggccagctcgctcaccaccgaccgcttaggggccatactagcacaaaccattccggccggcgccatcggaggctatacatccttctgggcactttgctcccgcgccgcccgagcgcaaattttatcatatccgcaccccaccgcaatatagctctgctccacgcgacgtcgtcgtccgtcaccacgctcatagccagcctctcgcgccgccgtccttctccacaaacgccacttcagccaaccccctcccgtgcacgaacactactcgcacaaccgcgacgggcattcaacaccgccgtctccgccaacaccaacgcacaaacgcgccgagccgaccacctcccccgccgcacacccccgcggcaccacacggcacggcacacagccgacacactatcgagcccgcccacggacaaccacccgacccaccgcgaacgcgacatcgggaaccaccgcgcgcacccacacagcgaccacccagccaaggcaacaccgccggccgcagcttttcccccaccgtcccggccaaaccccggcggagcgcacatcgcacgccgcaagccgacgacccgcacacacacacgcgccgcccccatcgagccgcgcacgctggcccacctacccagacgaccacaacctaggccgcgagagaccccaacactcgacacgatctccccgctcaacgaacgcttggcacgccacacggagacccccccaacccaagcagccgcacactagcggcgccacgccgcaccacgcaccacaacacccccgcacaactccctcccacggcgaccacgacgcacgccagccccaccctgcggccgcacgctcacccgcggacaacacagccacacgcgacagccacctacgccggcgcaacacaagcgaaacacaaccgagaacaacaagaccaaatacgtcggcagcccccctagcccacacccgacaggcatcacccaagacgaccacccacgccccacccccacgagttccagaccacgccccaacggctagcaacaccccagccgcccatccagaccgctacccgcacgaagcgcgagcaaccgcacgacagaccgaccgagcacaaacaggcacgcgcgcaaccgagcccccgagggccgtccctacccccacagagcgcaacctccgcagccgccaccccgcgcgctcagcaccacggatcgct

SEQ ID NO: 594107 - DNA, 1728 bp, Homo sapiens
  misc_feature (1126)..(1126): n is a, c, g, or t
  misc_feature (1135)..(1136): n is a, c, g, or t
cttctctgctcggtatgctgttgattccttgtgctgagtgtgactatcgttgtggcgtctctggtggaggtattccaccccgagggtttgttctccttccgctcgttgtgtggttgttcgttcgctcgcagttgtgtttgctctgccagctaatgacagtgttgttctgccacactgtttttcttcggtgggacgcagatgtttctcccctggtggttgtggggaataattattgctgcttccccccccatgtttgtttctctcggcgtgtgttgagttggctccctttactgttcctcatcaccagaggggccgctgggtcgccttgttttgtagtagtgtagtgtctgccccaggttgtctcctgtggaccgccagagtttccatacgccctccctttgtgggtccaccgcgggcgccctctaaggttggtggtgcgctcagccccacaccgcgtggtccccgaaggaagatttttctctgtgtgcggagtatatatccggcgagtgtgcgcccccaccgtggtgggagtttttcatgttgtgcgcgcccgctccaccgtgtgtccaccaccagccaagcttggtgggagtagaaacgtccgtctggtttgtaccccaaaacccccgggtttgtctctgttgttgtctgaaagaatagttttgctgctccgcgccaccacgctctttgtgggcctgttcttttgataaaaccctcggcctgttgttcttctcttcggccttttcttctggaaggatacgccgcacacacgtcgtgtaacacctcggcccctcgttgcgacagcgtcgtggggagaagagtatgagaacgcctcgccccacgggccgtctggaaaaataattttttgggcgcgttttgggggagttacaccacacaggttctccacagtgtggaatactatgttctgtcgccaacagcgagaagggtgcgcacacagccgtttgtgtcctcccactagatcccaacgcgttctcatacaccacatcgcgccgcccccacagtccccactattctgtgtaaaagggagacattctcgcccgagctttttagggagcatttgaatattgagacgccacatttttaaagcacctttttgaggcggctnttttggggnngtgtatattctttatcaccacaccacacaccacagctctccaacatttgtgagaaaagagaacacccacgtgccccccttgtgagaatgtaccaccacagagatctcacagagaatggtgtctcaacacacactcgggtgtatatctctttgttgttacaccacattgagcgccactgagaagggtacacccacgagaacctgtgttgtggtgttctccacaaattggtgtctctgtcttatacacccaacactatattgtttctcacctgttgcacccaagccgagagcgcccaagggtttcccactcggagcccacaaggctcgaaggcttgtgccacttctaagcacttccacaacccacaaattgtttttcctcaaataaagcacttcctctttatttttttctaatttctaatcctcgggttctgcctcccacccctcgaagaataaaggaagaagttcttctggtaactaactgtctgtaaccgctgcccctctatcccgggcccttatatggaattttggaccccttcttttttctgggattcccctgccccccccccttcctaatagagatgaccttttaaagg

SEQ ID NO: 594108 - DNA, 170 bp, Homo sapiens
tggatgtaccgtacctacgagaagttatatatatcaggtgcaggaaccgaaagctctattcagcactgtgtctgactggcgactatgattgctaatgccctaattgtcatagatttaccactccaaaagcaataaaccagaaatgtgggaagtaggatacttctgcctag

SEQ ID NO: 594109 - DNA, 338 bp, Homo sapiens
tcccccagttctgcttcttgaaacgtgagtgtataatcagtacgagcgtccctgcagtgattaaacaccaagggcaaggctgcctccaccagttccatgaccgtgtgccggagttcagggtccacgggatcaaacctgtctcctcttatctctaccatgacaatgaccggacatttgaactgatgagaagggagagatagaagtgtgccggctagagattgaaaggaccagaagaggttgagggatcgtgagggaggtcggacgcgagagttcaaagtggtcgcttagcgcattcgagattgatggagatgttgctaagaagcaggaacaggagggta

SEQ ID NO: 594110 - DNA, 296 bp, Homo sapiens
gaaggaacttcttttcccttcagctggaaactgcctgggaaggttattagttattaggtgatggtagcggactagccgacggaggacaggcaggggagggggagagactttacagaaaaggaattctcggtcgagctctcctagagatgactgcttacacttactaaacccagcggtacacacagagaggaagctcggcgccatttgactggaaggcagactgtgaggtgcttccttccctcctctaaaccagatctgagcagccggagaaagccgccgcattttcgggtctaggg

SEQ ID NO: 594111 - DNA, 168 bp, Homo sapiens
tccgtaacgacgctccgtaacgtcgtaacagccctccgtaacacgctcgtaacgacgccagtgtggtggtggtggggagtgagagggacaggcagggcgtgattgattaaagctaacgagcagacagaaggcactggtgtgtcacatctcgtgcctggggagagggga

SEQ ID NO: 594112 - DNA, 162 bp, Homo sapiens
  misc_feature (5)..(5): n is a, c, g, or t
gaacncagctcttacccgtcctacatagtgttgtaacaggttgtttcttccagagaagagaacatttcaggagcagttgccctgcacagagaggtggatagattaatgtgtaaatatgccaaactttaaattcttagccaacatcgattcttttcagataga

SEQ ID NO: 594113 - DNA, 115 bp, Homo sapiens
gcagagatcatgccattgcactcccagcctgggatgacatatctacgactgtcttttgcttcctttgacttgattcggtccatatcccccaattctcatttattacttagcgtgc

SEQ ID NO: 594114 - DNA, 418 bp, Homo sapiens
  misc_feature (61)..(61): n is a, c, g, or t
taagagaaagaaagaaggaaggaaagaagggaatacaggctctggagtcagatgccagggncttaaatcccatttctactccttactggctgtttcatcttgaacaagttactgaaccccttgatgtgtcaatttctcatccataagacagaggtcagactgggcatggtggcccatgcctgtaatcccagcacttcgggagactgagacaggcgtatcacctgaggtcaggagtgcaagaccagcctggccaacatggcaaaaccccgtctctactaaaactacaaaaattagctgggcatggtggtgggggcctgtaattccggctagttgggaggctgaggcaggagaatcgcttgaactcgggaggcggaggttgcgtgagtcgagatcgaggtcgcaccattgcactttagcc

SEQ ID NO: 594115 - DNA, 139 bp, Homo sapiens
cttacaggggcagccagtccaaatgccaaaagacgaccagttcttgccctgattgtatgcaattcgacatttaggcacttttttttgattcgggcccaaccagcttttcctatgttcaaagaccttgctggcgtcaaaa

SEQ ID NO: 594116 - DNA, 1327 bp, Homo sapiens
agcggatatacaggctgcgcgtgccggggggaggtcagagaatacgctcttctcctttaccaaaatggcggatggtgcctgttttcgcttcaccagtctcctcacttctcttctgatgcactcggtctgtgtccttgatgcatggtcacttagaggatctgggcatcgagggcacagacagcctgggccaggacgtgcaccagtcaaggaaggtgctcgaccggaccgtgaccgtgtctggcgtgactggaccaggtagccgcgtgaccggttcttgcccagtattgcgggtgatactgtatgtgatgagtcaaacccattgacgttaccgctgtgcctacgtcatttgactaccacatgatgacgtgttgtgcgtgaacgggcagaaggtgtggcgcatggtgtttccggacagactaatacgtcaagacgttatgccagctcctaccagtgtgcggtaacaacggaagatgcgatgctcattcacaactcactcccaaagggcactgccgctctaacgcttcgcaattattcacgctgagtgatacacgctctgcctttgcgctttgcgaagagtgtgccccattggagagcgcacggggagtgggcaagccccgctgtgggtggaaatccacaggattcaacagaccaacgcaaggctcaaaaaggacggatcttcggtccactcgattggttcaagtcggattggttccacgagtgtagctagacacgcctcatttgtggagcgaggaacgaagcgcaaagaacaatagcaaagagaggcacatacctagatagccgcactgtttgtacaggagaacaaacgcgcttgagatctagaagcaaaagccaatcgctatggacattatgccagcacatcaaatggcccagcaattgacactgtaggggttggccttcaatcttatgcgggatcgacacatgctaccgtgagtgaagcttcgcaaagccgggagctcctggaggagacggcgttctatcagcaatctcacaatgtgtggtcgtttcgaactcgcggaaactggggccacatgtgtgtgacactggctggttgtgtcctatccttgaaaaagaacgtcattcggatgtataccgtgaggccaagcctaagtttgcggacccataacggaaaccctcggtcgaggcaaagctaaccaagagcgcgcttaccaaagatcacaccagttgtgttaccgacacgctggtgattgccaccattatacggaacacacgcccccaggagtggcggtctggaatgctataggttgggggcacacaagcaatttgtgacgccccgaaccgacacacc

SEQ ID NO: 594117 - DNA, 376 bp, Homo sapiens
cacctgtatgtcaccttcagctagtgatacactctagagcagtatatcaaagaatgagccagctgggcccggtggctcacacctgtaatcccagctactagggaagcaggggaatcacttgaactcaggaggaggaggatgcagtgagccaagatcgcaccactgcactccagactgggcggcaagagcgaaactctgtctcaaaaaaaaaaagaaggagcaacattatttattaagattaatcttgatggccaggatgtggtgcctcatgcccgtaatcatcccagcactttggaaggccgatgcaggcagatcacgaggtcaggagttcaagaccagcctggccagcacggtgaaaccctgactctgctaaaaa

SEQ ID NO: 594118 - DNA, 912 bp, Homo sapiens
gataccaagaacgttgcctataactcaagaagaaacgtgaggaagttggaacgatcagaacgagtatgaatcccgcagcctttggcaaggatgtcactttcaacttaaaaactcagagacacttgatgcagcacactgaagcaaagcacaggcttgacagaacgacaaagaagcagacagcccgcagacacaccgcgcacggacgacccggaaccttcacgtgggagacacacggttacttttcactgacacgactggagaactgctggcgtttactgatgaaccacttacctgcaaacgtcttggctgcctgccacagccactcaggctcgcgaacgattgcacaacgatcctacatacctgaatgactccagggcccacgctacggcacctaatttcacgccacacccatacccagtcatattccctcttgcgagacgcacaaccctgctccaactttccaactccttcttaacttaccagctgcgttccttaatcatcgagcgggataccttggcaacctatctctggagcgcccacacacttgacaccaacttctacacggcggcaacaagcatatcccctttatatccccatcttgttgtgacagctcaccagaactatcaggacattcaagctcccctggcaccaaaaacaaccccaccacgcggcccccacggacaaaacaccacccaacggaaatggctctcccctccatagagcccaacaacaacccaacaaccgactcgctaaacacacccaatcccactaataacttccccacgcgctcacttacacagcctttttgcacccaccaaaaccttacacggcacagaattaaagacataccataacaacctagtgcctaccctatatagtaaaccatcaccatcacttatccccccgcccaat

SEQ ID NO: 594119 - DNA, 345 bp, Homo sapiens
acccagagcttcatcaatgatcctcgttccaatgattcgaacttgcgcttaatccacataccagtcccagcggacggctcttactttgccggcgtcttcctccaccgacatccggctttcgctttccccgtcgagcgggtacacaagctgcccgttttcgcgggacgcgggcggtcccagccgcgacagcgcggcgcggacggattggccgatttccatgtacgcgggcaggccatgcccgggcgcggtaacctcgacccgagtgagcagtccggacggatcggacgcgaccggcgaaaccagggtttgcacctcgatgccatcgcagcgcagcgagcggatcga

SEQ ID NO: 594120 - DNA, 1164 bp, Homo sapiens
  misc_feature (84)..(84): n is a, c, g, or t
  misc_feature (93)..(93): n is a, c, g, or t
  misc_feature (96)..(96): n is a, c, g, or t
  misc_feature (99)..(99): n is a, c, g, or t
  misc_feature (107)..(107): n is a, c, g, or t
  misc_feature (117)..(119): n is a, c, g, or t
  misc_feature (121)..(121): n is a, c, g, or t
  misc_feature (130)..(130): n is a, c, g, or t
ggccaggctacacagccccaccgcctccacctccaccaccacctgcctacaactatgggagctacggcggttacaacccggccncctataccncancgncacccccnaccgcgacannncnaccctcagnccagctataaccagtatcagcagatatgcccagcagaggaaccagtactatcagaaccagggccagtggccgccatactacgggaactacgactacgggagctactccgggaacacagcagggtggcacaagtacacagtagccagtgtgacccagaggctcccggaggccccatgaccgagattcctccacgcagacgccatgactcggccacctcctctgcaccccgaccagatcccgtggtgcatggggatggaggtcatcccagggactgacctcccatccagacccacatgcctcccctcttgagggggcttccattccccatccaatagggccaggcatatagataactggattcaaacaggcaacaagtgaccttataagttttactggtaagtcaccacaacatccaccagcctatcacaacctccatgtaacgtggcctaccttcttcccttttaggacctagagtattcccacaacatcacattgatcatacaagtgagggctacagtgacttgaggggagaattcccctactgttcactctccgcaaaccctgctccaagggccctcagactgcccagaaccctcatgcagcaggtggtgacatcactcccaggaagcggcgacaaggaccactgctcacggatgacagaaaagactcaaaagtgaacacacaaacgagaaaaccggggacacacaagccggcgagggaccacccgacgagaaaagacaaagtgacaagggacataacagtacaggaccgaactacggcaccaggggaaaactcgaggacacccctaacggaaccagaacagcaaagcacggtacgcgcaagaaaaacgaacaaaaaaagagaagagagcagacacagacacacgaggccccagtaccaaaacggcagcaaacacaacgagaaaaccccacaccacaaaagaaaagacacaacagacaatcaccaacaacacagacacaaaacaccagccaccataagctgaacatcagagaagaggcacgacgacgacagca

SEQ ID NO: 594121 - DNA, 351 bp, Homo sapiens
ccggtacctgtagcgggtgtggtggtcatgctgtaatcctagcatttgggaggccaaggcgggtggatctcctgaggtcaggagttcaagacccacctggccaacatggtgaaaccccatctctactaaaaatacaaaaatcagctgggtgttgtggcgggcacctgcaatcccagctacttgggaggctgaggcaggagaatcgcttgaactcgggaggcagaggttgcagtgagctgagatcacatcactgcactctagcctgggtgacagagcaagactctgtctcaaaaaagaaaagaaaagaaaagactcattcttccgttcattcattcacatggccactcaata

SEQ ID NO: 594122 - DNA, 349 bp, Homo sapiens
actggggttggcgtacaccaccacagtctggctaatttatctttattttctgtaaagatagggtcttgctatgttgcccagtaatggtcctgaatggtctcaaactcctgggctcaagcaagtccacctacctcaccctcccaaagtatagggattacaggcgtgagccactgcacctggccttgaggagatattctctacctaggggttgttaataatcacacggactccacttatgactccctaaagccccatgtcgaaaaaaccatcgctcggtcacttactaattgccgcaatactcttcaaactaggccgctatggtataataagcctcacactcattctaaac

SEQ ID NO: 594123 - DNA, 305 bp, Homo sapiens
tttggacctgactgttaaaacttaactgttttggaaaataattaagatggggagagacagataggggttatattgtttgagcgcagatgctgagcctggaaggaacccaggttatgcactggagtttgtaaataaagtcagctgtcaccgttatcgtttgctttcactgtgaccatgcttcagtgtgcatccttgtaggttgagttctttttcagagttactccagatttactacaaatagattttaaggttaagaataactgctgggtaagaaaatgaacttgttggatagagaaaatgagttc

SEQ ID NO: 594124 - DNA, 335 bp, Homo sapiens
aagtaccacgcaggagggcgactgccacagatttccatcaggtaaactaaagactgaactgaacaatcaaatgctcagcaggagtgccaaggggctgggcttgggtcctgtttctactggtatctatgatgataactagcttcatcggccagacatttcctcacactccttgggacggacatttgtggagtaggcgtgagctcatgcctgcatacatgtgctcggctacacgtatgcatacacactcttccatgccctacttgaaaatccagactccttccccagaggtctggctggacatgatacagttgtgtctgttctgcatatgtgccacc

SEQ ID NO: 594125 - DNA, 421 bp, Homo sapiens
gggctcgaaagaaactgcacgatgttttaaaaaaaatgcagacaaacaaaaatggggggaattcccacctctttaaagccaaagtaaaagaaacggaaggccaggaaaaaaaaccccctgccgacaaaaaaacccattgaccgggaaaaggggagtaaaatttcttaagatcctgagggatttcctacccccgtcctcttcgagaccccagtggtgatgtggagaaaaagccccctgcaaaatggacacaagccccaagttgccctgtaaacctgggcactccgcgccaaagccaccggcctgtgggtttttgaagggaccccccccaatcggactgccaaattttccggtttgccccgggataaaaaaaaaaattatttgtatgaaaaatgaaaaaaaaacacccctcggggcatggcta

SEQ ID NO: 594126 - DNA, 672 bp, Homo sapiens
agcatcgacgatcgcacgtctaggaatactagtatatcgctcacacctcatatcctccctactatgcctagaaggaataatactatcgctgttcattatagctactctcataaccctcaagcacccactccctcgttagccaatgatgtgcctattgccagtagctagtcgttagccgcgctgcgacggcaggcggctgggccgtagcgcctactgagtctcagatctccaacgacagtatgggcctagacgtacagtacagtatacctacaacctaagtccgaatgcgtaaatagctaattcgtccgcaacgaagtatatacttgactacgcagctgacattggactttgccaagagagaagcacgatagagttctgagatcaacgagcaagccagcccagcaggcctacatatatgtagcatcgatgccctcatacgtagtgtgtatgataaagccgaaaagtcgaaacaacccatagcgctaagttttcagccctggatatcgcccacaaaaccccatgtatgatccccatcacgaaagacacaccacgataacagcaatggaagctacattatacaacaccaagcagacagtacacgagggagaaccaacggccggggccctaaaagcctggaagctaaaaaccatccaacgagctaccaaggaggga

SEQ ID NO: 594127 - DNA, 90 bp, Homo sapiens
acgcgcacacgtgcgggtacttcttcgaagagctagttttccaccgggtagcgcaggatcgtggtgaggaaaaggtcggcgagtggaatc

SEQ ID NO: 594128 - DNA, 243 bp, Homo sapiens
cgtagtgcgtcttgttccatagccgactgtttctcaagtgtatcccttagttcgcctattcccttaaaacatccatcttcagctcagtttttaccagttggacctgtttctcttgagctctggcattatctcatggcaactttcaaccagcccctagtatgttagtcagcacagcgtctctgatggaagcactagtcccatccaggcaaacagacaaaggaagcatggcaaaacctaggaggc

SEQ ID NO: 594129 - DNA, 172 bp, Homo sapiens
actagtctggcaatcggccatgcctgacctttactgccttattaactcgatatcatatattgcgttccacttctttatgatttattacccatttttgctctgtagatcagcgtatgtctcagtgctgtcccctgcttcacggagagaaaggctgtttcggtcgacagcatgt

SEQ ID NO: 594130 - DNA, 869 bp, Homo sapiens
  misc_feature (3)..(3): n is a, c, g, or t
  misc_feature (156)..(156): n is a, c, g, or t
  misc_feature (159)..(159): n is a, c, g, or t
  misc_feature (216)..(216): n is a, c, g, or t
  misc_feature (218)..(218): n is a, c, g, or t
  misc_feature (224)..(224): n is a, c, g, or t
  misc_feature (234)..(234): n is a, c, g, or t
  misc_feature (275)..(275): n is a, c, g, or t
  misc_feature (288)..(288): n is a, c, g, or t
  misc_feature (328)..(328): n is a, c, g, or t
  misc_feature (351)..(351): n is a, c, g, or t
  misc_feature (355)..(355): n is a, c, g, or t
  misc_feature (374)..(374): n is a, c, g, or t
  misc_feature (384)..(384): n is a, c, g, or t
  misc_feature (393)..(393): n is a, c, g, or t
  misc_feature (454)..(454): n is a, c, g, or t
  misc_feature (460)..(460): n is a, c, g, or t
  misc_feature (570)..(570): n is a, c, g, or t
  misc_feature (579)..(579): n is a, c, g, or t
  misc_feature (606)..(606): n is a, c, g, or t
  misc_feature (619)..(619): n is a, c, g, or t
  misc_feature (630)..(630): n is a, c, g, or t
  misc_feature (636)..(636): n is a, c, g, or t
  misc_feature (664)..(664): n is a, c, g, or t
  misc_feature (674)..(674): n is a, c, g, or t
  misc_feature (681)..(681): n is a, c, g, or t
  misc_feature (775)..(775): n is a, c, g, or t
  misc_feature (865)..(865): n is a, c, g, or t
tgnaatgaaaggtcccataccccccacccctgggggagactgacagaatcagtgctggacaagtgcatggcccccttcagtttggtgctgaacttccatacccctgtaagccatcactcaagataaaatgagcagttctggtcctcagggaaacanccncctgtggccaggcccaggtaatccaagcctccaaagctcttggggaccaggcctggngnccaccncggctgggcnaggttcatccctggccacctagctactctagaggggctggnccccaacccaggngacctctcacacacagtgataggctgggacagagctgcangcttgtggggtgcctgttggtcnaganagagctgcaggatcgggtncgggggcgtnttggctggngtgtcttctaatgctgagtcgtggtccgtggggcctatgggcacccccttagggtttgatnagaatncgtggtggagacattccaggtcagggctgcggcccaaagatgggcctacttgtcaatgaggcctccctccttgagcttgaagtagaagaacttctccagggcgctggctnaggacagtnctcgctgtccggggggttgtactcgcnacagttggcgatnacccgctgcangtcggncacaaagagcttccgggtcacgtagtancggcttcgcngccgctnagtcatggtcttcaggtcaatggggaagcggatgacctcgtagtagtcaggggcctccgacttcttcacaggctccatgaagggcaggcactgnggtgagacttgatttgggccagcaggtttttgagggttgtgtagagctggtcggggtcttcagctccttcccttctccttccccaatggnttca

SEQ ID NO: 594131 - DNA, 425 bp, Homo sapiens
  misc_feature (47)..(47): n is a, c, g, or t
  misc_feature (58)..(58): n is a, c, g, or t
  misc_feature (181)..(181): n is a, c, g, or t
  misc_feature (184)..(184): n is a, c, g, or t
  misc_feature (267)..(267): n is a, c, g, or t
acgtcagtgactggagctgagtgcctgagggtccagagccgaggccnagcgacctcantgggcccagtggggaggagcaggagcctagcttgggaacatgcgtatgacctctacagctacctcttctatggactggttattgcccaaacagccacactgtgggatcttcttaacttaattntanttaatactatttagtataattatttttgatttcacagtgtgtttgcgattgtttgctctgagagttccccctgtccctccccnttctctcacagtgtgtctggtgacaaccgagtggctgtcatcggcctgtgtaggcagtcatggcaccaaagccaccagactgacaaatgtgtatcagatgcttttgttcagggctgtgatcggcctggggaaataataaagatgttcttttaaacggc

SEQ ID NO: 594132 - DNA, 1274 bp, Homo sapiens
gcccatttcctcagctgaccgccaaggtgctcgggtccttccgaggaagctaaggctgcgttgggtgtgaggccctcagttcatccggcgactagcaccgggtccggaagcgccatgcccatagactcgcccgcgcctttggcctcgtgtctcctgagctcgccttgcattctacgtcgtgcccttcatttctgcaccgaacgaatgtaggagatgacatgatcacgagaggaataaggattgcaagggccctgcaattaacagacagccgggatgtacacttggtgggaagcccatataatagggtccgtgggtcttaggataatggcataagaaggtgcccactgggccactaaccggatcaagacccagttatggcgtagcccctccaattcgttgcaaaatggatacagtgagagcccccaggggacggggcacccctggagcaccaccatgcaaatgacgtggagatgccgtggcacacaccccgagcacaagggaagagaggatcccatagggcgcccacccacatacacacaactggtcctggcctgggactaccacgaagggcgagaaaagaagacaaatggacagggggataccagggggtgggtaaaggcccaagaaatggcaacacctggatacggtacatgtccaacagatgcggcgacaagcttgccttgggttgtgggacagtcaggaacaaactggggtgtgaccatataggggagaacagcatataggtagaggcgaccggttaaaatggaaaggcatagacgttttgacgaacgcagattagacgactcccacttgtgtgaacgaccccaaacgacccatacgaccctagagggggcgctccttggggaaaccaccggttgggggtccaacacgcatgacaaggacaatcacggacacagagaattacacaccaacacacgacaacagtagataacaacagaccaaatcaccggaccaacacgacccaaacacacatacaaagagtgttgtaaccagcagagaacgacacagccgaggcactccacgcgacgacaactaggacgaagcgcacaccacacccgccagtgcagcgaacagaaacagatccaccctagttgcaacaagccaacatagcaagcaccaacccaaccatattacacaccgacggaaaaatagtcggagaacaacagccagtcgaacatagaggagcggagacctcagcacccacccgaagcgacagcccaggacaaagaagagcaaggcacgccagcgaaacg

SEQ ID NO: 594133 - DNA, 177 bp, Homo sapiens
ccccccggctcccatggcgggaaggctttgccctggctgtttttttgggtcctgacctggcctttggctaccataccaaaaaaaaagggctgggtggggaggaacttcttcttctgctaccaaggctgtgggcctcatccttccctcagttgtgaaataaaccgctccttgccccga

SEQ ID NO: 594134 - DNA, 329 bp, Homo sapiens
ccagacctcttacttgttgcccggttcgatgccattgtctcacactcttgccttatcatgcctcatcgccccatccccattctaggctgagaccttttagccagagtcaaagcttctatcagcttttcttgcccccttcaaccagagtcccctcctgctcctctccgctagtccggcccctgacccctttccccagtacccacttcctgcctctctcattaacccttccgtagctgctcaccatgaccccatcagaatccagttaagagactcttccaaatttcccaacgttcctcaataccccatctctctaacccaccaaaagggcc

SEQ ID NO: 594135 - DNA, 105 bp, Homo sapiens
tggggtgcacgacttaattcacatttctcctttctctaagttcggcaataggtgaaaagatgtttacccagtgccgacaatagtcgtggtactttaaatttccca

SEQ ID NO: 594136 - DNA, 619 bp, Homo sapiens
cagatatgcatttatctcagtgagcagaggggtgactttgaatagaatgggagacaggcttgctctaagcagtcccagcttgacttttctctttagcttagtgattttgggggaccaagatattttcctttcaaatttctccccttttttttttgtaaaatcttttggagaaagcattttagaagaaattgagcctctggtcccatgttttgtctgatctctcatggctaggatgatttgttcctagacaggtaagcaccaagttattaggaaagttttgttagaaggttgtgaagtctcatgtcctatgaaaagaaaatagtggggcacaaggaatagacactgcggcccctacctgaacactcttggtcaatctatattggccgcattactctgaattccgaacattggcaaacaggcgtgaccgcgtggtactgctgtaaataggttgctgctatcatcttctgaagcttatcgactagctgacgttttcacggctatatgaaagtgcagcttagttttcaatgactctcaattagaaaaaatgggggaaaaagagggaaaaaatggaaaacattatcttgcttggagcccagaagaaattagtttgtcccttgtt

SEQ ID NO: 594137 - DNA, 611 bp, Homo sapiens
  misc_feature (261)..(261): n is a, c, g, or t
  misc_feature (451)..(451): n is a, c, g, or t
  misc_feature (457)..(457): n is a, c, g, or t
  misc_feature (469)..(470): n is a, c, g, or t
ccaagcggtgcctttcgaagtggacaagactttgcccccggcagattttgactcgcctttgggctgggcctcggagcagttaatgttatccccactatggtttagttatacacgatcagtaagcctcaagaggcacgcctgccatgagagcacatgtcttctggccaggagaagtggctcagccttggtatccctgtaatgtggacccagctccagggaacaaagtgtcggggatggaggggcccagcctggattgactgntacttcctgtttttgtttccattattccccagagagggacaagataggacatggcctggaccagggaggcaggcctccccctcagaatttgggtttcacgggccccaagtttcccccccagaactttggccaaaaatggctttttaggtgggctgtgcaggcaaagcaaagctcagggcgggttcccagngggccngagcaaggggcnngcccccaaacccccccccgttttgacgaaaggcttttccccctccagcaagtgttcccagcaaccagctccattctgggtgcttgccttccatttccgtgtagatggagatccctgtgtgtaataaaccccaagggggtga

SEQ ID NO: 594138 - DNA, 876 bp, Homo sapiens
gctcagtgaactgggagcctcgtgggtggggcaagatgctccgtgcgcctgaaatgcgactctggcgtgggggcattcgtgatggtgacccctgcatacagggccttctactctgtgctgccagttgtgtctaaaagaactcttggaatctgtagaacccggaatcgcagcgccctcgggtgctggagccacactgcatggccgcgtgtgcatgggaccacactcgaggccttggttattgtccactggaactaggcgattcgtgcacccagatgaccttacttgggacgccatcacttgaacagcacgtgctctgagttgaacgcgtgcgtggatggtcgtgctggtggctttgtgggcctcccgtgagcctcaggcctatgtgcgggtctgtgagcctctctcgccgcgaggctcgtgccccacgggagctcccgggatgcgatgcggggcggcccttcgtcagtgttgaactctgccttcttatttgcacgtgcgacaaggcccctccctttttggccttgaggtacttctaaccgctgttcacagccttcgaggtccactgttggacccacgtccgtttggtctacgattggcaggttgcgctgaaggagatgggttgcgattgcgagtagcagaattaccctgcgagagagaggtgtcatttgttcctattcgcccaaatagccggataagcgaccctaagcgaagtcgattcgctcgagacatagaagcgttagcgacaggcccatttcatcccaatagggttcttttatcgcgcccatcgcttgtgaacgcatgaggttgctcttccgtccattgttgtgttggaccttgtagatgctagccgttagcaaggggttctgaggacactgg

SEQ ID NO: 594139 - DNA, 870 bp, Homo sapiens
ggtctctgaggagagtctgtgggcttcaacatgatacagtagagtatgaagtgcttagagctgtgcgccctgttgcatggtcagttgtgctagtgtgatggtctcagatgtattagtgtgcgtggaggtccgacccagattgttattgagcgcagggaaggtcccaggctcttgtgagtgacagggagtaccaaggctatggatgaccatcatgacagctacttccattgtttctcttgactttgcatcattcgtcttattatccagtttgctgagatgttaaactcagaacacacaggggaagcacctagtccattgcaccagcacatagtagagcagtcgtgtcaacgagagttctgtgagatcgacatggttaactcttgccctcctcgccatggttcctagtcagggagttgaatgtgtagtaggccatatgtaagtggagccaggagatcagtctggggcactctctcattctcctcctgcctcccacccttgagttccctcatagagagagcaggacaagtgacttctaggggaaccgtattagtctgtcgctaagaccagatatgtttataccgaaacgaggtttcattgactcacagttctgcaggctgtacaggacgcatggctgtggaggcctccagtgcaaacttacagtagtgcgcagacgcgccaaggaggagcaggcgtcctcacatggtctggagcaggaggaacgtgacgagagcgtggaggcgccatctagttttaaccatacagggtctcgtgacaactcactcgactgtaacagtctgcaagggggaatgtgccacacatcatgacaagtccggccctctgatcagtcaacttcccacaggtccaccttga

SEQ ID NO: 594140 - DNA, 175 bp, Homo sapiens
attcgcggccgcgtcgacgccaagtgaggaggcacgtccctgtagtcccagctactcaggaggtgaagcagaaggaccacttgagcccatgaattggagactgctgtgtgctgccatcatgcctgtgtatagcttttgcgctacagcctaggcaacgtagcgagaaccattttat

SEQ ID NO: 594141 - DNA, 320 bp, Homo sapiens
tgaatggaggcggcagagataggtgaagggcatgcacattaaaaaccagtgaagaggcaagataatgaaaattaattcaagaaggcagtgatggtgaagttcattaacactagataatggagtggtgggcatgtaacaatgcatcaatggggtaaatgatgcacaggtggttaagtggctgaatacggtgatgttatggtgactggttgtaacatgggtcatatagccagacattgcgtggctaatggaggcaagcgcctacggtcaagtgccaaatcgctcttcccaagcttgctcaagaacggggtaaccgaagctcg

SEQ ID NO: 594142 - DNA, 445 bp, Homo sapiens
ggccctcattcccatgtcacgatcaccccatgtccacaaataaaatgacaaaaattagccaggcgcagtagctcacacctgtatcctagcactttgggaggccaaggtgggcgaatcacctgtaagtcaggagtccaagaccagcaaggccagcatggcgaaaccccgtctctactaaaaatacaaaaattaggcgggcttggtggcatgtgcctattgtcctagctactccagggtaggcagaggttatagtgagttgtgattgtgccattgtgctccagcctgggcaacggaggagaccctatctcaacaacaaaaaccctgatttgcagccaaatagtttcctcagcctatttcctgccagtaaatggttaggagcccagtggctttgttttgaacagtctttgtccattttagtccaagctagtggtgcttgtgttagttc

SEQ ID NO: 594143 - DNA, 186 bp, Homo sapiens
  misc_feature (67)..(67): n is a, c, g, or t
tgccccctcccaccaaggttgtgccccgccctcatccagcgacagcagcagcgatagctcctcgganagtgacagttcgactgatgactctgaggaggagcgacccagcggctggctgagctccaggagcagctcaaagccgtgcacgagcacttgcagccctctctcagccccagcagaacaaac

SEQ ID NO: 594144 - DNA, 376 bp, Homo sapiens
ccggaagattggactctaggtgtattataatctttctccattctctcatttttatccaagacaaatcatggtagaaccaatttgtttgcaaaaataagttttagtcttatatttggcctgattagttatataaaatgcaacaagaataattatttgtcatataagctctctttcaaattggcattcttagaactttttccataaggagtctcagatcagaccttctaaagccttgaacccatccatggatttatttgtgcctgcaaatacctgtatgaattggatgaattcctctcctatggaggtccaaagttaacttggggctcctgggcttgttagaaagtggcattctttacttaccacaggttaggactcc

SEQ ID NO: 594145 - DNA, 530 bp, Homo sapiens
agttcgacgaagactctctaggtgagagcggtagcgtagccacagtataacttcacatgttcattaaaaaggcaagagttgaccgctaaaacttcaaagaagaaagtactcataaaaaaaagtcttaccccagaatagcaaacaaatacatgaaaagattagaagaggtgatagaaagcaccagacattacagaaaataagaataataaaataaattcaactcaaaaggtccccatgcagcaaatactttgtaaagtatggcctgtatgtaaatagtgctaaatcaaggactttgtagcagaaaattggtcggtgcttttatctaaggcttgaatttgtaaagtgaaggcatgaaagtgaccaaacattaagtaactcttaaaatggcacacaggtatgaaagctatgggttattccttcctaactctcggaatttttcccatggccttagtagatcaactatgtcagacgtatgtgacaccagcaactctcaagatacttgtcttgcagatatgtcatcagtcatgtct

SEQ ID NO: 594146 - DNA, 481 bp, Homo sapiens
cgaggatcccgggtgcggcaggagaggttgtggaggggaggcgaggcaggcggatcatgaggtcaggagatggagaccatcctggctaacacggtgaaatcttgtctctattaaaaatacaaaaaattagctgggcgtggtggcgggcacctgtagtcccagctactcaggaggctgaggcaggagaatggcgtgaacccaggaggcggagcctgcagtgagccgagatctctccactgcactccagcctgggcaacagagcgagtctccatctcaaaaaaaagaaaaaaaaaagagaaaatacttatattcattccctagggctgccacaattaagtaccaaaagcggggtgacttgaaaccagagaaatggatggtccgggggctcggggggccagcagtctgaaacggacgtgccagcagggccacgctccctccggcacttgtcggggagtcctggcacaacctctgggtaccgagc

SEQ ID NO: 594147 - DNA, 437 bp, Homo sapiens
aacctgctgctgggccccgtgctgcgattggtggttgggcggtccggcgggtattctacaaccgccggctgagctacacctctccctgtgtctaaccccctcgtcttctcattgtgggcgaggacaactcgacggggccgccccgtcctcttcattgcatcggcagcgcggggggccgcagtctctgtttctcagcgcgtgttgccgccccgcgccgtgttggtgggcgccacacgactgtcgggcggccgtctttttctccgccgtcagtgtctgcggcggctctactcccccgtgtggcgctttttttggtgacgtctttttttgtggagcgagggtagcatccctcttctgtacgcggggtgcagaaaattccccacacgcccccctccttcctccccttttggggggaaaaaaagagttttttttgccccaca

SEQ ID NO: 594148 - DNA, 321 bp, Homo sapiens
  misc_feature (246)..(246): n is a, c, g, or t
ctgcttgtttttttttaagagacagggtctcactctgtcaccacacatgcagtggcgtgatcagagctccctgcaccctcaaacacttgggctcaagcgaacctcctgcctcaccccccacagaatagctgggactacttgcacgccaccatgcctggctaatttttaaaaaatgtttgggcctggcgtagtgactcatgcctataatcccagcactttggggaggctgaggcaggaggatgctgngagcccaggatcctacaggagtttgagaccagcctgggcaacataggagaccccatctttaccaaaaaaaaaaaa

SEQ ID NO: 594149 - DNA, 103 bp, Homo sapiens
ccctttttttggggggggaagtttttaaccccctttcctgggggaaatttaaaaaaggggtttttttcccggccggaacaaaaaattgggctgtcccgtttta

SEQ ID NO: 594150 - DNA, 230 bp, Homo sapiens
ggcgcctagcatctcccctagcacttccggccgcctcattgaataccagagcactaaatcttttttactagaaaatactggcggtcatatgaaagtctctattactgaagtagtgtcactgagggtgtgggcaaatggagcctttcacatactagtggggggcacttggtaatacagatataagccttaaactatgtaaacccttgttctaaggaagttgctaggggggg

SEQ ID NO: 594151 - DNA, 535 bp, Homo sapiens
tgagccactaagcatcattccaaagatcatgggaccttgctttcacgtctcacttattctccaaggctcccactggtactctttcctgaacaattcagcccacgggtcaccaccagttgaacgtaataatagtgcaatagagtttttccatccccgaaaccatggagcagagattctgctagttgaaggcgaggcatacccaatagttcttaatgttacactgaccttctgcctttgagacctgtaagccacagcactggtgaacaataattctactgcctgctgctccagatccgatgggtacagggtagccctctggtagaaatctgtctgttgcctcctgcaagagagtaaacctggattcctacagagtatgaaatggctgtttgaggccgaagggaggggttgatgaaagtcacatctttttccagcacatctggcttgactgggcctactgatgtcacgagctcatgaggacatcgtacacagcgtctcaaggggtaagaatgtttcagagcacaggccctaaagccaa

SEQ ID NO: 594152 - DNA, 861 bp, Homo sapiens
ttcggcacgagctgggagatattttagtggtggtggcaagggggtgctggaatgttttcttcattgctggtgaaatcttggaactactgccttgtagaggttgagtagactttcaaaggtctttcttctccttgctgttactcaaaggtcaagagatttgcttgggtggagcccaccagcttgacttctgggaagaagtgagtgatggttgtgcctgcaaagactatagcagtgcacctggctttgggctgactagcccctggtaataccacactgcctgtattaaacacaccatgaagcagatagaggagaaacaaattcatatttcccactggcagatgaaggcactttaccatcctgaaattatccctgttttcttttgttcgaaatatattacatttgatacagtttttcttcatggctgtgaaagatggacatacccattgcagggataggttgtcccaaggactggtgtggcattgataccttctgtggaggcaattgggcatgacctgtcactgtttctgaaaaaaattactccaattctgacatcctagagatggtatttcagagacaggatgtacttttttttgggtagtgttggctaaatgtaaggtttcaaatgtgttggattttaaaaaaatacaaacagcaacagcggaattgaccagattattttccttattattctcttttaaaagtaagatgagccctggcccttctgcccaccctctgagaatatgctccctccgcgtatatatttacatatatatatgtgtgtatatatatatatatatatatagagagagagagagagagagtgtgtccttattaaaccacatgcttattaaactacatagt

SEQ ID NO: 594153 - DNA, 209 bp, Homo sapiens
  misc_feature (189)..(189): n is a, c, g, or t
caacttgtattcagcaaggtgtactaccgttactaaaagtaagaagtaagtccagactgaattacctcagcagggggcggtggctcacgcctgtaatcccagcactttgggaggccgaggcggtcggatcacgaggtcaggagatcaagaccatcctggctaacatggtgaaaccccgtctctactacnaaaatacaaaaaattatgcc

SEQ ID NO: 594154 - DNA, 278 bp, Homo sapiens
gctgtttgcgggtctccgcgcgggacccgggcgcagcgggggtcgctgaggcgagggtgtcatgtcagacaacgaggacaattttgatggcgacggcttttatgatgttgaggaggatgaagggctagatgacttttgagaatgtccgcagagagaaggcacagagaatgtcgagatctctccctctctgggagcgagcgcaagggcacaccacgaaagcgtatcacacacaccatatatagtgcacagtgcgcgcgcgcccgcgtgctctgcacccg

SEQ ID NO: 594155 - DNA, 127 bp, Homo sapiens
cccgcccccccccccccccccccccccccgggggggggggggggcccctttttgcccaaaccccgggggggggggtttttcccccgggggggcccctttttaaaaaaaaaaggtttttttttttttc

SEQ ID NO: 594156 - DNA, 273 bp, Homo sapiens
ccccggtttttaaggggggggggggttatgcccccccgtttaaaacccccccttatttttccggtgggggggccgccaaatccccatattaggggggggggggttttttttcccaaaagccgggggggcttccgttcttccccccattggttgggtccggtttcttccgccccttttgggcccgggatttttttaaaaacccgggtttttttttgggggccaaattttttttcttgggggggccgcccccccaaaaaccgttttttcccctta

SEQ ID NO: 594157 - DNA, 836 bp, Homo sapiens
  misc_feature (17)..(17): n is a, c, g, or t
  misc_feature (76)..(76): n is a, c, g, or t
  misc_feature (80)..(80): n is a, c, g, or t
  misc_feature (172)..(172): n is a, c, g, or t
  misc_feature (192)..(192): n is a, c, g, or t
  misc_feature (201)..(201): n is a, c, g, or t
  misc_feature (206)..(206): n is a, c, g, or t
  misc_feature (214)..(217): n is a, c, g, or t
  misc_feature (244)..(244): n is a, c, g, or t
  misc_feature (281)..(281): n is a, c, g, or t
  misc_feature (306)..(306): n is a, c, g, or t
  misc_feature (379)..(379): n is a, c, g, or t
  misc_feature (383)..(383): n is a, c, g, or t
  misc_feature (389)..(389): n is a, c, g, or t
  misc_feature (393)..(393): n is a, c, g, or t
  misc_feature (396)..(396): n is a, c, g, or t
  misc_feature (401)..(401): n is a, c, g, or t
  misc_feature (451)..(451): n is a, c, g, or t
  misc_feature (461)..(461): n is a, c, g, or t
  misc_feature (470)..(470): n is a, c, g, or t
  misc_feature (474)..(474): n is a, c, g, or t
  misc_feature (604)..(604): n is a, c, g, or t
  misc_feature (758)..(758): n is a, c, g, or t
  misc_feature (811)..(811): n is a, c, g, or t
gacttgattgagaagtncctggatattagccgccccaagatgcaggaggtggtggcaaacctacagtatgacgatngcancggtatgaaccgagaggccactgcagacgacctcatcaaggttgtggaggagcttactcggatccattagccaagggcaggggccccctttnctgaccccccccaaaagctntcccctgcnccccnccccctcnnnnccaccatcctcttcttggccatgggangcctttccctaagccagctgcccccagagccacaaancccctatgtggaagtggggcgggcntcatagagacttgggaatgagctgaaggtgaaacattttccccctggatttttaccactcccacatgaccccncccncccccntagnccnccaanccttgattggtgttcccagttgtcccccttccggggaaggattttgcagntctttggctnaaaggaagntgtncgtgtgtgtgtgtgtatgtgtgtgtgtgtatgtgtatctcacactcatgcattgtcctctttttatttagattggcagtgtagggagttgtgggtagtggggaagagggttaggagggtttcattttctntgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttnttcggaaaaaaaaaggtgggaggatgtgaattgttagtttttgagttttcccnaataaagtagaatataagaagaaaa

SEQ ID NO: 594158 - DNA, 352 bp, Homo sapiens
atagagacagtttttcctccagaatcagtatgtcagtgtgttcagcgtctcttcttcttcgatttctccgttttcaaagtttaacttcctggattctcttctcccccttgcctctggtttcagtagtcaactttcccaccagtcctaatccgtatttcacatcttttcgctggtcacctgctccttcctgactcacccctggtcaccttctttgacctgattcacccctggtcacctgctttgacctaagtcatcttgtagttacctgttcctaactgtccttcctgctatactagtcaccctgccactctggctcatatgcctgctcccttttaaatagcctgtcggaatt

SEQ ID NO: 594159 - DNA, 712 bp, Homo sapiens
  misc_feature (13)..(13): n is a, c, g, or t
  misc_feature (84)..(84): n is a, c, g, or t
  misc_feature (88)..(88): n is a, c, g, or t
  misc_feature (90)..(90): n is a, c, g, or t
  misc_feature (93)..(93): n is a, c, g, or t
  misc_feature (117)..(118): n is a, c, g, or t
  misc_feature (139)..(139): n is a, c, g, or t
  misc_feature (164)..(164): n is a, c, g, or t
  misc_feature (175)..(175): n is a, c, g, or t
  misc_feature (181)..(181): n is a, c, g, or t
  misc_feature (183)..(183): n is a, c, g, or t
  misc_feature (219)..(219): n is a, c, g, or t
  misc_feature (225)..(225): n is a, c, g, or t
  misc_feature (323)..(323): n is a, c, g, or t
  misc_feature (327)..(329): n is a, c, g, or t
  misc_feature (331)..(331): n is a, c, g, or t
  misc_feature (337)..(337): n is a, c, g, or t
  misc_feature (346)..(346): n is a, c, g, or t
  misc_feature (350)..(350): n is a, c, g, or t
  misc_feature (480)..(480): n is a, c, g, or t
  misc_feature (634)..(634): n is a, c, g, or t
  misc_feature (687)..(687): n is a, c, g, or t
gacagaaagaganatagataaaaaccggggcgggggaggtttgtaggaagggaccctgaaatggaagtggggagggggtggagnggcnantgntgttgttggaacatgggcggggtnnggatccggacggtgggaggcncgggcgcgttagagtctgtggaccntggggggaggntgctcncncgttagtcatactgttcacatatcccagacttttgnggaatnactaattacggcataagcgcatacttggcgggctgcggtaaacggcggcatgatatctttttttttggcttttaaatggtaagaaggcacgactatanactnnnantggctnaaaggaagntgtncgtgtgtgtgtgtgtatgtgtgtgtgtgtatgtgtatctcacactcatgcattgtcctctttttatttagattggcagtgtagggagttgtgggtagtggggaagagggttaggagggtttcattttctntgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttnttcggaaaaaaaaaggtgggaggatgtgaattgttagtttttgagttttcccnaataaagtagaatataagaagaaaa

SEQ ID NO: 594160 - DNA, 716 bp, Homo sapiens
acacgcaacaactatcttgtcttctctcacacacactctcttgaacaacaacgcgcggcgagagagaaatatgattttctctcttctcatgcagggcggtgtgtgtgtctacagacaccacacgctgcttccctctctctctctcgcactctctgtgtcacacacacacgcgggcgcgcgcgctctctctctctcatcgacacacacgcgcacacacatttctctctcttctagaaagagatatttttgttctccgccacccgctggtcgctccacaccgcgcggtgcgcctcacataacaaaagaaggtggtataaaaggcggggtgtttcctccccacacgcggtgtccccactcaggatacccccccgcggggcgccctgttttttcaccgcgtgtctctctcttctctcgcggacacacacacatcactctgtgaaaattttctcctggtttatacccccctctctctcagacgaacaaggaggggccgcgcaatgagggcgcaaaatacagcatacacgtttttgatcatcgggggctccactggtgtttgtttgaatgaagcccaataatttttttgtgtggggtgttttgggcgcccacagaggggtccctgcttccacaccccccccccgagaggagagtttttttttttgggggacaccgtgaacaacacacacaaaaaacacaaaaaaaaaaaaaaaatggggtga

SEQ ID NO: 594161 - DNA, 404 bp, Homo sapiens
cggccctttaggatctttccctttgggggcgggccccaaaaatcccccgggggggttttaggggtgtttaggggcaaatttacccttccccccgggtggccaaagtttgggtttcaaacccccccttaaaccccggggccccggcaggtaaaaaccaaatttcccctggggcccaaaaaaggggttttttttaaattttttttcccctcccccaaaagggggcggggggggggggggggcccccccaatttaaaaaaaaccccaaggggggggttttcaatttttggaaaaaagtcccccaaggtttttaaaaagggccggggccccaaaaaaaaagggtttttttcaaaaccttttttaaaagtttaaaaaaagttttgggcccttggttttttccttcccca

SEQ ID NO: 594162 - DNA, 204 bp, Homo sapiens
gtcccctcggaatttttgggttttcccccccccccccccgaaagggggtccggggcccccccctcggggtccgggttttccccccggcgcctgcgttaatttgcgacccgggttttccctttgggtccccgggaccccgcccccccctatgccctgggggcggggttctttccccattttttttaaagcccgggtttgtgccca

SEQ ID NO: 594163 - DNA, 201 bp, Homo sapiens
tatgctaggaacaacatatgacgcactcatccccatggaactcatacgacaaacatatatggtcagacaagaacctactgctaaggctccagtgtgcttatgaatgcgaacaggatacccgcgattacgctaggagcaaaatcatgcacctcctatgaagaagacttgcgtaggcaatcagcctaggattacttatatgag

SEQ ID NO: 594164 - DNA, 1404 bp, Homo sapiens
  misc_feature (711)..(711): n is a, c, g, or t
tcatctactctaccatcttggcaggcacgctcatcacagcgctaagctcgcactgatggtttgacctgagtaggcctagcaacgtaaggcgatgctagctttatagtgtgccagttcataatccatatcaaataaactcgcatcgttccgaaccagtaagctagtccattctaacgtattcttccctcaacgcgacagactagactcgcatcctaatatatgctcttctaagtgagctagtcgcgtcttccaatcaatagtaggtcagcgcgagagaatcgtagagctataaaagcgcaaatggctaacctacattcaaagttacctcgattctattgaagtcaactcgatgacagttgggccttattaggcgaaatgagaaaagcataggatagttaggccgccctgtttcactggtctgagtacccctagaaggttcttacccaagggcaacaccatcgtgtaacaatgccggtccctggtgtcgtattcgttcgaacgagtgaatccacatggaatcttagagatcgttaagacactcttcgtcgctccagctacttcgtcatatctggttatggccatgcactagtccaggacagattggagggtggatttaagaccgaaaggcgcagatttacgtcaaaatatcttaagtgcattacgaactcttcaatattttacacccagcattttggggaatcgcaccgtatnattacgcggacgttcatgatccgttaacaatagggcccttaagcattataacgcaggtaccttttaagtatacatacgtgactttctaataattttaatacccttaaaagttacttagcacgggagtttcctgacattaatccaaactatataaacttcccaagattactccatttggaattggctcgtaaacctgaagattaatacgtgcggcaacgcgtgggaacaacaaaaggcttaagaccacattggaacttaaaagaacacccgttgatattgttcacaggatgccctaagccgcttcactttctttctctctgaagggaagtggccttggtggcgccggcgaataaatacgcgggcttgttttatggcccccaaaagtggggtccactttatttcgggaacagaaattcccgcgcaaaaaaacgaaagttagggccctccaattcggattcccccggagcacaaattaattggggcaacccaattgacgcaatcgcatatagagccccttcgtaacatgtcttatacccttaagagcgtataagtcatcttatggccggacccgtctcaagttcgacaaatttaagttccccgcattatgttttagccaaacggtttaagaacacttacagactgacgacggtctgagccaacatacaacaagaagcacaaggccattagattcac

SEQ ID NO: 594165 - DNA, 215 bp, Homo sapiens
gttcactttctacacaagaccagctatttgggagactgaggtgggaggatcacttgagccaggaggtcaaggctacagtgagccatgatcacaccactatctatactccagcctaggcaaaagagtgagaccctgcatgaaaaaaaaaaaagggcctcagacttttttttccatgtgtactgttatgtgtagaaattggaacgggttaccgagct

SEQ ID NO: 594166 - DNA, 201 bp, Homo sapiens
acctagtcgttgctgatgctatgagctgatgaattaaacctggagtgtatgtaccatgggcttcgtaaggaataacaatatatttacatgtttaaaccagtgtctcatagtatactgcagaaatcctaatgggcataaagaaactatagaccgactaaccccactgcaacctcacctgaccccttaggctgtcctttcatg

SEQ ID NO: 594167 - DNA, 491 bp, Homo sapiens
cgcacgtccaactatactatcctaatctatgccgtgagatatattcataacaacagaataacatgaaatgagattatcacaatagatacctctgattaactttacaaatgtcaagatgtcatgaggttgggaattagaatacataatttgaatgagagttgagatttaataagaaaagaaaaagaacaggggacaagtttaatttagggctcaaacaaccctggaaacaatgaagccaatggcaacaagggtgaaaaaggttaccgggttcctcccactttgaattcccaaagaaaccagtttaccacaggcccgggaagggacgaaaccagaactccagaagaatgcctattaaaataggcatcatggagtttcccggtggaattaaaggcagggaggagagttcaggaactctgggccccaagaattttggggctgtgttcatggttcaatatttaagtgtcaactttgattgggattgaacgtattga

SEQ ID NO: 594168 - DNA, 341 bp, Homo sapiens
ctagccagagttgtaagtggcactcactctgtgctttgttttctccttctccaaccctgtcagtccgagtaaaccatctaaaatttaaaacctccagataatctcttcttgctctatattcccccagatctactgcagaaaatacagttgttttggtttttgtttatttgttttttgttttggtttggctttggttttggtattttgattttttgtttttggtttggtttggtttggttttttgttttctccttctccaaccctgtcagtccgagtgaaccatctaaaatttaaaacctccagataatctcatcttgctcagtgtgacctagaaacacgtc

SEQ ID NO: 594169 - DNA, 429 bp, Homo sapiens
atttcgacggaggactctctctaggtactctaggaaatgacaaagtgcccttttcaaggatatacccaaacagctagcaccaggccactttgatctgtgatgtctacaactccaggccaaatcatcatacagatggtgtgtgtgtgtgtgtgtgtgtgtgtgtgtgtgtgtgtgtgtgtgtgtgtgtgtgtgtgtgttgtgtcattatttttgaatagagagaagagtgttatattgagtgtcgcgcttagtgggggctaagagtcacagcttcattttaatatcccaacgagggagagaggtgtgtacatgtgctcaagagagacaccatttatattgagtctcactcaattaaagagagagagagggtattaatctaacggggaaaaaaaagagtaccagtaaattcttgagtggtgtgagagtatg

SEQ ID NO: 594170 - DNA, 919 bp, Homo sapiens
gggaacgcacccgtcttgtcagcgcttgcgctgccccgcggggacaggcccggacgggcgccgcgcggccgctagcgcccgcccggtctcgcacccaagagaggtggagaagagcgagttactgtgagaaagaagaggcatcccatggatgatgatgaccatgaagatgaggaagatgagtgttgtctcgcacggggcatcgtcgcacggtgccctgttagttgatcgtccgtgcaaggtgcgcgcgaggtctaccccacctatgctttaagcccggcggtatgctgtgggtacctctcgcatgtgccctcggatatgtgcgtccaccggaggtggaccctccctgcgggtcgcgcgggcctatgtggcccagggaattgaaccggctggggcgcccagcccgcggggtgggcggtcttcagcccaaggatgttctaccattgcgccagggcagtgacacaatgtgtttgcgcgggaccagacttctgttgcgcagccggggctcaggagcttcgcaccgttctcccccgtggcccttttggcccccaggtcatagccaagccctatcctgtgtggtgcgacggtgtaccccctttggctgtccttccccgggggcgcaccatgatgaacgccatctgatcccggtcgacgttggacctgttggatgtgtgtgtccgtcgagatgattttactgaggggctgggggtgccccgtgaagctaggcgacgagctttccaacggaggcaggaggtttgatggccaatctttgcttgctcatgcaggcgcacggatgtgctcaccggctgtgcatcccggctcgggccagcctgaaggtctacgagccccacatccaggtgcttcggcagggcctttggggtggattgaccccattgggtcttaggtggggccgctcaacccg

SEQ ID NO: 594171 - DNA, 170 bp, Homo sapiens
cgggaatacccttctgggcagaacctgtgagcttcacgtgctcagcttccccgcggaaatgctcacaggatgctgcgtggacccccgggcgtgccacacgctctaagtggtaggtgctagtctgaacgtggtatggcccaccacgtagaccgtcactgtgccagtgtctt

SEQ ID NO: 594172 - DNA, 114 bp, Homo sapiens
  misc_feature (6)..(6): n is a, c, g, or t
ctaggntggaaagcgacgttcataggtttcaaggcctcaatccaatcagcgtctagctggctcgttctgtcctgtccatctgagatcccagaggctgcttctccttttgtttgg

SEQ ID NO: 594173 - DNA, 284 bp, Homo sapiens
  misc_feature (247)..(247): n is a, c, g, or t
tgaatgttatgtcgattacacggtattgatcgtctcgaactcgacttcgtctgattatgaaacattctggcaatgcttcgtctggtcgtctttgcgccggtcaagaatgtacctctagcggcgcatacgaatgccccggcgtcctcttaatcatggctcagttccgaaaaccaacaaatagaccgcggtctattcattattctagctgggtatcaggcgctcgggctgctttgaacactctaatttntcaaagtaaacgcttcggcgcccgcgggacactcagc

SEQ ID NO: 594174 - DNA, 169 bp, Homo sapiens
tcagaggatcccggaggcaggaactgggcagggcatgtgagctccttgcacaccttgctccagctcctcggggccccaggcctgcaggtcacgcggctgccctggtggatgatgtctggctatatgtgtcttggaggccgcaccccgcatgacctcttctcctctggcc

SEQ ID NO: 594175 - DNA, 471 bp, Homo sapiens
gaactgctgtgggactgactactaacgggactgttgcaaaacgaagacagacttgatgggtttttcaacttatgaggaatatttccaactcacaaaagtaaactgaagcctctctcttgtgaaggcacgctactcagtttgaagaaagagctcataatgcattatctagactataaaagcgcaatactgagagtcttccctagagataagtaacagggagtacacacccatgggacactggaataccgattagaaacaagaatccaaaactttttaaaggatacggtctgttcccggaaacaatgttcttccagtcaacagctcgggcattatgcatcccactgagcaaatatcaactgtctggttgtaaatgcatccagttcagcatgatctcaggagtcctgtaccacctagtggccacgtagcctgtcatttcatcatctgtgtgcctagccccaaagccactccaca

SEQ ID NO: 594176 - DNA, 279 bp, Homo sapiens
cataagagtgcgaatccagctattagaaagccctgtgttctttgactccactaaactgtcacgctgtaatccagtatgcactaaacaggagtttacggtgaccttgaaaacacagattactataattactataataaatcccttacattcctgtctctagcatggtttagggagtgccgaggctcaatgtagatggggtcaccttgtcagagcatctgttcatacagaaactgggtttcctgcagaccccaggtgctgcataggattcctcaaacccta

SEQ ID NO: 594177 - DNA, 397 bp, Homo sapiens
tttagggttttaatggtagtagaattattgatagagttagaggagtttattgagattgtggttattattttttttatttttgtaaggtaggagggttggaaggatagttttagtgttaatgagtttaaagagttgggtatttagtagttgttttatttgtttaaggatgtgggtttttttgatgagaagatgaagagtttggatgtgaattaggatttggagtttaagtttaatgagtattggagattgattggggagttggttaaggaaattaggaagaagaaagatttgaagattaggaagaagtaaagttgtttggttgagatggggtgggtagggtagagttgattagggttgagtagaattgtattttttttaaataaagttttttttttga

SEQ ID NO: 594178 - DNA, 186 bp, Homo sapiens
atgatgctgaggtacctagagttcccggcagaatacactcaagtgtagtttgcagagctcagtcagagggcatacctgtgaatataactccagaatctacaaaacggggaaagtttccagcccaacttgtaaacatcagtgcacatgtattgatggcgccgtgggcttgcattccttcttgtgtcc

SEQ ID NO: 594179 - DNA, 760 bp, Homo sapiens
atcactcagttaaggtggggcaggaacaaatcacaatggtggaatgtcatcagttaaggcaggagccggccaatttcccttcttttgtgattcttcacttgcttcaggccatctggatgtacacgtgcaggctatgggctcagaggcctgacagtcggccactagttaccaaagctgtgtgtgcaggctggagtctccagtggaagctattgattgattgattgactgattgacagggtcttggtctgtcacccaggctggagtgcagtgacgcgatcacggactcgctgcagcctcaacctcccatgctcaaggtgatccgcccacctcagcctctggagtagtttgggaccacagatgtgtgtcaccaggcttggtatgatatattatttattttatttttttagggacagaatctctctatgttgcccaggctgttctccaaatcgtgggttcaagcgatcctcctgcctcagtctcccaaagtgcatgggatgacaggtgtgggcaaccacaaccagccaaggatctggtataagcaaagataaatcacataacaaactccagcaagactgggagaaaaaagaaaaagagacagaccacagtaccatgtgtggacatacaggaatatataacgaactcacaagccacaaggatggctagttaaaccaatacatatggacattggcaggaggcgaatactggagggcacatatacaaccaatgagggattagcctactgaaatgagattaaaccaca

SEQ ID NO: 594180 - DNA, 382 bp, Homo sapiens
  misc_feature (242)..(242): n is a, c, g, or t
  misc_feature (279)..(279): n is a, c, g, or t
  misc_feature (342)..(342): n is a, c, g, or t
  misc_feature (349)..(349): n is a, c, g, or t
  misc_feature (377)..(377): n is a, c, g, or t
attcggcacagcaactctgggctcaagcaaccctcctgcctcagcctcccaagtagctaagactacaggtacatgccaccatgcctggctaatatttaaatttttgtagataaggggtcttgctatgttgcccaggctagtctcaaactcctggcttcaagtgttcctactgtcatgacctgccaacatgctggggttacaggcatgagccaccatgccccaaacaggtttgaacacaaatntttcgggatgaaattaggaggaaccttaatttttagntttttggatagtttacctagtttggcaaaagatttggggtgacttgtggagctgttttttaantgctggnttgtttggaacatcacaacccaaattanttagg

SEQ ID NO: 594181 - DNA, 116 bp, Homo sapiens
gtcgacatcgatatgacttttaggacaatacacctacttctcatgaagttctgggatgaacaacaggacactgtatgtgccaggcatatgcgggcgcgcgatcgctcgacatcgat

SEQ ID NO: 594182 - DNA, 519 bp, Homo sapiens
gggcacatgctggtgtaacccttaaccagaaagctaggtttcctcgctcctaccccccgaaagaaccttgggtccaagagtactccacgtgtgcaagactgaaaggacctggtgacattccggcatcagtcctgtgaccacttggaggtcacagaagcaggctcgtgtcctcctttagttctaccacactacatgactcgcaattggttctgaaattagaacgttcaccatcgtacttaaaatcttaggggcatgaagagtcagctagaacaaggaaaaagaaagtcgcaggtagtaggtaagtaggtgggcacgtgaaaagccaggctgctctgtccaacaccaggtgatacatgatgcttataactacaatgaactccagaaggccaacagacagcagcacctgctcaagttcacctcggtaacacctaacaagaccaaagaagagtacacttaaggttgaagacacaacacattgatcttgaaacaagaaaggtttgtgcctactcaacagcgttg

SEQ ID NO: 594183 - DNA, 842 bp, Homo sapiens
  misc_feature (498)..(498): n is a, c, g, or t
tgaaaacctggttgctaatacagcgaggtctacacagcctatcaacctgaaaagggatcctaggcaagcagcacagaccaaagcacagccttgatctaatcaaagacacgtatgcgttgggtgttaggttgatcggattatgagatcctatcaatgttcgcttgatattgtcacaccaacataggagcactttctacagatcctgatcaaatgtaataggtcacagtctgcgatttcgctgaagatcacacctcagtgtgactcaacaccaactgacctatattttaatgtatgcacataaacttaactcatcaagtagatataccatccagactttctcatagcagaaacaatgcaaaaacccctctccaggcacgaatatttttaaatgccactaatattcgatacgtgttgcacccaatttcactagaaggtatcagcatgtatgcgacatcgtcatgtttgaacgttagaaacacaatgtgcactcagaatttnccttctaaaagcatcaccttctacttggcagaagcaccatgcgcagaacatgtacaaactttacacccatgaagccacagcagcccaaccttcagcatctgaagtctagcccacctggatttccatttccagggccttctaattttgccccacgcatgtctgggattccaccacatatgccaacttcattactttccccttcaagttttggcgtttgtctcccatggggttctcggcaccctggtggtcatctcccaggccagccacagggatggaggggggctttcttacaagaatcaaggtttttggcccgcagaattttaccccgttgactttgggggccc

SEQ ID NO: 594184 - DNA, 117 bp, Homo sapiens
taactatggctgcacagcctgttttgtaataagttttattaaaagcagccatgctcatttgtttacttattgtctatggctgctttcctgctatgagggcagacctgagcaagccag

SEQ ID NO: 594185 - DNA, 1437 bp, Homo sapiens
  misc_feature (5)..(5): n is a, c, g, or t
  misc_feature (25)..(25): n is a, c, g, or t
  misc_feature (41)..(41): n is a, c, g, or t
  misc_feature (92)..(92): n is a, c, g, or t
  misc_feature (98)..(98): n is a, c, g, or t
  misc_feature (121)..(121): n is a, c, g, or t
  misc_feature (254)..(254): n is a, c, g, or t
  misc_feature (1436)..(1437): n is a, c, g, or t
ccggncgcggtggcgcgtgcctgtngtcccacctctgcctnccaagtagctgagactacaggcacacgccattacacatggctgattttttntaattntatttttgtagacctagggtctngctgtgttgcctaagttcttcctgggctcaagcaatcctctcaccttggcctcccaaagtgctgggattacaggcatgagccggtgtgcctggccataattcctttttaatataacttgtttacagcaacatncaaccttagaattttgagatgaatgactaaattattattatcttcctttttttcccttctgatataccaattttattaggtgatatctccgaaaaacccaattttgttaggtgatctcataaaaaaaaaaaacccagcattgactgaggttgttcaaagtaaagttattttatttttatttatttatttattttgagacagagtttcgctcttgttgtccaggctggagtgcaatggcgcaatctcagctcactgcaacctccacctcctgggttcaagcaattatcctttctcagcctcccgagtagctgggattacaggtgcatgccaccatgcccggctaatttttgtatttttaggtagatacggggtttcatcattttgggtcaggctggtcttgaactcctgacctggggtgatccgcctgcctcagcctcccaaagtgctgggattacaggcatgagccactgcgccggcaaagtaaagtaatttaaatagtgcctctttaacatgacacacagtaaagtaatttaaatagtacctctttaacatgacacacattataaggacttgttatatcccttctctttctggggaataatttttggaaaacttactgccttgtatttgggcatatatgacatgtgggttgggaccccaggatcatggtttccaactctcttgtccctgttgtttcaagcacataaactgaattcacagtcctatccaggacccttggagaagattttcctgcaggagcatttgagctaagagactggctggctggagggtaaattcatcagtactgctgagatcatcaccgtatatgcccctgaaggagtggagtacagtggttgagttggggcctctggagtcagagatacctgtatttatcccattttgttgacttccctgtctccagtaccctagaacagtgcctgccacatatcagacactcaggacatatttgtgaatgagtgaatcttagtgtactgggagattcttctaatcatcctgtggttaatatgaagatcattgtctgatttgtagtccctctccttactgaaacattagcggaggctttatttttatagtaaatggagtatttaggctttttttttattttattttgattttagtttttagtttttttgacattatttactttgcgggccgaaagcnn

SEQ ID NO: 594186 - DNA, 153 bp, Homo sapiens
  misc_feature (58)..(58): n is a, c, g, or t
aggtggaaagcgacagttcaggtggaggcatgagaaggcttgtgctagccctccaggntcccatactgtggagtttggaggggcaggtctggctttcctgggtcagcatagggcacccagtgtgtggggcacagtgtggacacccatgcacag

SEQ ID NO: 594187 - DNA, 697 bp, Homo sapiens
ttctttgcccatagcatggttcattgtccccagcgctaaggtgccttggcctataccttcagctgtgactgtgacatcatcattgaccgtggtctcttctgatctcagaagactggcagattctcagtgcatacggtcagtgatcttggagctccgactggacagttgaaggctcacatcaaggttcagttcatggtggtcagtggcgaccgattggtattgagacaaggcttgcatcaccattaaggtggcctgggtacagccatagccaccaaggtagtatctctgtacattgatcaaccgtgctacgctaggcgcatagtcacagtctattatccacagtaggcacaagagggcatagcatgtggcctactcgttgtagatactgctcaccagggtcctcccaccggttcttatctctggctgtggtcaagaatctgttaataataggccccttcagcttgaccatatggtccagagcatagccagcaatgtccacagtgtaggatctctgtaggttcatgtagttggcttcaagtaagtctcatgctttagtgatgctgcctggcagcctgctgacctgctcctcgcaaatatctttagcctcctgcagcaatatgagacacaaagcccgtgaggtccatgtctttctagttgctgttccgtaatccaccaatcatttcttggtgtatcccgg

SEQ ID NO: 594188 - DNA, 668 bp, Homo sapiens
ccagaacaactggtcttcgggcccgacgaacgacctcctatctttcccaggctctatacggattaatcactcagcttaataattcatccaagggtgcatcccattgaagtacctcgagatgaccgatcgctatgcctcggatcaatgacgtggaagaccaaatgttgcgtgacgacgcaggctgaacgccacgctcgcatgaacactgctcgaacagtctctcgcccttctacctttcggtgctggtcatccagcaggtggtccgacacatgcgcagcatctacaaccctcgaagtgcttgaatatcagcagacggaaatctctgcattctcgcttcctggagggtgtcccgcaacagttgccagtgtctgtcttgcagattggctacccaggtgttgcatcacgtacccctttctatcatcaacgggtacataaggagtcctggccttgtctgaggagacggatttacaccttcccatcttgctgaaaaggtcaaggccttcttgcgctgatccatctgcctttgtggctgcagcccctgtggctgctgccaccacagctgctccagctgcatgctgcagccccagtttaaggttgcaaccaaggaagacgctcggaggagtcggacgaggatatggatgtgtctctttacacacggaaagcaacca

SEQ ID NO: 594189 - DNA, 154 bp, Homo sapiens
tgctgccagtgaaacacgcccaaaacttagtggcacaaaactagacattgatgatactcttggatatagaattctctgctggatcatagaattcagacgggacatagtaaggatagtctgtctcttagcacaacgtctgggacctcagctaggg

SEQ ID NO: 594190 - DNA, 180 bp, Homo sapiens
agaggactcccggcacattgtgctggcatctggtgtgagcggaccactcccctcacattccagaggccatggactcacttttgtaacaaactcctacctaacactgatcaagtaaaaagcaaatgtgggagttttttttttttttttttttttttttttttttttttttttttttttttt

SEQ ID NO: 594191 - DNA, 273 bp, Homo sapiens
gtattttgagtggaattgcattgaatctatagatcaatttaaagaaaatcaacaattaacacttcttagtcttctaatccataagcatagtatatctgttcattatttggatagtctttaatttctctcaacaatgttttataaatttcagagtacaagtattacaattttctgttaaatttctccctaagtatttaatgttttggatactgttctttagaatttcaattgcaggtattcattgttagtatatacaaatacatttggtatttg

SEQ ID NO: 594192 - DNA, 708 bp, Homo sapiens
tataaaaaaacctggtttttatccagcccaaaccggggcaatctacctcgggggtttggccaaggtttaaaaaataaaaaccaaccaacaacaaaacaacagcgtggtagaagaaaaaggtgaagtataaagagggggtcgggcgtcgcggaaatcccgggggtttacattccagcgtttcggctcccgtggaggccggcgaggggaggggagtgcccctcccggccgtggtgggtgcgggggcggggcccctgcggggggagaggtctgccgcggggaagccagggccggtcttgggaagaggggaaaaaatgggcccattctgtccctccgcggagagaatcgaggaatgggcacacatgttgggcagttgggtgtggcagaaaaaggtgtgaggagaaagcgtggtgtatcagagtgaagagtggtgtgcatatttcacacgaggttgtggtgggaggacaagtctcgagaaattcacaaaaaagagaatatatactgtgggggttttccaggtgtgcacaccttgggggagggagagtgtctagattacccacgagaggcgtgaacagaggctgcggggtaaaggtctgcagaaccaccgagtgggaagaggctcgcaaatgaccacccggacaatgtgcataacgggtgactcaaataacaccggccgtggggggcccaaaagccccggggggaaaagtggaa

SEQ ID NO: 594193 - DNA, 188 bp, Homo sapiens
cgggcccctggccccttcccccccctttgccccccgtttgcagaccttgtccctttgccccggggtttcccttccccccccccagtttttggaaatttttttttttcctttgaagtcccctttttttttaaaatttttttttttgccccccaaccccaaaaaaattaaccggtggggggcggggccca

SEQ ID NO: 594194 - DNA, 102 bp, Homo sapiens
tcctccaacagatttaatcaataagtgcagggcacatctgtctgtcattatgttattatggatcctcatactgcacaatgcctgatgggagaagatgcgcca

SEQ ID NO: 594195 - DNA, 211 bp, Homo sapiens
  misc_feature (2)..(2): n is a, c, g, or t
angtgttgtgcttgagctacttgtgggcatctgggctgtgccactgactctctgacggcagctcgggacatggacacatctcgaggaagcagaagatgatgaagtcagtgttgacgacggctacgcatgtgtcccagcgggtcagctgcggagaacaaacccccagtcccaatgtcatggcgacagatcattcctgggacagccactatgc

SEQ ID NO: 594196 - DNA, 395 bp, Homo sapiens
  misc_feature (337)..(337): n is a, c, g, or t
cccgcgctgctctcataggccacgcccttctgatctggataccgtcctggacagagcctgccctcttttcctggctgcagccctcacgcactttctcccatgctgaatgcgggtgtgctgtcggtgccctgccctctgtcggccctgcttcctgccacgacgtgtcctcttccgattccttttctctcagacactgtaggtctctcctgccataatgctgttcccattccccacaacttgtcgtgacagcagaccacactgtgctcggcggatcactaagttccaatccagtgagcccatcgtccgcctagctcccccggacagacatgcttcctgntttgactctagaattccgccgcctccggtcccattgctccatccttctgtgttgggga

SEQ ID NO: 594197 - DNA, 210 bp, Homo sapiens
gtttaagccaagttatccaattatttatcaaagttttaacttggagaccctaaagaccattcgtcggttagcgccaacagctgatatcgcagcgctacggttattggggcggctataaggtctattggttaaaatggcgtggggtctttgattatgtccatgtcgatatgcgtattttaaagcataagccggaaatttttttggcgctca

SEQ ID NO: 594198 - DNA, 798 bp, Homo sapiens
  misc_feature (783)..(783): n is a, c, g, or t
  misc_feature (798)..(798): n is a, c, g, or t
gctgctggtatgtgtatctcgagagtaaaaactgtatacacagggaccttgctgcaagaaactgcctggtaggtgaaaataatgttctgaaaatcagtgactttggaatgtctcgtcaagaggatggtggagtgtattcatcttctggcttaaagcagattcccattaaatggacagcaccggaagctcttaattatgggagatacagttcagagagtgacgtgtggagctttggcatccttctctgggagaccttcagcttaggggtttgtccgtaccctggaatgacaaatcagcaagcaagagagcaagtagaaagaggataccggatgtcagctccccagcactgtccagaggatatttccaaaatcatgatgaagtgttgggattataaacctgaaaatcgccctaagttcagtgaacttcagaaagagctcactatcatcaagagaaaactcacatagtgacaggatggcgccaaactcagccttcaggactctgtcctccagcagagtaacattattgttctcattaacaatgaatttataccacattaccttcgacagtcttctaccattattttttattaactgggtgtcttaaaagtacgttccacttgtaaaaagtcaaaggcaaatttgttaaagaaataggcagtcctaccaagggctttcttagctaaccatagcaatcctaccatttcaggccattgcaaatagaaaagcacaggcttctaagtgtgtgaaggataaaagatctatcctatccctttcacaccttgtntctactttaggcacn

SEQ ID NO: 594199 - DNA, 367 bp, Homo sapiens
ttctagagttgatgtctgactaggagcatctcttcgtatttcaacgttcacttctcgatgatgaacaagacttcagaaatggccttgcggaattagatgccaacatagctagactccagaagtctataaggactggtcttctggagcaacatgaatccagcaagcaaaatatcatcaggtgcttcgtttttcacaaacactcgcaacttggctcatattgcaatgtgtatttttctcctcagtgcaaatgcatgttttcatgttcattcatgtgtgcacagtcaatcatcatggtcaccaagtcacatcacaatgtcattgttgcagcatcatattgcacacggggaatcctactagagatcgaacc

SEQ ID NO: 594200 - DNA, 369 bp, Homo sapiens
  misc_feature (74)..(74): n is a, c, g, or t
aattttttttcccccttgggggggcccaaaaaattttttcccgggattaggggggggggcccggaaagaaaaanccccggtttttccccccccgaagggggggtttgggggggattttttaacccctgggccgggggggggggcccgcttttttttttaaaaaaagggggttttttgccccaacctttcccttttttggggggggttttaccccccccagggggtttttgggggggggacccaaaggggggaatttttttggggcccccccctttttgggttggaatttggggtcttttttttttcccggcggggttccccccccttttttttttttgggttttccccccaacccctgggggtctttta

SEQ ID NO: 594201 - DNA, 316 bp, Homo sapiens
gaacatctccgaccttacctctactaaaaatgcaaaaattagccgggcatggtggtgtgtgcctatatcccagctactggtggaagctgaggcaggaaattgcttgaacctgggagacggaggttgcagtaagctgagatcgtgccactgcactccaatcagggcgactgagcgagactctgtctcaaaataaagtaaataaataaaaatgtctgcatgacccatatggttatgaagtttttttcctagactaaatgattgccgattatttatgggggctagaagatatttagctatcaatgtaaggcggagattg

SEQ ID NO: 594202 - DNA, 572 bp, Homo sapiens
  misc_feature (18)..(18): n is a, c, g, or t
ggagtatgcagcaatatnccacattactaaaaacatcaaagggcctgtaaaatagaactgtgaactctcaatagatagaggaaatatcaactatggtgcactcaaggacatttacattatgatgaccatggggtttatgaacatttataactatatttataatttccatattacatttctcatagtatggacaactttttgccactaactgaattctccaaatacacgtgaagtttcaaaaaagaagccgcaaatatgtagttctgaagatgttgaataatcattttacaaagcagttttctgaatggggattagttggtgattgtttgtaacaaatatgctaatgctttagaaatgtcagtatttttgtaattatttctacctccaaatatatatatattgtctttcactggataaatgtgtgtagatttttacatgtgccttatttgacaatgcttatgtctagtataagcatgtctcatttgaagttcttttttattatgttaaagaatgcagctgtatagattatatagctttcattttattgctatttgattctttgttcgtcccat

SEQ ID NO: 594203 - DNA, 262 bp, Homo sapiens
aaaaattttaacccccaaattccaatccccggttggagaatggccgttaaccttagccggggctttatttttcttcccaaactgccggagggcctccttaaaggtttttttttgggggaaaagctggtttcccttaaaccaagaagaaagggccgaagaaaagtgggcgcccttaaaaaccgagaaaaccgaaattaccacccgggactgctttttcttttcccgctggggaccgctaataaaaggggttttttttgctgga

SEQ ID NO: 594204 - DNA, 312 bp, Homo sapiens
gaactttgtgtagatgggatggagttttgctctttccccagtgctggagttatgtggtatgatttcagctctttgcattctccgcctctcctgggttccagcaattctcctgcctcagcctctcaagtagctgggattacaggtgcccgtcaccacaccaggcaaatttttgtctttgtagtagagttgcggtttccccatgttggccaggctggtcttgaactcctgacctcaggtgatctgcccgcctcggcctcccaaagtgctaggattataggtgtgagacaccatgcccagccacatatactatat

SEQ ID NO: 594205 - DNA, 315 bp, Homo sapiens
gttagaagctgcagaaacgcctgccagtgcagaacgctcctccagtgcaaactggtctggaaggcttggccatgtgtgccctggaaagttctaggaatctttttggtgttaggatagaacggcattcatgtattcagcaaaacacctaccaaaccatagttaacagagaaaactggttagagaataatgtaaaacaggagcgtttaacaaagttttccactagagaagcagtttggaagagtcaagtcaccctaagaggaaagctgggtatattcttgtaagagtagccttggaacctcctttctcttctctgtt

SEQ ID NO: 594206 - DNA, 400 bp, Homo sapiens
  misc_feature (22)..(22): n is a, c, g, or t
  misc_feature (24)..(26): n is a, c, g, or t
  misc_feature (245)..(245): n is a, c, g, or t
  misc_feature (300)..(301): n is a, c, g, or t
  misc_feature (397)..(397): n is a, c, g, or t
gaaaaaaaaaaaagaaaaaaanannnacacgcggcggcagaaaaacgaaaaccacgcaaacccctcactactcacaggtccatggcctttgattcactctgtattttggcctgaaacccatagtggtgctgcatttatatgaagcagtgaaggaagccctgactgatcttggagaggagtttcctgcaacacgccttttccccctggctgaaagacctcaccgaggattggacttgcgctgagtnttcgtaagaattggattgagatccggcgttcctccctgatcacgctgtgaacagnngggatgggccccaaccacacccaacgcccgcccccaccacccccccacaccccactcaccccccgccccaaagcccccccccccggagtagaaagnaac

SEQ ID NO: 594207 - DNA, 583 bp, Homo sapiens
  misc_feature (429)..(429): n is a, c, g, or t
aaaaaaaaaaaaaaaaaaaaatttgtgtgcgggccgcgccttcggcgccctctggaagaaacgttttttgaaaaccatatccggttgggcgcgcgcgcggggccccaagagggtttacagtggagaaatgtgtgggctcatatagccttggtgttctcctataggagagaatctccggggctaattgaacctatacggggcgcttgggagattctctctaccacaatatataaaacacacgcgccgcggggggagacaccaccagaggcgcgtgtctcttgggaaaaaatatctccaaagatggggaggtctcgagagaggggctcattatacgggggagattctatatctaaaacggggggagcgctcacaagcgcagagagcgcctctcgagatatatcttcaaatatctatagcgcccccccgggnctgtgggtggagaaccaacgacggctcaacacatacttcaagaacaaccaaaaaaacataacaccaaaacaactgcaagcaaacagcacaaaacataataagataacaacaccacaaaaccataacaacaaaatcaccccagaggaggacaggt

SEQ ID NO: 594208 - DNA, 92 bp, Homo sapiens
  misc_feature (87)..(87): n is a, c, g, or t
cactcagaacctgcatccacactacagccaaagaagagctgggcactgcagcctccgcacatcacccaaggaaccttacaaaatacnctttt

SEQ ID NO: 594209 - DNA, 181 bp, Homo sapiens
taatgttttttggtgcacaaggattttgtcacaaggagtccttggaagggggttggtgtaaatatcaggtctatcttgctttttttcatttgcttaaacactgtgagcgtttctggcggaacattgcgcccgtctctcagagtctactccatacccatctatgcctgtacccactataatg

SEQ ID NO: 594210 - DNA, 295 bp, Homo sapiens
ccagaagcagcaagactacaggtcacaatagggaggtttcaatacgggtatccagaggccacagaccaacgccaggagtccctgcttccagaagaattagaagatcagatgccaagatgggtggcagaagaatctaacagaggtagcacaaccataaacaaagaagcaagtcacacaagggacgtttggtagctgtggtgggtgtagccaaaggtgtaagagattcaggagctcccattcagctgatcccttttcaacagagcaggagcttgcctgagagcacgcaaaagcagtt

SEQ ID NO: 594211 - DNA, 374 bp, Homo sapiens
  misc_feature (216)..(216): n is a, c, g, or t
  misc_feature (244)..(244): n is a, c, g, or t
agatgtaccgtacacaacactagaggacgagacgagtcgtcttagtctaggttccttaagtcattgtattgccacaactaacctcctcggactcctggcctcactcatttacagccaaccacccaactatctataaagcctagccatggccatcccctctatgacgcgggcgcaggtgattataggcgtttcgcgtctaagacttaaaaagtgccnctagacccacgttgcttaccaacaaggngacaccatacacccctatatccccgatactagattatatatcgaacaccatcagccatactcagttcaaaccaatagccctggaccgtacgcctaaccgactaacattactgcaggccacctactcatgc

SEQ ID NO: 594212 - DNA, 968 bp, Homo sapiens
  misc_feature (8)..(8): n is a, c, g, or t
  misc_feature (72)..(72): n is a, c, g, or t
  misc_feature (260)..(260): n is a, c, g, or t
  misc_feature (558)..(558): n is a, c, g, or t
  misc_feature (582)..(582): n is a, c, g, or t
  misc_feature (586)..(586): n is a, c, g, or t
  misc_feature (686)..(686): n is a, c, g, or t
  misc_feature (726)..(726): n is a, c, g, or t
  misc_feature (728)..(728): n is a, c, g, or t
  misc_feature (787)..(787): n is a, c, g, or t
  misc_feature (854)..(854): n is a, c, g, or t
  misc_feature (875)..(875): n is a, c, g, or t
  misc_feature (889)..(889): n is a, c, g, or t
  misc_feature (891)..(891): n is a, c, g, or t
  misc_feature (901)..(901): n is a, c, g, or t
  misc_feature (908)..(908): n is a, c, g, or t
  misc_feature (955)..(955): n is a, c, g, or t
atatcttnaaatgcagaaattgaaatcctatcaggcagacagccccgctgccacaccctgggtcctgtgtantaaaagatcgacccctgacctactcggttatgtaatctatagattacagacattacgtatagaaaagcactgtgaaaatccctgtcctgttttgttctgatctaattacctgtgcatgcagcccccagtcacgtaccctctgcttcctcaatccatcaagaccctctcacgcggacccccttagagtngtaagcccttaagagggacaggaattgctcactcggagagcttggtttttggagacgtgagtatgcggatgcccccagctgaataaagcccttccttctacaactcggtgtctgaggggttctgtctgcagcccctcctgctgcagaagagcaagggagagagggatggagaaatagaaccagagggagagagagagacagcgatagagagagagagagagacagaaaaggggggaggagagagagaggggggaagagagagctccacagtatgagcgcgaggcggagggggaagtanagaaagggagagggtgagggagtngtgnagcgacaccgacagagccttggagagggaggctctgctcaggtagacagggcacctttcagcaggccggggtggggtggagggttcttgggccgggctanaacagggggtcagggcccccacccaggaaaaccaatggancnctgatacgtgttttttttcttggattggttggttgctttgggggtgcgtttcataaggnccttccttttgtttgcttctttctgtctccttagatgcggtgggccccgagatttgtagagtgtgcncgtgtgcctgtgcgtgagcgntggcgccgagcctntncacgggggcnactgggnatctctctcctgtcctccgactggagtgtacacgaagcggtggcatngggaacaggggga

SEQ ID NO: 594213 - DNA, 326 bp, Homo sapiens
  misc_feature (29)..(29): n is a, c, g, or t
  misc_feature (83)..(83): n is a, c, g, or t
  misc_feature (88)..(88): n is a, c, g, or t
  misc_feature (97)..(97): n is a, c, g, or t
  misc_feature (242)..(242): n is a, c, g, or t
  misc_feature (246)..(246): n is a, c, g, or t
  misc_feature (249)..(249): n is a, c, g, or t
  misc_feature (311)..(311): n is a, c, g, or t
ctgtgtgatcaatgaatggttcctcctgncctgaaatgatttcagcaaaatcacacaggcaggtgggcacgaggctggtgggnttggnagcctgagncctgggtacggaggggcccccatcctcctcttccatcttgggtgattttggcaccatccccagcaggccaaggtcagacattgccacaaacactaacctgctcatctactcagcagataaacatcagagtcagagcctgaagagncagncgntttcttcctcctttcatgacatcttaagtccttggcaaagagtgtggcccgaaaccagagcnccaggacagagcaaa

SEQ ID NO: 594214 - DNA, 198 bp, Homo sapiens
  misc_feature (183)..(183): n is a, c, g, or t
acggacgagtagttctctgatcagagcatatgaagcaacctctgttctcattactttatatatctcatctcataatacatacttactagaggatcagttccgatggtccctccgtacatcacagtgatatatttcgagactcttataaatggagtttgcctggatgatgttgaagttatgatnttactgggattcggg

SEQ ID NO: 594215 - DNA, 107 bp, Homo sapiens
ttctaaggtggggtgagctccccttacttcctggaggagtcaggttagtcttttaaactaggcattaaaaggaaagctggaattatttgtttccagatgtggttgag

SEQ ID NO: 594216 - DNA, 427 bp, Homo sapiens
  misc_feature (17)..(17): n is a, c, g, or t
  misc_feature (20)..(20): n is a, c, g, or t
aggagctaaaaaggaangtnttctgtattctgggcaagagaaatattgttaagtgttatgctactacccaagcatctacagttcactgtattcctatatttcgcagaatgattaaacgctttttgcagaatggaaaaactgtcttaattcatatgagctacggagaccctaatggccaaacatcttgaaaaggacaagttggagactcatatttcctgatttcaaaacatactacaaagctacagtcatcaaaacagtatggcatggcgttaacagtagccatagagaccaatggaatagaattgggggtccaaaacaaatgcatacatctatggccagttggtttttgacaaggaggccaagtttatttaatggagaaagaatagtctcttcaataaatgttgctgggaaacaggatttccttacc

SEQ ID NO: 594217 - DNA, 379 bp, Homo sapiens
agttgtggtttttgagatggatttagctcttgttgccccggctggatggcgcaatctcatctcactgcactccaccctgggtgagaaagcaagacactgtctctaaaagtaaataaatggggccaggcacggtggctcatgcctgtaattccagcactttgggaggccgaggtgggcagatcacttgaggttaggagttcaagaccagactggacaacatggtgaaaccccgtctctactaaaaatacaaaaaattagccgggtgtggtagcgagcacctgtagtcccagctacttgggaggctgaagcaggaagatcacttaagaccaggagtttcagactgcagtgagccattattgtgccactacatgccagcctg

SEQ ID NO: 594218 - DNA, 329 bp, Homo sapiens
  misc_feature (7)..(7): n is a, c, g, or t
  misc_feature (37)..(37): n is a, c, g, or t
  misc_feature (120)..(120): n is a, c, g, or t
  misc_feature (190)..(190): n is a, c, g, or t
  misc_feature (238)..(238): n is a, c, g, or t
  misc_feature (245)..(245): n is a, c, g, or t
  misc_feature (257)..(257): n is a, c, g, or t
  misc_feature (265)..(265): n is a, c, g, or t
  misc_feature (294)..(294): n is a, c, g, or t
gatgccnctagatgaggggttctggacatgtcacagnaacacccgttatccccatactagttattatcgatgccagggagcctggtcaagcggggcaatagcgggtgtccggactactanccagtgacatgagctggagtcgacctactcatggagctaattggaagccccaccggagcaatatcctccnttcaccttctctcaaaacttatgatcatcctgaagcggattcagctgnctatccnagtactcccttncccgagangcccagcccacgtagttatactcctagtnagccttgatctattcatccacacagaaaaaaaaaa

SEQ ID NO: 594219 - DNA, 175 bp, Homo sapiens
gtctataggatccccgatagcttaatagtgctaacaaactacaatgcaaaatgaggctattctgcagttcaaactgaaataccatcttattacaatttgatccccagtgtttgctctttttgaagtaaccgactctacatctctaaaaacgagtatggcgtgccacgcatggaaa

SEQ ID NO: 594220 - DNA, 467 bp, Homo sapiens
  misc_feature (7)..(7): n is a, c, g, or t
  misc_feature (40)..(40): n is a, c, g, or t
  misc_feature (97)..(97): n is a, c, g, or t
  misc_feature (119)..(119): n is a, c, g, or t
  misc_feature (453)..(453): n is a, c, g, or t
  misc_feature (455)..(455): n is a, c, g, or t
ccttggnaaatccttgggttggaaacccgaaccccctttnaaaattgccaaactttcccggccaaaaacttaggcttcccccggaaacgcaaagaancgccaaaaatgttggccaacanaagcaggaagattgattggaacgcgaagcttgaggctcccagctgcgggactactgcgccccacccaccctcatccggctgctcaagtgcaagcgtgacagcttccccaacttcctggcctgcaagcaggagcggcacgactgggactactgcgagcaccgcgactatgtgatgcgcatgaaggagtttgagcgggagcggaggctgctccagcggaagaagcggcgggagaagaaggcggcagatgtttgcaaaggccagggacccggggaagtggaccccaaggtggccctgttaggtgcaccccccaccctatggaccagtcaaataaaancntcaggcccctca

SEQ ID NO: 594221 - DNA, 733 bp, Homo sapiens
taaaaccccgtgtgctggggggggtgggggtgtaatactaagtggagaatgatatcatttaggggggaaggcgcttggtgaagtaggccttatttctctgggtcctttcgtacagggaggaatttgaagtagatagaaaccgaccgtggattacctccggtctgaactcagatcacgtaggactttaatcgttgaacaaacgaacctttaatagcggctgcaccatcgggatgctcctgactccaacatcgaggctcgtaacccctatggttgatatggactctagaataggatggcgctgttactccctagggtaactgggtcccgtgggctcaagttatgggactcaaatggagtatagtagtctcgcttggacgggtgaagtcttagcatgtacggctcggaggtggggttctgccccgaggtcgccccaaccgaaattttaaggcaggtagggaagttaaggaccgtgggggttcgtaaggatacggtggcattaataaattaaggcccatggagagtctccatcacaattgggagtggtaatgcccaggcactttaagggaggggccaaattcccgggttacacagttaaaaacaggttaaaccccgtgggcgttaatagaggcgccatatagggaacgtgattttcccctttgcagagaaggaaaggccggaaaagtttatagaggaagggcggcacaaaggggaacaagatgattttgacacagca

SEQ ID NO: 594222 - DNA, 894 bp, Homo sapiens
  misc_feature (247)..(247): n is a, c, g, or t
  misc_feature (264)..(264): n is a, c, g, or t
  misc_feature (312)..(312): n is a, c, g, or t
  misc_feature (333)..(333): n is a, c, g, or t
  misc_feature (339)..(339): n is a, c, g, or t
  misc_feature (347)..(348): n is a, c, g, or t
  misc_feature (362)..(362): n is a, c, g, or t
  misc_feature (387)..(387): n is a, c, g, or t
  misc_feature (397)..(397): n is a, c, g, or t
  misc_feature (408)..(408): n is a, c, g, or t
  misc_feature (411)..(411): n is a, c, g, or t
  misc_feature (426)..(426): n is a, c, g, or t
  misc_feature (451)..(451): n is a, c, g, or t
  misc_feature (456)..(456): n is a, c, g, or t
  misc_feature (459)..(459): n is a, c, g, or t
  misc_feature (467)..(467): n is a, c, g, or t
  misc_feature (474)..(475): n is a, c, g, or t
  misc_feature (506)..(506): n is a, c, g, or t
  misc_feature (740)..(740): n is a, c, g, or t
  misc_feature (759)..(759): n is a, c, g, or t
  misc_feature (814)..(814): n is a, c, g, or t
  misc_feature (859)..(859): n is a, c, g, or t
cgccgaggcccgggtcccccaggccgtctcgccgccggcatggcggaccctaaatacgcggaggcttccgcggcatagccaggagagtgagaccagatgtagtatgaaactagacgacctacctgtaggatgatcaagcggagttcgatgcggaggagctgacaagcacaagtgtggaacaatcattgtcaatcctaatgctgcctatgagaagttcaaggacaagagagtggggacaaagggactngatttctcagatcgtantggaaaaaccaagaggacaggatatgaatctggagaatatgagatgcntggagagggtctgggagtganggaganaccccagnnaaagtaccagcgcntactgcatgaggtccaagagctganaactgaagtngaaaaaatcangangacagtgaaggagtnagccacagaggagaagctgagcccngtgtngcnggctaaanagctggnngccctgaagcagcagctggttgcttcccacntggagaagctgctgggaccagatgctgcaatcaaccttaccgaccccgatggcgccctggctaagcgcctactactgcagctggaagcaacaaagaacagcaaagggggatcagggggaaaaaccactgggaccccccagatagcagccttgtcacttatgaactacattctcggcctgagcaggacaagttctctcaagctgccaaagtcgcagaacttgaaaagcgcctganagagctggagacagctgtncgttgtgatcaggatgctcagaatcccctttctgcaggtctacagggagcctgtntcatggagactgtagagctgttgcaagcaaaggtgagcgctctanaccttgcagttttggatcaagtggaggctcggcta

SEQ ID NO: 594223 - DNA, 298 bp, Homo sapiens
aaaaccaacccctcagatactggaaactttggttttcccatccaggaacacaccgatctgggcatcaaatctgacccaacccttggtacccacggcctggacttctatgtggcgctggctaggccaggtctcagcatcgcagacaagaaccgcaggacaggctgcattgggcccaaacacagaatcagcaaagaggaggccatccgctcgttccagccgaagcatgatgggatcatcccccctggcaaataaattcccgcttctatccaaaagagcaataaaaacttttcagtgaaaa

SEQ ID NO: 594224 - DNA, 121 bp, Homo sapiens
ggcccctgggggggggttccccccccttgttttttggggggggggcccccccccccccttgggtcccggggtttgggtttcccccctttgccccggtaaaccctttttttcgcgggttgta

SEQ ID NO: 594225 - DNA, 243 bp, Homo sapiens
gaggaggcatatattgatagagcatgtctggaatcttctactttgtaattgttggtcacatgataatccagtttacgaaatggagtttttgccagctgggcaagtgcagaatccaaagacgaccatcgtcatctgaaccagttcatagctcatgcgtgctctcgacctcgtgtatgagaacatgtggatgtcgaacaacatgtacttgaaaactgtggacaagtgcaccgagtggttagtgtc

SEQ ID NO: 594226 - DNA, 1739 bp, Homo sapiens
tagtagagacggggtttcaccgtgttagccaggatggtctcaaactcctgacctcaggtgatccacctacctcggcctcccaaagtgttgggattacaggcgtgagctactgcgcccagccaactatacatttttgaagccctcctgatcacttccttggttactctcatctttgtttgaagttcaatatattactttttttttttttttttttttttttggagacagagtctcactctgtcccccaggttggagtgcagtgagccatgattgtgccactgcacgccagcctgggcaacagagtgagcccctgtttcaggaaaagaaactgagagggtaggagtaaaggaatttcctaagctactgccatgtgtcaggcccactgctaggcaatttatatcatttagctcttgaatgatcctatagctttgccagtgtgtattatctcagcttacaggtgagggcattgatgcctgtcactatgtttaagccttggtcatgctggcacagcctgagcttcccaccgcgaaccagaacagcggtggggattggctgtggaccctgacccttacctgggctggtcagcttgagccagagtctcaaagtgaagctcatggtctggcttctccaggatcatcaagtgttgtctcttcaccagaagcaaatgcccatcaattgtgtccacctggactgtctggggggttagggtggcttggcagttgagcgctgggtcaagcctgcagtatcctcgaactcctacaagaagcctgtggtcaggcccagcctctgacacctccaccgtcagtcaggatggaagtcccctgggtgttgagcagacacagggaggcagggagatgagctggatctggctgggtccctgcttagtcacaggctctggcaacctctaatgaaacatcccttcccagttggctgttttccccaaatatagacacgtgctgtcactagaggggagcttcccagcccaacagcttctggaccatgctgggctgacttggggagagagccacccacgaacccctggtttgaaggccagactaggtggtcatatggaaggtgacagaccttccccctggtgggtgtactgtgtgcagggacaaagcctgtgctagcaccctgctgtcttgacagtaagtgtctttgggctgggcatggtggcttatgcctgtaatcccagcactttgggaggccgaggcggacagatcacccgaggtcgggagttccttctgccttggacacccaaaatgcagagattacaggtgtgagctaccacaccccaccaagggtctcttaagaagagctggccgggtgcggtggctcacgcctgtaatcctagcactttggtaggccgaggcgggcggatcacgaggtcaggagattgagaccatcctggctaacacggtgaaaacccatctctactaaaaatacaaaaaattagccgggtgtggtggcgggcgcctgtagtcccagctactcaggaggctgaggcaggagaatggcatgaacccgggaggcggaggttgcagtgagcagagatcgcaccactgcactccagcctgggcaacagagtgggactccgtctcaaaaaaaaaaaaaaaaaaaagagctatactgtgttgaaagagtcctgtataaaggaggatgtcttaaatttgccattttgactctgttttgaacaggtcaccaggaaaatgagacttggtagcctggcgaggtggctc

SEQ ID NO: 594227 - DNA, 350 bp, Homo sapiens
  misc_feature (247)..(247): n is a, c, g, or t
  misc_feature (262)..(262): n is a, c, g, or t
  misc_feature (265)..(265): n is a, c, g, or t
  misc_feature (270)..(270): n is a, c, g, or t
  misc_feature (280)..(280): n is a, c, g, or t
  misc_feature (287)..(287): n is a, c, g, or t
  misc_feature (293)..(293): n is a, c, g, or t
  misc_feature (304)..(304): n is a, c, g, or t
  misc_feature (311)..(311): n is a, c, g, or t
gaagaaccaaggtttaaattactgaccctagtgaaattttctggcccagcttataagggctgctgtgaaccactcataatcacccttctgccttaacagaagatttataaaacacaacaatcagctacaaacagggcaaagaaaatgtcgatgggaaatcataactgaaagttaattatacaaggttcaaatgctggctccgtgggctggaaatcatgatctgccacgtgcatgtccgtcactggtnggccagtggccctgncgnccagnctgctactgngctgtgngcccangccttggcgcnatttagnacactaccagagtctgtggtaacttaatttgcaagtaat

SEQ ID NO: 594228 - DNA, 357 bp, Homo sapiens
gggtcaggtcgtccaggccaccgaccccgatgccgccgcctcctgctcctttcggctgtccgccaccgccgctgcctccccggctttcccgccggctctcccccagctggcccggacctattccgggggcctccgaccccttccttcagtctccgctggcgtctgcatgcccctgagcctccgctgtgaggtctcccgctggttggacggctggcgcttggcgccttctaccctggttgccacacacctgtactgctgtctccttccgccagcccgcagttgtctggctccgttccccgggagacctgaccgcctgcgcgagctggacgcagggcactctggactcccctggctccg

SEQ ID NO: 594229 - DNA, 417 bp, Homo sapiens
gactcttttcacactcagctggatatccttgtgtaggtagggtactgtcatttacagtggccctgtcaggaattctgggcttggatcaaaaagccaggaaggacattttatgcctctgtcagttccacataggagtctgtaggctgcaaacatccttcctgtcctgatgagaattcatcatctttatgaacctgtctttgactcttccagcctggtcctctgttgatgctttctctcttgataccatgtttactcctttcctttgtccctctctctgccacttcctgtgcttggtaaacaactttgtacctgggattgagttgtctgaaagagagattgactctaccacttcattcactcagtgccctgggaggtctgccacatgccaggtaccagtatggggagcacagcacagca

SEQ ID NO: 594230 - DNA, 886 bp, Homo sapiens
  misc_feature (242)..(242): n is a, c, g, or t
  misc_feature (333)..(333): n is a, c, g, or t
  misc_feature (359)..(359): n is a, c, g, or t
  misc_feature (368)..(368): n is a, c, g, or t
ccaacagagggggaaacccctctccaattggataacccaatttgcccggcgttgtggcaaaagcccgtatgccccgctaactccggaggctaaggcgggaggaaatgcctgaactctcgggaagtggaggttgctcgtgaatcagagtcgcacccctgcaactctatgcccgggccaatacacgcccactgcccgctccacaagaaaagaaaaaaaaaagaaaaagagggttacagatcatngcacatggaaaatattcccagcagtaaccacttccattaatgtgatctacagcttttaaaaaggagcatctcagaataagatggtggtacnatttgcttattgagaaaggaaaaaanaaaacacangagtatattacaaagggaaaagaaggaatgtgatttctcatgattgaaagcttgatttagattgcatacagcttttgctacccaagaccaagaggctctggcaagacagggtggttttccgaatgccagactgaggtgccttatgaaggcagctgccgatggttccagatgtagagagataggtgatgcaggagggaaagctggattggaaaagggagagttttgtagacgggctacgctcattgtgcctttgaaagagcagagccggcagcctctagtcatcatttggatatacaggactagagcatgaatctgatgtagagctacagaatgaagagcaacagcagctgtttaaataccaagaaagtgtgtagaatgaaattggacaagccaagcatggtggtttcatgcctttagtcctagctacttcggaggctgaggtgggggaattacttgagctcagcagtttgagttcagcctgggccagatggtgagaccctgtatcttaaaaaaaaaaa

SEQ ID NO: 594231 - DNA, 806 bp, Homo sapiens
  misc_feature (162)..(162): n is a, c, g, or t
  misc_feature (253)..(253): n is a, c, g, or t
  misc_feature (279)..(279): n is a, c, g, or t
  misc_feature (288)..(288): n is a, c, g, or t
tgtttccctttgtctggagagtatattgttgaagaggatagctattagaaggattatggatgcggagcttgcggtgagcagagattgtgccactgcactctggcctgggcaacagagcgagactcggtctcaaaaaaaagaaaaagagggttacagatcatngcacatggaaaatattcccagcagtaaccacttccattaatgtgatctacagcttttaaaaaggagcatctcagaataagatggtggtacnatttgcttattgagaaaggaaaaaanaaaacacangagtatattacaaagggaaaagaaggaatgtgatttctcatgattgaaagcttgatttagattgcatacagcttttgctacccaagaccaagaggctctggcaagacagggtggttttccgaatgccagactgaggtgccttatgaaggcagctgccgatggttccagatgtagagagataggtgatgcaggagggaaagctggattggaaaagggagagttttgtagacgggctacgctcattgtgcctttgaaagagcagagccggcagcctctagtcatcatttggatatacaggactagagcatgaatctgatgtagagctacagaatgaagagcaacagcagctgtttaaataccaagaaagtgtgtagaatgaaattggacaagccaagcatggtggtttcatgcctttagtcctagctacttcggaggctgaggtgggggaattacttgagctcagcagtttgagttcagcctgggccagatggtgagaccctgtatcttaaaaaaaaaaa

SEQ ID NO: 594232 - DNA, 609 bp, Homo sapiens
ggtggccttgtgcaggaattgaagaagtgcaggaggatgccacacagagatgggagagggagcgaaaggagcaaaggccctaactttcccgttaattgatgtctccttccatctttagtccatctccagacgaatgtacatgttatcctccccgtttgaagatgaagacactgaggctcagcaaagatcaaacgcctttcccaagagcgtcacagctacgtgcctgtacggtagccatgtaagctagcaagaagacccttaccagacactgcatgcgtggtgccttgagtcttggacttcccagcctcctgaactggaccactggtgtcatggcacgagatgaaccatcaccttggatgacctgagttcctccttaatttgcattcactgaatatccgtgaatgggcgactccactcgtcttcctcttgtgtttatttatgtatctcatcaccgtattggggaacttagagatgattattctgatcctcagtggatcaccaggctccaagcgtccaactgtatttccttctgagtcacctcgctttcatggacgtctgctactcatctatcactgtcccccagatgctggcagctggtgctggagcatg

SEQ ID NO: 594233 - DNA, 240 bp, Homo sapiens
  misc_feature (184)..(184): n is a, c, g, or t
tggaatttaagaattgaatttaattgggaaaatccaacaatgaccttattttagtagaaatccattaaaggatttttaaattatcattagtcacctccacaaagacaataatactgcttgtgaaagaacgaggggaaaaaaaactgattatatttatctacaatttccctatatttgtaaaatntaatctatatatttttactaacttataatgagaaaaggaaatgatgcccgtcgacg

SEQ ID NO: 594234 - DNA, 585 bp, Homo sapiens
gagcggccccgaccccttttctatttctgaacaggcatgttccaggcagctcacccgactccttagattactatggaatcggtagggtcctgaccgctggggaagcaggaaagcgtatcctgggaagaaaggcttggcttggactccggagaagaatactacatcgagacctgctggggaatgttattttattttattattttctttggtcttggttgtactgcagggcaggaagaagaggttgtagtaggcccggtcgaacttgtggcagcctgaaggccccctacaggcggcagccgcgggcagccccgcagccggggacctggtgcagactaccgcggacgctgtcagggaagcgcaggcggccaataggaacccgggagacggtacgctgctgctagaggcggacagtagtcaggccagtcacaaaccgcagactagcccgcagcacccactccgcgggaggtcccccagagcattggaagtctcgacagtctggctgtggccatgggacgatacagtagtggagcctgcccccttgtaagccaagcttctgatgcccacttcatggcccagcagggaaat

SEQ ID NO: 594235 - DNA, 439 bp, Homo sapiens
gccattacaaggggaatccatttcctccctcactcctggcttccattgccttcccccaggccccagaccctgagttccagaatccctctgaccacatcctcttgtgctcaggagggcagaataactgcagcctttccctgtgccctgccaggcatggtcccgaggacccccatctcagaaccacatcatccagggcatgcaagctctggccttggacccacccccaatcagaagggactgatggccctgatcacacgaactccaccacatctgtgaccagacgttcatctccatgagcatcgcatgaccctgcaagactgtccaaatagagcaagaagtgacatgttactctatatggggacacagcatggactggacagaacactgacaggggatccagagtgtagccttgcacaagatcactgaggagatgtggtat

SEQ ID NO: 594236 - DNA, 124 bp, Homo sapiens
  misc_feature (36)..(36): n is a, c, g, or t
  misc_feature (38)..(38): n is a, c, g, or t
aacgaagccaacacagggcaagtttgcatgcttgcncnacggggcccccgcttccggttcacccccccgacccctgcttcccctccttccgagggccgccagaggctgggctgacccgaagagg

SEQ ID NO: 594237 - DNA, 305 bp, Homo sapiens
  misc_feature (74)..(74): n is a, c, g, or t
gttcgggcggcagagctccaccggtgagggcgacgaggccagtcctttattataagcccctactggtactatantatggggtgggggggcgctactacaaaaattttcttttctttttggttttgcttattgtgtacttagctatagataattgttgagtacaaagcctacggggcatataaatgggatagttaactgatcctgggtggtgatgtgctttttacggggggggggcgacatcttttaatccaacatctactactgggtcttgcgcttcctttttcttgttcttaaattctgggtgg

SEQ ID NO: 594238 - DNA, 212 bp, Homo sapiens
acgtgttctttagatgcttaccctaaaacagttccgttgaatttcaccctgacactaacaaacaatttatctacagaatagaggaagcagtcaaatatgcatttgtctcaggtgagcagaggtatgacttctggttctatccttggtcccgttcttctgaagataaatggtttgttatggtcagggtgaaattcaacggaactgtaaaaggg

SEQ ID NO: 594239 - DNA, 399 bp, Homo sapiens
  misc_feature (1)..(1): n is a, c, g, or t
  misc_feature (57)..(57): n is a, c, g, or t
  misc_feature (231)..(231): n is a, c, g, or t
  misc_feature (346)..(346): n is a, c, g, or t
naatctcggaacaaactgtgcatcacattccataatattcccttgtcaattatatanaaagtttaattaccaagcctgcttatatattgctccctctgcttctcatcctaatcattaagctcgagagcttctgtaaactaagaattactctatctaggctcagcagaaatacacagaatacttatatatgaaagcctgttgcaaagagtagttaataagtacacagaaatntttgactatatgagaacacatctctcactcagaaaggcacagtggagagtattatatttagatataatctagccacatgtgtgggatatagaagagtcattataattatatgtcncatctctcctccctgtggccaactttctctatctctcgtgccgtactcctaca

SEQ ID NO: 594240 - DNA, 88 bp, Homo sapiens
  misc_feature (40)..(40): n is a, c, g, or t
  misc_feature (64)..(64): n is a, c, g, or t
ggtgctgtttcccctttgccttccgccatgagtgtaagtntcctgaggtctcccagtcatactnctggttaagcctgcggaacggctc

SEQ ID NO: 594241 - DNA, 258 bp, Homo sapiens
tctagaggatcccggtttgaccaatcaggcaaaagcatgcaactttgaactgcatggaggacctgcacaaaacggctacaacgcggtcccagtctagaggcataagtattaaggggctaggtctactactcaataaggtactgtaacactaattgcagtgccccctggttgcatctaggtcttttcttctttgtattagagtttcatatttctcgttgacaaccttgtttcttcttttcatctgatgggacgaagatg

SEQ ID NO: 594242 - DNA, 680 bp, Homo sapiens
  misc_feature (449)..(449): n is a, c, g, or t
ctgatacgttcagcacctttcagacggacccggcctgacgcatccggtggaaggtgccatgcgaatgtcacgattcaggtcaagcttccggagctggggagatgcaggtgtgatctagaacagggctcacagcctcggaaacctgctctcgccgccggcccccgaagaaaatagacgcccattcaccggagagatggggactgaggccgatgatcatgcatgggagaccatgatgtcagggactggatggactggagtgtcaggcaggcccatgaggaccatgactggccccgatcaccaggacatctgaaaccaagaaaccaatggaacacaaaagaacccacaagaggcaacgaccaaggcagccccaatccggggggaacaggaggaccacaaggaagagaggaatcaggatggacaggagacacaacaagtacactggagagcanaattgaaggacatcatgaagaggaagggcattcacattcattactataggagcattaggacgcagataaacacaaaataccagggatgggcgcataacaatacatagaaaggacgacaagagagcaattgggaatcacaatcaaccaaacaagagggaccacgtgaaacacatgtgaaacgcaccatggaaaccccctgaggagataggaaacaggaggataacaaaacca

SEQ ID NO: 594243 - DNA, 287 bp, Homo sapiens
gttggttaaaggtgttgatgggaaaaacctggcgggaggaaatatgtttcactttgctgaggtgcaggtggaggaggctattatacttagtgcatataacagtgaagaatgttgggcagggcagagtggtcagctgaatggcagtgattccaggtctcagttaatgcccacaaagttctgaactttgaacatagataccctcactgcaatacatgtctctctttctctctctctctttctttctctttttttactatacttttggagaaaccgttttgggacgcagc

SEQ ID NO: 594244 - DNA, 207 bp, Homo sapiens
gtgtcatcttacttctgtgcttagtgcaatacttcatcaatccagcagtagcattacagtatttccagcacatcatgaacatatttattatcagtgtctaaattcttgcctaaagtcacaagacttccttgatactataaaacatagctatatattgggtttcggaaatacatcaagatgctaagctagaagtgattgctccccgct

SEQ ID NO: 594245 - DNA, 287 bp, Homo sapiens
ccccggtagaggccccgctgcctcctgcgacaggatgtgacgtaccgaccctgcattggaagttgggggccaccctcgattggaggcttggtgcctgtcatctgggtttcggaccaggtcctgcgggtcactggctatctggccgctggttctggatatggtaccgcagtccaggagcacgaggatgcctcggtctgccgagtcgtgactgtgctgcccctggcgccagttcttcagagtctcgtatacggccaggtcgatgcccgcatagggggggggatggagca

SEQ ID NO: 594246 - DNA, 264 bp, Homo sapiens
ttagacgatcccttattactggcattggatggggtgagtttggtcactgagttcctgtcctttctgcctgtgactagagataggcatgatgtaaaaacaccaggatctgctgcttagcaaccagtaaaataccgtatatctggataggcagtaacacagtacttcattcatttctctttcagtgtgatgaagagaaaaggcttttttgcttgagaaacagaaaagccccccttctctagaaaagccatatgtgatcattatgga

SEQ ID NO: 594247 - DNA, 201 bp, Homo sapiens
atcaacgtgtgttctggggtcgtgccacgtgctaactccagtctgtgtatgcaaaaatgtaaacttgtgccctgtgactgttgttcctttgttctgtagccttcgtggcagttccgtgggactggtggcctgtgtggtcgtgttactgggggcgtcctgtagtggaacctcgcgacatcaagggtttcgaaagccgctgtg

SEQ ID NO: 594248 - DNA, 151 bp, Homo sapiens
atgatcaatcactcgcaatgacaggccaggcaatccacctggttatgatagcttcttatcttctgctaaaaggtcagtacattctttggtgctcatgactgtaccagacacctatgagcaaccattagtaagattacactttaatcatggc

SEQ ID NO: 594249 - DNA, 481 bp, Homo sapiens
  misc_feature (250)..(250): n is a, c, g, or t
gttgatagtctacctgaaactaagccattctgagtcatatggatgtaccagaagtactctgttttaacacaaatgtatgcaggtacattttaaacacccagaactggaaaccagaaacaccatttttggtacactggcaaaggatcagctttctaccatggaatgcaaaagtcttgtggagatggaaacaccagatgcacatattccgtattctaagggcctttcatgttgacagagagaggggatcagngactgggggacttaactaacaggctagagattaatgcttcctatttgatgcggaattctatattctgaaattctagaagaaaatttgtgaggccacgccccctttgagaacaaaggcttttatgagaataggggagaatgaaacgattcgaagcaaaaaagcaaacaccaccaatcaacccccaggcaggaagctactataagggatcataaatccaggtgcccaggatgt

SEQ ID NO: 594250 - DNA, 247 bp, Homo sapiens
ggaccattacgctcaggatcgcgatgcccaatcaaggtgcggtggaccactcggtacaattcgcctggtattaccctcagggaggataccctggggtcgagtagcctcagttgacttcgggattctcagcacgactggcgagaacgcctcgggcgggaatactcggaagcgatcctagtctaatgtctctagagtggagatgctagccggtcaattacctgtcatcatattctatggcggaggattc

SEQ ID NO: 594251 - DNA, 212 bp, Homo sapiens
taccccccccccccctttttcattttttttggggggggtgggggtttttaggcttcctttttttttttgggggtggggggccccccctatggggttgtttgtaaccccacccctcaaagggcctgtccatccctaggacccctgggttgtcccggcccgttttttatttgggggggcccttttttaaaaataaccaagtgcttttcccccca

SEQ ID NO: 594252 - DNA, 304 bp, Homo sapiens
  misc_feature (104)..(104): n is a, c, g, or t
  misc_feature (121)..(121): n is a, c, g, or t
  misc_feature (126)..(126): n is a, c, g, or t
  misc_feature (233)..(233): n is a, c, g, or t
tgaagataagataaagcactttatgagtatttgttggataaataaaagtaaactaaatggaatttcaaagataattaaagaatggggtacaagtaacatttgangcaataatggctaaganttttnatgaattatgaaagaaaccaattagaaatattctacagcctacccataccctaggtatttcagtagtttgtttttgtttttgttttgagatgtagtctcgctctgtngctcactctggagttcagtggcccgatcttggctcactgcagcctccgtctcctaaggtcaagtggtcttt

SEQ ID NO: 594253 - DNA, 211 bp, Homo sapiens
ccgtagtactctcatactacgcttagattccatctctatgtgacaaagtgacatcaacttgggaagaggccgcacatgggcatggtcctgggaagggctcacaccgacgacatggacttgagaagggactgagggccccactggtagtcagtagctgtatgggcagcacgggatatgttcagggcgccacatacgggtaccgacgctcgaa

SEQ ID NO: 594254 - DNA, 921 bp, Homo sapiens
  misc_feature (364)..(364): n is a, c, g, or t
ggagagaactagtctcgattttttttcttattattgttatttttatttttaaacaagggtttattatccatttttccctttataaaaccaccacccaacaccggggaaattattgggagggggtcccaacctaagggccgggacttctgaaatctaactccccatatgtccctccattttggtgaactatagtgttggcggcgcgatcggttcatgtcaaacatcgggttgttcccctaattgggtatctgcgcaaaaagtgagcgacctaatggcacacagctctattggtcggccacacctcacagagaggtgtctcgacttcgcgccgcggtcttgtgcaatgacaccaaacatgttgtcncccccgacatcacaaggggccgcttttgacactctcacagaacagacggggcgctcggcaaatctatggtgtccgagccgcggccaaacatcgcttcgtcacgtgagccggcttcgtcgcgcaacgaacgttcctatctcgcgctggcgcaacggcacccacttacgcgggaactagtgagcaacacacaacacacagtactcgcgcacacctgccgccactctcacaccaggcgcacatctcgacgaggcgctaccaggtgccggcacctcgccagcaacaacgccgtactccccgtgcccagacaagcgggcacaacgacgaagcccaactcagcgccatcaacgtaaccaccaacaaaacagcgcccaagttacctaacacaccaggcgccccgacaccacccccgctccactacacaacgtctactgacccaaagggctaccacctctacacccacaagcaacggaccaccacacaacggcagcgatacacaaccggctcaagaaccaacttctgcgacctactaaccgcctccccaccgcagacaactaact

SEQ ID NO: 594255 - DNA, 107 bp, Homo sapiens
tactttcacagggacactattcacaatagaaaagacatagaatcaacctaaatgcccatcaatggtagactggattttttttaatgtgatacatatacaccatggaa

SEQ ID NO: 594256 - DNA, 342 bp, Homo sapiens
gctcactctagaggattccgtgatgttatccccaacacttcaggaggcaaggcaggcagatcatctgaggtcgggagatcgagacccacctgaccaacatggagaaaacccgtgtctactacaaaattagccaggcgtggtggcgcatgcctgtaatcccagctactcagaaaggctgaggcaggagaatcacctgaacccgggaggcagaggttgcagtgagctgagatcgcaccatttcactccagcctgggcaacaagagaaactccatcgcaaaaaaaaaaagggttgctttccttatagagaaaaattaggttaaccggttggtgcatggccggccc

SEQ ID NO: 594257 - DNA, 362 bp, Homo sapiens
  misc_feature (10)..(10): n is a, c, g, or t
  misc_feature (354)..(354): n is a, c, g, or t
agagaacttntcgaacacttcttgttgctaatgtaaattagtacaaccactatggagaacagtttggaggttcctcaaaaagctaaaaatagagctaccatatgatagtaaccctactgctaagaatatatccaaaagaaaggaaatcagtaaatcaaagctatatctgcactcccatgtttattgtagcactattcacaatagccaagatttggaggccacctaagtgttcaccaaacaaatgaatgggataaagaaaatgtgggtacgtatatggcaatgggagtacttgttccagccgttaaaaagattgagatccccagccccagttaggggttttattaggatggaaantccccttt

SEQ ID NO: 594258 - DNA, 840 bp, Homo sapiens
gggagcctgccagccctggtgtgcctttacatgcctgaagctggaagcctcagtgtgcctggagcagcctcaaatgcagaatgcctgagaacaccatgtgaatgtcatgcactgtgcttaagcttggataacacagtggtgtgtgtgcagactgtcttggaagccatgtggccccatatgcctgtgtgaccatgagcttcactcttggagctggaaatgggcactggtgaacttggatgtttggcttgtagttcttggctgtgtgacccatgctgtgggccttgtgatgccctcacaaattccttgaagtatggacgcgattcacttgagaccaattgacgatgtgcattagaggtgatgcgagcatagtggaacacttggaagacacccccatgtggacttagccatggtcgtggcttggcaggtgatacagactttaccctgaaaaaaaccgcttggttcaattcgcacgacgcggatatcccttcgggctcccaggacctgtggcacaacggacacagaacacactttttgtcttccaacatcgcgcatcgcacacgggcgaaacgggcaagtttcccataaatgagttgggtaaagtagcaagaattagaaccaattcaggactagttcgggaccactcgttagcgagttgctgtggcattggcatacccctggtgaatgtgctcttacaattcccaacaaaaacatagcaccaacaggtggggcaacgaagttgcacccatattataaagggcacccctttgggaaggacgtatacattccccagaggaattccaagatagggcccctggtgcaaccgaaccgtgcggctcgacc

SEQ ID NO: 594259 - DNA, 440 bp, Homo sapiens
caaaaaataaagacaaaatagggttggagaaaggagatttaggaaaagtgatcaggtggccaaagtgctgtcactaaacagggactggctctgagaattcaaacctttcaaaggggcaagacaaagaattatgcagagataccctgggtagtatactttagaggtggtagagaaagttgaaaacattaagaggaagcaaatcatgctgagtggtgacccagtgtggcacatcctaaatattgtttcttaactttgctcttcttaaaaccagccattggtactgaccatcatctcttcatcaatggcatcaagtccaatgtacactcctgggtcctgccaagcagtgtagcaattacttctccaaagagcctggttttaatcaacattttggatgggtctcactaatactttagatttaatgcacttttctaagattaaaa

SEQ ID NO: 594260 - DNA, 1195 bp, Homo sapiens
  misc_feature (216)..(216): n is a, c, g, or t
agcggaacgcctcaacgccgcgaacgcgccgggccaactgcacggaagggtctgtgcctcatgcgagaccatgggtaaccagtggttcagtagaaagttactagcaccagtggccactccgtaaaggacagcgtctagagagaaagccagtggtacttccatgcatcttacaaacgaacctgcagagaaacgagcagcagaactttagcatgtaantaaagctgagattatttcattccggcctcagaagagaccaagatttccagcaatggcgtttgacgtgaccctgcgctgtcgtctcgtgggatatgacctagtggcatggtcttcacgatctttttaccttggcaacgaaatgggcacacacgagatcaccagcgtgtagttcacgtggccttctcgtggaaaccgaccgcagtatgccaaagtggccatacatggggacgaacttgtgaaccatacataccacacacctgagaactacaggaacaagcaggtctgctgcgcaccgtggcgcagttaaacaatggcgtaaatacgaagtgggaactgggcgtgcacgtagcagggtacagacaccgtaaatggtgcccacaaaggttgggggccgaaagcaagtgggcactatttaccgaagccagtacgagtactaccacgaaggggaaccggcataaaaatttcagctaacaaaacgaatggttgagatagaacgcaaatcttcgttcgatagttcattggctcgaacagcgtgatcgcgcttttagctttgtgcgcgtagagatgtcgtgtctttggcgagattcgcagagaagacctagggattacgtagagcgggacgggattcaccgtaagcattttttgcggtcgtaattgggactgtaggggaacacctaaaaggaaaggttgccccaaattggcgacgccttaggttggggaatcgattgtaaattagcatccaaggtcgaataggatttgaggcgttaccatccagaaaactttaacccccacgggctaatggggccgttggtggtacacacacttgtggcgacttaccttggctcccacacatttcgaacagcactcaagtacgttaacacaattaaacataatcctcaatggtatttggcccaaaactaattttggtcccctgggtatgcgttaactaaactagttgaacttgtggactatatgcaaa

SEQ ID NO: 594261 - DNA, 278 bp, Homo sapiens
cctctttccatcgattaatgtcatgacagtatgactattgtgttatcaccgtgtcatcttcactgtgatcctagcatacgaacgtataggaatccacctgtctccatacagtaaagatgtcgtacaagacaattataattccttcctgtctacggcagtcggacctcctggctctctgctgtacatccgtgcatccatcatgtccatttcagagacgggaagatcttcttcaggaaagacacacaaaggtaacttgtgcagagccgtagggcgaataa

SEQ ID NO: 594262 - DNA, 1209 bp, Homo sapiens
tataaaggggggggaaaaaggaaggggggagagagagaggttggtggttaaaaaaaaaaaatataacatatattttttaaaagggacgcatcatttatattttttttataaaaaaaaaccaattaataaaatatccacattttgtgtagccgagaatggaggaaactaccagaaatgtatcatatatctcacacgggcacaggggtgtgtgggggcgccaacgcgcgcgggataactccacaaacactattgagaagaggagccagagggtgggcgaaaaataacctgtgagaggcgcagtggaatatacaaaaaaccacacctgtgggagaacacaagggaggagaaacccccggggcctctcacacacaacacaaatcacaaaaaattatgaccacagcgcgcgggggcgcggcacacgggcgcgctgtgaatagcccccacaacaataacgtggggagggagcaacaaaagacacggagagaacatgtgagcactgagacactgtgtggagaaacagtgaggcgagctgcacagagagaaaccacaaacatcagtggggcacgccaggggggcgatatccaccacacgcgcggggcgagaaacaacaaacgtgtagaaaaatctacacccagcaaaacaaaaaaaacaaaacaaaaaaaaacgagggggggggcgcgcacgaccccaaaaagaaaaaatcccccccaagaagagggagagcccccgaaacaaaataaacagcgaatcaacccacacaagccatagtactgcgtgacgcaccaaaaaaagggcggaccccacaaatcaaggaagaaggcacagaaaacaaaaacagcacaagacgacaagagcgccacgatgaatataacaacaacctcaggtcacgacgtgccacacaacacgggaactagcaagaggcgacaccactttggtagagaaagacaacacacatacaaccaacgatgggaggggaagcaaccaacaaatctaagcgggagcacaagcaaaaaccacgccgccgaacgaacattcaacaaccctcatcagaccggaggaaaaaacataacaaaatgaatcaagaacggacgtctgatcaaaggaggaacaacacaacgagaccgatcgatacacagcatgagctgcgagacaaaaaatcgatgcaccagcagagataaacacatgaacgaaacactctactacccgggg

SEQ ID NO: 594263 - DNA, 389 bp, Homo sapiens
cttggcgaggcagtctcatttgggattggagaccccttcgtgtgttttgggagggcctggtcggcttgttggggaggttatagctcatgagggagactcccgggaggtattctcctagctgagagttagaagggggcctgttttgtaagaggaaagggcgtccgtatattaactcaaatggactgaggaaggagggtgcttttggactggctctaatgctctccagtgctatgggcaaaagggaggtccatggtttttggacttcaagagtgagtttggttaactgagccttaaggatcccatttaccctttcgacttttccggatgtctggggccagcatgggatatggagacgccactggatgccaagggactgagaaacctgttga

SEQ ID NO: 594264 - DNA, 447 bp, Homo sapiens
tcttagaaagatgcttctgatgacattgaggatccacctcaataatccgatatcatcctcccatctcaagatcattaactgaaatgcatctttaaagtctgttaccatataatgtaacctattcgtgtttttattgttgttgtttgtttgtttatttttgtttttgagatgaagtcttgctctgctgcccaggctggagtacagtggcaagacctcggctcactgcaagctccgcctcccaggttcacgccattctcctgcctcagcctcccgagtagccgggaccacaggcacccaccactgcacccagctaattttttttttttttgtatttttagtaaagacggggtttcactgcgttagccaggatggtctcgatctcctgaccttgtgatccgcccgcctcagcctcccaaagtgctgggatgacaggcgtgagccacctcg

SEQ ID NO: 594265 - DNA, 297 bp, Homo sapiens
  misc_feature (286)..(287): n is a, c, g, or t
accacgccaccggagaaggactgcgcgtcgtgcagtgaaggcgggacagaggtgagagcggggtgagccgccgcgcccctcccggtgtgccttctcccaggaggtctcctgaacctccgcctttggctttccctgtgagccgctttggttctggccaaacacctggtatgaagagctgctctcgagccagctcgggccatcgcaggccggtagcacgagagcaggaaagacctcccggagtgtccctccaggctccccttctccggtggcgtggtggggatcctcnntagagtcgac

SEQ ID NO: 594266 - DNA, 342 bp, Homo sapiens
  misc_feature (17)..(17): n is a, c, g, or t
  misc_feature (182)..(182): n is a, c, g, or t
ttttttttaaaaccccncttaaattggggggggaaaattttttttggggggcttttaatggggaaaaaatttttttttttcgccccccccccggtttttttttaagggggaatttttttttcctttcttttttccccggggggggaaaagggggaaagcccgggttgttttttttggggganaattttttggggggttccggttccccgttggccccccccccccctttttcccttgtttttttttaaaaaggggggggttttccccttttttgggggtttaaaaggtttttttggggggggaccccctgcccccccccggggttccaattttaaaccctta

SEQ ID NO: 594267 - DNA, 291 bp, Homo sapiens
  misc_feature (280)..(281): n is a, c, g, or t
cgctgtcgtgactggaaaacaatggtggtggatcgtgtagcttggtcttactgtttcgtgtgtgacgcgcccctcccggtgtgccttctcccaggaggtctcctgaacctccgcctttggctttccctgtgagccgctttggttctggccaaacacctggtatgaagagctgctctcgagccagctcgggccatcgcaggccggtagcacgagagcaggaaagacctcccggagtgtccctccaggctccccttctccggtggcgtggtggggatcctcnntagagtcgac

SEQ ID NO: 594268 - DNA, 653 bp, Homo sapiens
cgtgcaaaaggtggcttcgtagagcagatttggttcagtagagccgtgtcaagtgccctattgcgagcgtggtaggcattgccagctgcgctccgtgctgtcctcgagttacgacaaaggacgatcgagctgcgttgctccgcacttgtccaagcagggaggaagaagcttaggcagggctctctgttccttcttgccttcagatgttctctcgccaggggctgggcttcaggagggagcatagaaggcaggtgagctaaccagttggctagagggaaacagggggcccaccagagctgtggagaggggacctctaagaactcctgcagggcacctgagctccatagcccatccgcccttagccgaagccaggagctgctcactacctcactcagggaatggccgattaggccaacgtcgttgccttgctgcactgagcttccccctcaccacaggccctttcctacaggcaaggtctggcctcaggtgggcacgcaggcgggaaaagcagcccttggccagaagtcaagcccagcacgtggagcctagagtgagggcctagaggtcatggctgcattgcccccatgctggcgccaacaacttctccatcctttctgcctctcaacataaactgctcgtaggcccagggtatt

SEQ ID NO: 594269 - DNA, 721 bp, Homo sapiens
ggacactgcagacttgtacaatgctcatacggtgttgtatagaaaatgttgaacgtcactactttgtcggaattttcgccatcttgatgaatagtgcccgagtaggtgatgagaatgcctctgcaacgaatgctcagtacgagcggtccatgcacgtgtcgtgactgtcctctactcaatacgtgctatgctactatgctatggtatgtcattattattcactgctgctgaagagggtctgatggccacgttgtgtgggtctgggagtgcgatggggcggcgcgaatgttgctctataacttttcttaatggtttttgtatgctagcccttcatagtgcactgagactatgtgactcggatggtcatttcagacggacacatttggactatttgccataagctaccatgagatcgtgatcttagacgggaattcatgcaaatgacggggtctaaacatggtcatagtgaccccgtccacgtcctccaaagctcacgaccttggagccccgtggagctggactgaggaggaggctgcacagcgggagagcagctggtccaagaccagccctgcagcccccactcagccggcagccagatggccccgaaggcctccagggatggccctagccacaggccctggctgaggtctctgggtcggtcagtgacatgtaggtaaggaagcactgaaaatagtgttcccagagcactttgcaactcccg

SEQ ID NO: 594270 - DNA, 309 bp, Homo sapiens
ctcaactgccagccctgatgatggtctcatctgcatgagtgagcaggccaggactgcccgtctccacctttgtgctggaccatttacaatcaaagcgcagcatcgagatacccaggaaagagccaggaacaggccaggaagctgctgccccaccactgaccccaccgctctccttccctccttccttcccgctgggctgggcacaggttgagctcaccgtcgtcccccttcatcccttggcccctccaaggctccaggactggaggccgactgggccgcagacatttcaccatcaccattatgctcagc

SEQ ID NO: 594271 - DNA, 479 bp, Homo sapiens
  misc_feature (187)..(187): n is a, c, g, or t
gtacagccgccgctccaagatgaatcccctgtggaacaccatggtcattggaggctatgctgacggagaaagcttcctcggttatgtggacatgcttggtgtagcttatgaagccccttcactggccactggttatggtgcatacttggctcagcctctgcttcgagaagttctagagaagcagccnagtgctgagtcagactgaggctcgggagcttgtggagcgctgcatgagagtgctgtactacagagatgcccgttcgtataaccggtttcaaattgccactgtgactgaaaagggtgtcgagatagaaggaccgctgtccgcacagaccaactgggacatcgctcacatgatcagtggctttgaatgaaatccagttgaatgtccagagtgttgaactttgctcttctaaacgtgactgtagctggctcaaaggccgacttttgtaaaataaatcagtcgtttgaagtgaaaa

SEQ ID NO: 594272 - DNA, 376 bp, Homo sapiens
  misc_feature (31)..(31): n is a, c, g, or t
  misc_feature (51)..(51): n is a, c, g, or t
  misc_feature (89)..(89): n is a, c, g, or t
  misc_feature (131)..(131): n is a, c, g, or t
  misc_feature (140)..(140): n is a, c, g, or t
  misc_feature (157)..(157): n is a, c, g, or t
  misc_feature (185)..(185): n is a, c, g, or t
  misc_feature (201)..(201): n is a, c, g, or t
  misc_feature (238)..(238): n is a, c, g, or t
  misc_feature (250)..(250): n is a, c, g, or t
  misc_feature (257)..(257): n is a, c, g, or t
  misc_feature (294)..(294): n is a, c, g, or t
  misc_feature (299)..(299): n is a, c, g, or t
  misc_feature (333)..(333): n is a, c, g, or t
  misc_feature (347)..(348): n is a, c, g, or t
gacgaggggattaatcaaaacctatgatganggattctttcttatagaganatttcaaatttttttctgtcacatgcctatggacacgngtatttgtgactaccgcaatctaagctcaaagtgtaagggtncttgaactnctgaggggatacacagnccgggtgcgggtctagagaatgggtggntttattccaggtcaancttatcttgagggtgcattcctttatggtgcccactnaaagtgggggtnggttatnaagggtctttgatctgatactttggtggcctcttatnttcgngggtatgcttttgatttggtgatgccaccgtgtngcttatattcatanngcctttttcctggtggcgacagttgggc

SEQ ID NO: 594273 - DNA, 1033 bp, Homo sapiens
gtcctgggagtagcaatgggaaaaaaacctcaatgattatcagacatcaatccagaatcatgagggcgtgcgtcacgttcgattaaatcctgagcaggccacccatgttgatcatggtggctcgtgatgatctaccgcattgaagattcctgctatacaacgagtcttttccttgcttccccaactactagactcgcactccggtgcaacgggtagacaacttcgaggctgtgggaaccccttgctcagtctgtggctactcagtatgctgcaagaaactgtgactcatagcaagtccctggccccgactcggggctcgcaagggtcgacgctgaatgctgcgctccaattgacacgtcccgtggtagtaggtaagcccgaaccttgctatctagtgttctggtcgtgctagagaagcatccaagagggaattatcctctgaaacggctgtgtcacgtgcaccactctgattgtgccgatgcaaggacacaagagctcgcctaatcctagccacctgtgacaagtttacttttcgtacgagaaaaccctcggaactgccctggccagcctcaattgaccacgccgatacaccacagatagaccaacctgtcgctggggttgacctgttgggaagacctgctcttgcaattgtcttgcctttgggtcctgtaaacctgtaacatctactcaaggttcttggtagagtcctgatcacccaggttgtacgtattaatgcgactaggttgtccgccttctgtcggtggtgaccctgcctcctcggtagtacggttcggtctccgcccgatcttgttccctgcgggcatcttccctgtgcttgtagcgttggcaccccagttcccctgaaggcctgggtcatgatccgactgtgagcttcccggggttggaagcgttgcccgtcgtgaatgtttgggaagggcccaagggttcttccaagaacgggaggatttgtggccccctttggttgaaccgggattggggcgctatttcgatggcagacctcgttttggccgtc

SEQ ID NO: 594274 - DNA, 138 bp, Homo sapiens
actagaccgacccctgtgcatgcatgtgagatctgtctcccgatcccctaaaaaagaaagaaagcactgagagaggaaagccaggacccactcagcgaacaacggacaggcaacacacaggtcgcacgccctggaggg

SEQ ID NO: 594275 - DNA, 122 bp, Homo sapiens
gggatttgaaagttgaattctcataatatatatatgtattacacattattatgaactagaagtatgttagaaatgattaagcagaaaaagaaaatttctattttaatgaacaaaatttttaa

SEQ ID NO: 594276 - DNA, 1181 bp, Homo sapiens
  misc_feature (1055)..(1055): n is a, c, g, or t
ggtttgccgccagaacacaggtgtcgtgaaaactatccccctaaatagtcctaaactggtaaaggacacagactcactatacaagcatatgtcgtcattggacacgatagatgtcggagacaaggtccaccatctactggtcgcaatcgtgactctataagagttgcgcgtgtgcattcgacgatagagaggaacccaattgcaagaagagtttcgcaggaaaggagagctgtcgtgaccgatggtgcaacagcggctccgttcaagtatggccgtgggctctatgagactaaaagctgaaagactgtaaggcgtgaaacgtgggtatctatccagtttgattatctcgcttgatggaagattcgaagaccatgcgaaagtagctagtgtgactagtcaatggatgccccatggacacgagagactttattcaaaaatcactgattacacggcacaatctcatggcctagacatgatgcatgatccctgatttgattctccttgcttgtgattgtgtgagttggaacacttttgcaacagccttggggtgaattctactcgaaacgaaataggcgccatgatcgcccggcagtagcacatgtccccgttcttggaacgtataacaacaacattgaggttggatgtaatactcaaccttacacttggttcctcttggtttgaaccataggaacatgtgactgtcgcaacctttgacgtgcgccagctgcccttagccaagtcgcccatggaaacgaaaggaattacttgtaggggcacccagttgtaggtttcaaacgcggacaaatgtatccgaagaaccaaacttgtaatccagctttacaagggaaaagacactatgtggatctgtaacgacaattcgcgccggagatgaaccaagatgaaggacaactgtaggttgcccaacattttacatggggctttcgcgaaactcgagttggaacaaacaaattagccttatgagacaggccgctaacaagtatggctgaaaccaatcgccccatatggcgtatacaacagcgggtgcaatccgaagnaactggttccaccccccagtacgacgcgaaatggaatcaagttggccaaagagcagagaaaacccaatcagcacttagacttacgaaggaggttacttcgagaacgttggcacttccctgaaacca

SEQ ID NO: 594277 - DNA, 503 bp, Homo sapiens
  misc_feature (24)..(24): n is a, c, g, or t
  misc_feature (38)..(38): n is a, c, g, or t
gcacaccaaggaagggagattgangcttgaaacatcgncccaccgtgtattatactaaactctgattcccgaatgtggaatataggagagcgtacctctcttgcgcgtctccttttttatcctacggtgcggggagattattaaaaaagcaatcgcgagatacccgatttcatgtaaattattcccattggacattcttctggttatatataccaacaactgcgtgtgtggcactttgagatttctttaaaaggataatgttataaaccctttaaagagcctttattgaaaggcttatgcaaatcaggattaaggatctttcttaaaaatgacctaccattaacgagaggcttcttggtatatttaaataaaaccttttaaaaaaacaaaaattgagttgctatagaatgcccaaatttacattttggtgggtaacaaatgaaactgcgccccccttaaaaaacccccgcaaaaaaaaaacagccatcttttgttttttttat

SEQ ID NO: 594278 - DNA, 230 bp, Homo sapiens
cgtcgctctagaggtcccggcacaccccgctacggaggcatcccagagcaactcagctttttcctcgtcatctgtcaggcttccaggtaagacttcatttgaagaaaaggtcctgcagtaaagatgttgagaagtgctgatatgcgctgcggttatatgaaagggtggaaggaggactggcacggtggctcactcctgtaaccccagctactccagaggccgtagcgggg

SEQ ID NO: 594279 - DNA, 218 bp, Homo sapiens
agaaacctatatcccgacaggacagaagtatgcattcctgctagtgactcccagaactccttctgcttctcagtactctatatccgacaccgctccaacatggcagtaaacgcaacgagaaatccaatctaggagctgctcctgcatctccctggctacgcatcgagtcgtgactaggaagcccgtgcggttcctacacgagtatgtccgaccaacaa

SEQ ID NO: 594280 - DNA, 305 bp, Homo sapiens
  misc_feature (120)..(120): n is a, c, g, or t
  misc_feature (182)..(182): n is a, c, g, or t
  misc_feature (190)..(190): n is a, c, g, or t
  misc_feature (196)..(196): n is a, c, g, or t
  misc_feature (202)..(202): n is a, c, g, or t
  misc_feature (204)..(205): n is a, c, g, or t
  misc_feature (209)..(209): n is a, c, g, or t
  misc_feature (212)..(212): n is a, c, g, or t
  misc_feature (214)..(214): n is a, c, g, or t
  misc_feature (218)..(219): n is a, c, g, or t
  misc_feature (221)..(221): n is a, c, g, or t
  misc_feature (230)..(231): n is a, c, g, or t
  misc_feature (243)..(243): n is a, c, g, or t
  misc_feature (250)..(250): n is a, c, g, or t
  misc_feature (269)..(270): n is a, c, g, or t
  misc_feature (273)..(273): n is a, c, g, or t
  misc_feature (276)..(276): n is a, c, g, or t
ggccgacttcccagcggcccgtgcggccgggcatgcccagtgcgggcgcagggcccggccctggaagcgccccggggagctggcccgcggtgggctaggggcaggccggagccgcggggnggagctgtggatccttcatgatgagagatttggggacacttctctctcctgtggtgtagttngataagtngggtgntcgaancnngatnggntngacnngntgtcaaaannccttttctccangggaccnttgcccaggagggaaatcnnaanganctccaatcctggggggtaattttggtacc

SEQ ID NO: 594281 - DNA, 486 bp, Homo sapiens
  misc_feature (71)..(71): n is a, c, g, or t
  misc_feature (307)..(307): n is a, c, g, or t
cacgaggccgaccggtcccgtcatgccgacccgcagtcccagcgtcgtgattagcgatgatgaaccaggtnatgacctagatttgttttgtatacctaatcattatgccgaggatttggaaaaagtgtttattcctcatggactgattatggacaggactgaaagacttgctcgagatgtcatgaaggagatgggaggccatcacattgtggccctctgtgtgctcaaggggggctataagttctttgctgacctgctggattacattaaagcactgaatagaaatagtgatagatccattcctatnactgtagattttatcagactgaagagctactgtaatgatcagtcaacgggggacaataaaagttattggtggagatgatctctcaactttaactggaaagaatgtcttgattgttgaagatataattgacactggtaaaacaatgcaaactttgctttccctggttaagcagtacagcc

SEQ ID NO: 594282 - DNA, 175 bp, Homo sapiens
cccccttagtacagaccatgacacctggaactcaagtcaccatggactatctctgctttgtgtagcatctccactatggtcaaaaggttatatcataatcaacactgtcatctcagggggtaagtatcttcactgagtaggagaagatcctgtgaaagttgaaggccagacaaac

SEQ ID NO: 594283 - DNA, 221 bp, Homo sapiens
gggatctgcggtagtttgtttgaaacagcaacgcttcggtcagggtatcttttaccagacactaaagcatatggagatagaatagaaagaatgcttcgcctcagtttgaacattgaccctgatgcaaaggtggaagaagagcccgaagaagaacctgaatttgacagcagaggacacttactagaagacacccgatctatacgaagatggagaaaggaatc

SEQ ID NO: 594284 - DNA, 138 bp, Homo sapiens
taatgcaggactactgctgtgtgggtggtgacccatcacgtactaggcgagatcaagtcggccctgttcggccatctcggccctgtctcgggctctgttctggctccaggtacgagtcgaatcgaatcatgcatactg

SEQ ID NO: 594285 - DNA, 139 bp, Homo sapiens
atccaggcggcctgagtgtaccagtgaggattatccaggtgccctgagagtaccagtgaggataatccaggggtccctgagtgtaccagtgagtataatccagggggccctttgagttgtaccagttgaggatacatcg

SEQ ID NO: 594286 - DNA, 194 bp, Homo sapiens
agctcggaccgcagtctgcgtccatcagcagacactaaagcatatggagatagaatagaaagaatgcttcgcctcagtttgaacattgaccctgatgcaaaggtggaagaagagcccgaagaagaacctgaatttgacagcagaggacacttactagaagacacccgatctatacgaagatggagaaaggaatc

SEQ ID NO: 594287 - DNA, 335 bp, Homo sapiens
tgatcagtcggtacctactctcggtgcctgtacctcaaacctgcaggtgctcagaaaatcctggcaatgccacctgtgccctgctgatcttggaggttaagacaacctccatactatttattgttgtcctcaccaacagttctcccagagactcctagttcaggttcccagcagattcagggaccatataaatgaaaactgggccctggagaggtgtggcatccaggtcagttctcaggaatcgataaatagatggaggttgtcttctcttctcagggcagcaactggctctcagcactaaaaacaaggcctcaaacccgcagtgcccgagagta

SEQ ID NO: 594288 - DNA, 129 bp, Homo sapiens
atgacagccgtcttaggcaacctaagaacaaatgtcaaagtacagatgcaggaccaaatgaattgcttggtattcattacttcatgtatatcaagcacagtagtaaaacaaaaacccatgtatttaact

SEQ ID NO: 594289 - DNA, 634 bp, Homo sapiens
gggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccccccccgcccctggggtaccatttgcatgggggtggggtcctcctgtgctatttgtacaaataaacctgaggcagg

SEQ ID NO: 594290 - DNA, 403 bp, Homo sapiens
  misc_feature (32)..(32): n is a, c, g, or t
  misc_feature (44)..(44): n is a, c, g, or t
  misc_feature (126)..(126): n is a, c, g, or t
  misc_feature (139)..(139): n is a, c, g, or t
  misc_feature (151)..(151): n is a, c, g, or t
  misc_feature (201)..(201): n is a, c, g, or t
  misc_feature (228)..(228): n is a, c, g, or t
  misc_feature (285)..(285): n is a, c, g, or t
  misc_feature (295)..(295): n is a, c, g, or t
  misc_feature (315)..(315): n is a, c, g, or t
catgagtgtggggcgcgctctcgcggtcctgntcggcggagtgnggcattcttcgggggtgcatcagagggagggcagagcctgaggatctaagcgaaggcgttcccgggtgtttcctgtgctgtntgtgaggagagancgaattcgcctnctgctctcaagcctctctggtcctggcttttggttggatgccggcgctgntgtctgtggcctcccgccttttggtgntaccccgagtcttgctgaccatgggctctggaagcccttcgagccagaccttggcgngctcggattncggctctggctacgttccgngctctggctctgtagactttggtacttggcccaacgagaaggtcgccaaggagatcgccagggccgcggtggaggcgcctatcagctg

SEQ ID NO: 594291 - DNA, 577 bp, Homo sapiens
  misc_feature (541)..(542): n is a, c, g, or t
  misc_feature (549)..(550): n is a, c, g, or t
gggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgagacagaagnntggtgcnncccccactctaccctggtacattgact

SEQ ID NO: 594292 - DNA, 831 bp, Homo sapiens
gggcgcttcgggagccgcggcttatggtgcagacatggccaagtccaagaaccacaccacacacaaccagtcccgaaaatggcacagaaatggtatcaagaaaccccgatcacaaagatacgaatctcttaaagggcgcgtgacgtgcactgaatcacatggacagtgtcttgtcttggttccaggtgcacagtcaaggcctctcatgtagttttatgctctagacttaggcgttctgcctgagcacagcctaactggccctacccagaagcctgcaattcctttttctaccctaccagacccataataaagctttccttggtctccacagtctgaagtgtaaccctctggtcagggtgtaacctgcctcctgcagggcaggttggctatctcccttgcttgtgcctctggcacttaggggtaccggagtggccttgtctcgatgtgcgtgctagtggcacattccctacacatgaccagccttatgacctccatctgacccattgctgtgagttggggtcagcttctctgacctgtgtcagggggttctaaggattagctgagaaggcttggaaggtctaggggagagctgagcatgtccccagtctgtaccttccctttacttttgctctctgttccgtggacgtgaatcacaaactctgagcctcagtttccccatatcccaccttggcttataagtcctcttggaccaagacttcggtatcgcaattgacaccttcttctaacagagggcgcagggggtgtccctgacgggatgtcaccgcacacacacttggtcgaacccctgctgtaagcagttgaaagccccag

SEQ ID NO: 594293 - DNA, 223 bp, Homo sapiens
  misc_feature (223)..(223): n is a, c, g, or t
gggcgcttcgggagccgcggcttatggtgcagacatggccaagtccaagaaccacaccacacacaaccagttccgaaaattggacaaaaatggtattaaggaaccccgattacaaaggtacggatcttttaagggggtgggacccaaggttcctagggacatgcgttttggcaagaaggacacacacaaaggggcccacgagggttcagggccacacttcccn

SEQ ID NO: 594294 - DNA, 155 bp, Homo sapiens
  misc_feature (20)..(21): n is a, c, g, or t
gctgcaggcgacctcgaggnncccacagaacatgacccaccagtcccgaaaatggcacagaaatggtatcaagaaaccccgatcacaaagataccatttctgtgccattttcgggactggttgtgtgtggtgtggttcttggactgggtcatgtt

SEQ ID NO: 594295 - DNA, 1021 bp, Homo sapiens
gggagtatggttgcaaagctgaggcatgagaatcacttgaacccaggaggcagaggttgcattgaacggagatcatgccgctgcactccagcctgggcaaacaggaagtgagactcttgtctcagaaacaaaaacaaaaagagatgttttgggggaacagggcacgggggggctcatggcttggtaatcccaaaggtggctgggttttaccaggtttgtgatcgccaccggaccaagcctggagttcctctttctctcttttaacctttaatttttggaaaacacccctggtcaagcacttgggtgggggacgcattttcggtgggctacattacactggatccaaaaacgctggagtgggattcttttcaacaaggatcttggaattttgcgggtttcccttccacacagtaaattattgtctcctgggcctccttgagatggtggactacgtttcggaacaacggggggtgggacttctaaataagaatcctgggggtctggaaattggggcgggtcgtcggcaatagacaggttcaacccgttgtgggtcacatataacctatttacctggggggacatagagttggtcctgaacgccaatccggggagcattccattggggagcaaaggtactactgaagaaggcttttaaaacccattgttattttgcgctagttttggaaccacggtcaacgccactttcttgtgggccttagagaaggacctttgaaggaaattaattgagcggcgttgccttaaaaaacttatggggttgcacggggtttccttcccccatcattcttatcataacaacattgggcagttgttatcaactggaccattgggcacgtggttacagcagctgttggccttccgtggggcaaaatcttgcctcttcttacaccccacttccgacaatttttggcacttggttcgacatcgcgggggaccccgataattgaaacttttcgccacctgccgacaggaggcgcaaaagagaagtcgtatcgcaacaggg

SEQ ID NO: 594296 - DNA, 186 bp, Homo sapiens
ttgcatatttgctttgtctttagacatagctgccacagcatcttcatagtttgcgaacacgacatctgcaacaccagttactctgccatcaggaccaatatacaatgtagtacactcacagggttgagcggagcaacaaaattataaatgtcatactcagtagctctgtaaaggtaatccccgcaa

SEQ ID NO: 594297 - DNA, 664 bp, Homo sapiens
  misc_feature (647)..(647): n is a, c, g, or t
gggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccccccccgcccctggggtaccatttgcatgggggtggggtcctcctgtgctatttgtacaaataaacctgaggcagggtttgttagcctntgtttatgattttggga

SEQ ID NO: 594298 - DNA, 835 bp, Homo sapiens
gggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccccccccgcccctggggtaccatttgcatgggggtggggtcctcctgtgctatttgtacaaataaacctgaggcaggaacacaaaattatgagaacacaaaaaaaacaaaaaaaccccggggcctctctttgaccggggcgcccaaaacgctcgctcatggacatgggcactgtgccagtacgtgtcccttggcccgggttttttgtcccacgtggaaatcgccggcccccaagggaggccattaattcgaaaccggttactgctaaattccacatgc

SEQ ID NO: 594299 - DNA, 492 bp, Homo sapiens
ataatagtagaccccattttggtgctgattttggtgagaattaacgaaagggaatatagagagagctgcctcttggctagatatatgctttaggacagtacctaggacacagaagtgctacgtaaaaggtacctctatccctgatactcaaaacgtgggcccagccatatatggcatccgttggaagcttgctagaaatgcaggatcggctgggcacaatggctcaaagtgctgtaatcccagcactttgggaggctgagatgggaggattgcttgagcccaggagttcgagaccagcctgcgcaacatgatgagaccctgtttctacagaaaaataaaaaattaaccaggcatggtgatgtgtacttgtggtcctagctactcgggaggctgaggtgggagaaacacctgagcccgggaagtcgaggctgcagtgagccatgatcatgccactgcactccaacctgggtgacacagtaggacctggtctca

SEQ ID NO: 594300 - DNA, 215 bp, Homo sapiens
  misc_feature (5)..(5): n is a, c, g, or t
  misc_feature (18)..(18): n is a, c, g, or t
  misc_feature (24)..(24): n is a, c, g, or t
  misc_feature (32)..(32): n is a, c, g, or t
  misc_feature (52)..(52): n is a, c, g, or t
  misc_feature (70)..(70): n is a, c, g, or t
  misc_feature (77)..(77): n is a, c, g, or t
  misc_feature (83)..(83): n is a, c, g, or t
  misc_feature (111)..(111): n is a, c, g, or t
  misc_feature (117)..(117): n is a, c, g, or t
  misc_feature (119)..(119): n is a, c, g, or t
  misc_feature (125)..(126): n is a, c, g, or t
  misc_feature (146)..(146): n is a, c, g, or t
  misc_feature (167)..(167): n is a, c, g, or t
  misc_feature (176)..(176): n is a, c, g, or t
acatnggctgtatgagangaaaangacctcangaaagcaacgaacggaacgnaagaacagaatgacgaangtcccgnggactncaacggccaatgttggtgctggcaaaangtgagntngagatnngatcacagccgaagagtaanggtgctgcaatgatgttagcngcggccacngcggatttttcgcaagaacattaataaactaaaaacttc

SEQ ID NO: 594301 - DNA, 271 bp, Homo sapiens
acgatctcacgtatattaatcttggttgtggtagcctgtttctaatactttgttactgtgctgtgaagatacagatttgaacatgtagtgtacgtgctatgggttgtggactggtgtgtcgtatgtaacagctgaccaacgtgaagatactggtacttgatagcctcttaaggaaaatttgcttccaaattttaagctggaaagtcactggaataactttaaaaaagaattacaatacatgggtttttagaatttcgttacatattacggg

SEQ ID NO: 594302 - DNA, 580 bp, Homo sapiens
  misc_feature (544)..(546): n is a, c, g, or t
  misc_feature (553)..(553): n is a, c, g, or t
gggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggannnggtcatnttctgtggtaccagctcgattctatcg

SEQ ID NO: 594303 - DNA, 631 bp, Homo sapiens
  misc_feature (20)..(21): n is a, c, g, or t
gctgcaggcgacctcgaggnncccacagaacatgacccagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccccccccgcccctggggtaccatttgcatgggggtggggtcctcctgtgctatttgtacaaataaacctgaggcagg

SEQ ID NO: 594304 - DNA, 150 bp, Homo sapiens
tttttctgtcagactgaatgttttatttcaacagccggccatggattacaaaaaaaacagtggaggtgggcagggtacgccattttatcacacgcgtcagagaacgtagccttccgccccagaactcagagccccttctgtcgtcttctc

SEQ ID NO: 594305 - DNA, 521 bp, Homo sapiens
gggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggcccagacaggggtctcagactcaagactggttcacgacggcatgtgcatcatcagaatgcgtgcagggtgacctaatcgtagatcggccgtggcactgattggtgttaccttgt

SEQ ID NO: 594306 - DNA, 111 bp, Homo sapiens
ggagagaactagtgctgtatcattgaccaaatcttctgcagtggctccttataaatactactagtgccaccttcttggcaaattattctatggcaggccttctgttacaag

SEQ ID NO: 594307 - DNA, 140 bp, Homo sapiens
agtgagtggtagaggcagaagtagaaaagagctctggctttcgattcaagcgattaagtgtcccgtttcactccttatcgtagtcgcttctgtgaacgtattacgttatccgtcaagagtccacgctcacaatgcagcca

SEQ ID NO: 594308 - DNA, 291 bp, Homo sapiens
atgttacctagcggaggaggagaccccatatctataacaacaactattactagatttattcggtcaccctgaagattatatatacttatcctaccaggcttcggaataatctcacatatagtaaacattactactccggaaaaaaagaaccatttggatacataggtatggtctgagctatgatatcaataggattacctagggcttatcgagtgagcacaccatatatatacagtaggaatagaccgtaaacacacgaacatatatcaaccccgatagcccgctagggga

SEQ ID NO: 594309 - DNA, 104 bp, Homo sapiens
  misc_feature (1)..(1): n is a, c, g, or t
nccggccatatgccatccagcatccatcacagtggtgcactcgtggcaatgtcccacgggtccgcagctcgcaattcgtcaatccatggtccatcagctgcttt

SEQ ID NO: 594310 - DNA, 84 bp, Homo sapiens
tcgaggcccctcttccttggggggggccttccggcacattggtccacaccccacttctcaccaacagggccggttcgagccggg

SEQ ID NO: 594311 - DNA, 207 bp, Homo sapiens
  misc_feature (11)..(11): n is a, c, g, or t
ctgagactcancggaactttctaaagatgaaactgggctgggcacagtggctcagcctgtaattccaacactttgagaggctaaggtgggaggatcgcttgaggccaggagtttaagaccagccccagcaaaacagcgagacttcgtcttgacaaaaataaattttttttttttttttttttttttttttttttttttttaaacccc

SEQ ID NO: 594312 - DNA, 798 bp, Homo sapiens
  misc_feature (41)..(41): n is a, c, g, or t
  misc_feature (71)..(71): n is a, c, g, or t
  misc_feature (77)..(77): n is a, c, g, or t
  misc_feature (112)..(112): n is a, c, g, or t
  misc_feature (159)..(159): n is a, c, g, or t
  misc_feature (190)..(190): n is a, c, g, or t
  misc_feature (216)..(216): n is a, c, g, or t
  misc_feature (223)..(223): n is a, c, g, or t
  misc_feature (230)..(230): n is a, c, g, or t
  misc_feature (232)..(232): n is a, c, g, or t
  misc_feature (237)..(237): n is a, c, g, or t
  misc_feature (258)..(258): n is a, c, g, or t
  misc_feature (300)..(300): n is a, c, g, or t
  misc_feature (320)..(320): n is a, c, g, or t
  misc_feature (329)..(329): n is a, c, g, or t
  misc_feature (359)..(359): n is a, c, g, or t
  misc_feature (400)..(400): n is a, c, g, or t
  misc_feature (446)..(446): n is a, c, g, or t
  misc_feature (466)..(466): n is a, c, g, or t
  misc_feature (505)..(505): n is a, c, g, or t
  misc_feature (595)..(595): n is a, c, g, or t
  misc_feature (606)..(606): n is a, c, g, or t
  misc_feature (620)..(620): n is a, c, g, or t
  misc_feature (623)..(623): n is a, c, g, or t
  misc_feature (626)..(626): n is a, c, g, or t
  misc_feature (630)..(630): n is a, c, g, or t
  misc_feature (635)..(635): n is a, c, g, or t
  misc_feature (645)..(645): n is a, c, g, or t
  misc_feature (658)..(659): n is a, c, g, or t
  misc_feature (714)..(714): n is a, c, g, or t
  misc_feature (716)..(716): n is a, c, g, or t
  misc_feature (722)..(722): n is a, c, g, or t
  misc_feature (734)..(734): n is a, c, g, or t
  misc_feature (769)..(769): n is a, c, g, or t
tgactgtattggaaggcaatatatctgttgcttcaactacncccagaaacctgcagacactaagataacanacatcnagagacgaacggcgctcctgcacctgcatgaagcnagatgcggagccacaatgcatgcgcgaaggacacggagcatcaatcnagaagaaaaatgatcaaagaacagctgagtnacagtttggggccatcccaggcaagngggctcntggtgcncnggtgnagccaggaacccatacaagcngggctggcctaggaagcccacgcagccagcctgtgttcagcnacagcttctgtgtacttatntaccatcancagccacagcccttgggagcgaagccctanacgcctccttcaagccccctgctggttggatacatcattanctcgcctcttccaaatctgaatgttagcctctgacagtgtgatcanctggggacaggcatggcagncacctggaggtcttgtaattcatagcgcatgttggcgcngtcccatgatgacagcagcgtggatccggtagcgcagccctcggagcggcttggccgtacatcgcacagatagttgggcaaatgagagtncatagagtggntatttcttgtagtnctngcntggnacttncttacagaanaagtatttctctnnagattccacattttgttattaggggaaatttgacaaataggttgggattctgtcncnaacaanagaaagtttgtntcttgagtggaatctctttgataacaaaaagattnagatcatgggagggcaacttgggttaagc

SEQ ID NO: 594313 - DNA, 106 bp, Homo sapiens
gcctcagctgcctagggcgtgactgtacgatggcatggctgtggcgacagggtctgggataagcttactcaaagatctaggaactaaaccgccagtaagcaatacc

SEQ ID NO: 594314 - DNA, 379 bp, Homo sapiens
acctcctaccccacgcaaggaagagaatacagtcatgggttcttagtttctctttctggttgggccagtaaagccccttcctcatccctcttttccacttatcactagagacagaaactaaaaaccacggcttcagaatgccaaaacctaaaacaaacaaaacagaacaacaacaacaaaataaggcaggctggacaagcttgcaacccttcaagatgattgttttcacggatttaaagaaatgggatagcactttggggggctgaagcaggcagatcacctgaggtcaggggttcgagaccagcctggcaaacatggtgaaatcccgtctccactaaaaatacaaaaattagccaggcgggtggcaaacacctgtaat

SEQ ID NO: 594315 - DNA, 983 bp, Homo sapiens
  misc_feature (493)..(493): n is a, c, g, or t
  misc_feature (495)..(497): n is a, c, g, or t
  misc_feature (500)..(500): n is a, c, g, or t
  misc_feature (508)..(508): n is a, c, g, or t
  misc_feature (536)..(536): n is a, c, g, or t
  misc_feature (539)..(539): n is a, c, g, or t
  misc_feature (543)..(544): n is a, c, g, or t
  misc_feature (547)..(547): n is a, c, g, or t
  misc_feature (552)..(552): n is a, c, g, or t
  misc_feature (562)..(562): n is a, c, g, or t
  misc_feature (569)..(569): n is a, c, g, or t
  misc_feature (587)..(588): n is a, c, g, or t
  misc_feature (592)..(592): n is a, c, g, or t
  misc_feature (595)..(595): n is a, c, g, or t
  misc_feature (597)..(597): n is a, c, g, or t
  misc_feature (609)..(609): n is a, c, g, or t
  misc_feature (639)..(640): n is a, c, g, or t
  misc_feature (656)..(657): n is a, c, g, or t
  misc_feature (717)..(717): n is a, c, g, or t
  misc_feature (841)..(841): n is a, c, g, or t
  misc_feature (849)..(849): n is a, c, g, or t
  misc_feature (859)..(859): n is a, c, g, or t
ctctgggccctgtgttttcccgagcaccttttctgactctggtctggattacatgtgtcggtatgtggcacttgtccccttttgcccttggtatatgcgacccttctattgtattgcgccctttgtgcccgcactttccggtccatgtcggggatgatggatcccccttcccctttgctcagttgcctcctggggccaggggcccctcaccacaaggggtctggatatacagtttcataaggcctggccctcccatgtttgcatgcctatgtacttctacgccaaacgtgtcagcccttcctcctgaagctctctgccgtgcctccctgttctgggaggacggtggtgcggtgtgactgaatttgggcctcttgtacagttaactctcccaggtggattttgtggaggtgagtaaaaggggcattgagactataaagcagtagacaatccccacataccatctgtagagttggaactgcattctttcaaagtntnnntangcatatanttgtagggctgtagacttacggtcctantantctnnttnccatngcttattctngagcacnaaagtgataatcaattannacanttnanacatcacctttnttgacttgttccaagcccttttacagctcnntggcattttcctcgcnnaggcctgtgaggtaactgggatcgcaccttttataccagagacctgaggcagatgaaatntatttccatctaggactagaaaaacttgggtctcttaccgcgagactgagaggcagaagtcagcccgaatgcctgtcagtttcatggaggggaaacgcaaaacctgcagttcctgagtaccttntacaggcncggcccagcntaggcccggggtggcaacaccacagcaagccggccccccctcttttggccttgtggataagggagagttgaccgttttcatcctgcctccgttattgtaacttggaggtttacacgggtgcgtt

SEQ ID NO: 594316 - DNA, 166 bp, Homo sapiens
ttgtttttttgtggctgcagtaacaaatttcgacagatttggtagcttaaaacaacagaaatttattgtcttacagttctggaggccagaagtctgaaatcaaggtgtcagcgaggttgacaccctccgaggtgccgatgaatagcgaggtgccgatgaatagcga

SEQ ID NO: 594317 - DNA, 91 bp, Homo sapiens
  misc_feature (51)..(51): n is a, c, g, or t
tggctagtgccacgaggtttacttgactgttgtttgaaaagctgataaganaaccatccagaaaaaagctcttcgttttacaaacatgaga

SEQ ID NO: 594318 - DNA, 871 bp, Homo sapiens
gtaggcagccatgcgcccagcctggaatggcatggtcttgaagccccacttccacaaggactggcagcggcgcgtggccacgtggttcaaccagccggcccggaagatccgcagacgtaaggcccggcaagccaaggcgcgcccgcatcgctccgcgccccgcgtcgggtcccatccgggcccatcgtgcgctgccccacggttcgtgtaccaacacgaaggtgcgctgcccggccgcggtttccaggcctggaagggagccttcaggggtggccgggcatttcacaagaagggtggccccgtgaccatcggccattttcgtgtggaatccgaggaaggcgggaacaagtccacgggagtcccttgcatggcccaacggtgcaggcgggctgaatgggagtaaccgcttccaaactcatcctcttccccaggaaagccctcgggccccccaaaaaatgcgacgaccagtttctggctgaagaactgaaactgagcccacccagctgaccggacccggtcatgccccggtccggaagcggtctatacggacggcagaaaagggctcgagttcatcacctgagggacagagaagaattttcaggaaggccttatcggcataaatctcccgtatattggccccggtggccaaacggccccgggcatcttatccggcataacgggggcaaaaaagagcccaggaatagtccgaagaaacagggctgtttgtacacgaaaaaaaataaaggcccctcctgtgggactatgggaactacaggacgggagaacacatgcctggactctcaccggttgtggtttttcgtgtggaaccaacttggctggagtcggcgtaccagctgtagatccccagcag

SEQ ID NO: 594319 - DNA, 342 bp, Homo sapiens
ccttggacttacctggagtggctggcgtgatggggtgatcgccggtgaccatatgacttgatgctgcgctgcgacacttgccacctggtcaggcacggctgccgggatggtcgatcatggacataggcccacaaagcagaggttgtccgtggtgaagttcacgtcatcacagtcgaaggcaaagcccttggggaactgctcctcgggcagggtaataatggcagaaaccaagcactgcgcttcgcccaggccaccgagctcaaggtaggcattctggaaggcctccttcatttcctcgtccagaggctgctccttgccctgtagcagggatggtggagcagc

SEQ ID NO: 594320 - DNA, 797 bp, Homo sapiens
gctccggggctgcggctgtaactgcagcagctgccggcgcaccggcgccgcctgcctgcccttctactccgccgctggctctatcccgtcgggcgtctcgggccgccgccgcctgctgctgctgctcggggccgccgcggccgctgcctcccagacgcgtggcctccagaccgggcctgtgcctcccgggaggctggcgggggcctcccgctgtggccacctctgcctgcggccgctggcgccctgcgtcctaccctgccctccgtgcctctctgctgccgcagtcgctggcgggggcgggccggccggtccggaggcgcacgttacggcacagagatgtccaaaaatagtttaatctggaagatcttcaccagcaccccgcctgagtatgaattggccccgtccaacgttagaagaggaagtgtgatgatgtctttctcattcgagtctcaaaggagctgaccctggtcatgcactatggaagatgtgcttaacttttctttccagactgcagaatccgcaacggtgagaatggaatacattttctcctaaacagagatgggaaaacgaaaggggtgatgccttcacttgcaacactggagtcacacgcagggactgtgcagacaagcccttatcacgaaccaccgcatgttacctgggcccagccgcatgtggcaactatatgacgattagacatgcacgaattgcctgccccaccgaaacacttgcaggccactcccccctgggtacactcaggccgcccgcccgccagcgccccccaagtcaccgcaaagacc

SEQ ID NO: 594321 - DNA, 780 bp, Homo sapiens
gctatcatatagtaaaacccagcccatgagccctaacaggggccctctcagccctcctaatgacctccggcctagaccatgtgatttcgacttaccacatcgcataacgctcctcatactaggcctacgtaaccaacacatctaaccatatacgcaatgatggcgcgatgtaagcagcgagaaagctagcgatagccgaaggacgagccacgacaggcaccgtgtccaaaaagggctgtcgatgacgggataatcctattgattacctcagaagattttgtttcttcgcaggattgtttctgagaccttttaccagctccagcctagcgccctaccccccaattagggagggcactgggcccccaacaggcatcaccccgcgtaagatcccctagaagtcccatgtcctaaacacatccgtattactcgcatcaggagtatcaatcagctgagctcaccatagtctaatagaaagacaaccgaaagcaaataattcaagcatctgcttattacaacttttactgggtcgtctgattttatcctcctacaagcctcagaggacttcgagtctcccttgcaacagtttgcgcgaggcatctacgggtcaacattttatgtagccacaggcttccacggacttcacgtcatggatgggctcaacttgcctcactatctgcttcatccgcaactaatatttcactttacatccaaacatcaggtttggcttcgaagccgcggctgatactggcatttgtagatgtggtggactatatctgtatg

SEQ ID NO: 594322 - DNA, 956 bp, Homo sapiens
  misc_feature (683)..(683): n is a, c, g, or t
ggcggtggcctgcgagaatcgaggcactcgcttggtgtacccatgtatcgaacatgatgttcacggcctggtaccgggggatgtcggtggtctacgggatcggcacctggtctggtgttgggctcacgtgcttaactatagccggaccaatggcgaagtcgtcagtagaccaaagggatggctcagcaggtgaatgtacccagtgaacctctctgaacgcccaaagggatttcatgtggaaacagttgtcacatataacgaagatttggttccaaatacagaaaagatcctcaactatgtggaaatcatggacctggttggccctggtacagaaccatgactgggctgctgaattctgaaaaccaggcacttggtccaccatttaaattggatagtggccctgattcccattgtgggttggtgacacaagtgtatgtcattaaattggctgtaaaactataatcagtattaatatgcaataaatatttctggaagacaaaaaaaaaaaaaccaaaaaaaaaaatttgtgggggctcgggccttggaggagttttaaacccatcgggtgtgggcacggggaccaagtggcaaaggcacagtggcaaacggggtccaaagagaaccccgggcaagcacagggggggctccccccaaaaaaacgccggggacacgggcgtttaacnacccaagggagtccggcggcacaaggggggacaacaacgggggccggggtccatcaacagcgccccgcggctgcggaagtgacaaacaacaaacgcaacagacaaagaacaaaccaaaaaacacagaaaacgaagcaagaagagacaagagaaaaaacataaagagccaacacaagcccacaaccacagacacagcagccaacacagcgaaaccaacaaaaaacacagcaccgcacacaagagcgcaagacaagagaccacagagccgaacag

SEQ ID NO: 594323 - DNA, 421 bp, Homo sapiens
  misc_feature (174)..(174): n is a, c, g, or t
agactttcaccacctactctgacaaccagcctggtgtactcattcaggtgtatgaaggtgaaagggccatgaccaaggacaacaacctgcttggaaagttcgagctcacaggcatccctccagcaccccgtgggtccctcagattgaggttacttttgacatcgatgccaatgnatccgtcaatgtttctgctgtagataagagcacaggaaaggagaacaagatcaccatcaccaatgacaagggcccgcttgagtaaggaagatattgagcgcatggtccaagaagcctgagaagtacaaggctgaggatgagaagcagagagataaggtttcctccaagaactcactggagtcctatgccttcaacatgaaagcaactgtggaagatgagaaacttcaaggcaagatcaatgatgagg

SEQ ID NO: 594324 - DNA, 182 bp, Homo sapiens
taccctagctgtgcttctgtaccctagctgtgcttctgtaccctagctgtgcttctgaccctagctgggactacagatgcacgccaccatgcctgtcaagactttttgtacttttagtagagacagggtttcgccatgttggccaggctagtctggagctcctgacctcggtgatccacccg

SEQ ID NO: 594325 - DNA, 468 bp, Homo sapiens
gaccaactgcacactgttagcagtcctcaattttcccctccaccttagctcctggcaacaatatctgctttctgatatctatagagtttgactactttagtaacttgatataagtagaattaagcagtattttgtccttctggtgagcgatgtatatcacttaacataatgtcctcaagggtcatctaaattgtcccatactgcaggattttcttatttctttttttttttgggggctgaataatatcccatggcttgtattgtcccacattttcttcattcttctgtcagtgaacgttaagttgtctctacatctggggtatggggaataacttcgatgaccatgggagtgctaatatctcttggccaacaggactttttaaaatattaaagtggctagggtgaagaatattaatttatcacaccatagtaagcatattatgtacaccttctgagttatcctccggg

SEQ ID NO: 594326 - DNA, 132 bp, Homo sapiens
cgcatcttattaatctggtggggtttttattctttttatgagacagattctgctctgtcgcccaggcttgagtgcagtggtgtgatctcggccactgcaacctccgcctcccgggtccatctgacccatctt

SEQ ID NO: 594327 - DNA, 258 bp, Homo sapiens
attagttccctcagggaggtgtgggggtaagggagggaagtcccctcaaaaaagggaaaaccccggaatgtgtgttaagcccaaaaatggcatttgcagttaattagcccatgtgagggttaaacaggtaggggaatgcaagctcaaggtttggaaaaaagacttttcagttatgtttttgggatcaaacaaacgaaaggtctctttgtagtttgggttaatggaacattaataaattttttgattcccttgctttta

SEQ ID NO: 594328 - DNA, 101 bp, Homo sapiens
aaaaaaaaatttgggaggggtggggttccctttggggggagggtttggggttttgaaaaatttttttttccccccctggtccattaaccgggtttttttga

SEQ ID NO: 594329 - DNA, 237 bp, Homo sapiens
  misc_feature (2)..(2): n is a, c, g, or t
  misc_feature (78)..(78): n is a, c, g, or t
gngacagggtctcactttgtcgcccaggctggatgtagtggcagaatcatggctcactgcagccttgactgcccaggnccaagccatcctcccacctcagcctcccaagtggctgggactacaggcttgcaccaccacaccaaggtgaagtgttgttttgtttgttttttgtagagacagttttgccatgttgcccaggcagtgatcctcctgcttcagcccccacaaggtgttggg

SEQ ID NO: 594330 - DNA, 399 bp, Homo sapiens
ggaagtataatctctaacagatggacaaagttaccagatgccttaaactctgtaacacttaaaggaagtgaaaacttagtagtatgataggttatttagatgtaaagatgttctggataccattatatgttccccctgtagcagaggctcagattgtaatatgtaaatggtcatgtcattcgctcacatcatgcatttaatttgaaatatggtctataggtaatgattcactaagcagcacagctgagaggcatgtcggttgtatacattgtggtcattgcaccataaagaaacattgtagcctcaatcgagtgagccagactagaagttcctagtgatggcttatgatagcaaatggactcatgtcaaatatttagatgtaattatgagtaagacata

SEQ ID NO: 594331 - DNA, 101 bp, Homo sapiens
gtagccacaaggacggcacactgctttggagtgattccgtgtttcctctcgtaccatgtgatccttgagtttggaaagatggctcagctccttggcagcag

SEQ ID NO: 594332 - DNA, 159 bp, Homo sapiens
  misc_feature (69)..(69): n is a, c, g, or t
atactcaatgcatctgcgttttcttcagcaaatccatacttatacaagattacctataaatctgtcccncaaacgtctaagacatattcagtaattaaaaataagtctgattaagatgctttacccggatacatgaatgaactccggggggatatgctt

SEQ ID NO: 594333 - DNA, 920 bp, Homo sapiens
  misc_feature (9)..(9): n is a, c, g, or t
  misc_feature (18)..(18): n is a, c, g, or t
  misc_feature (61)..(61): n is a, c, g, or t
  misc_feature (95)..(95): n is a, c, g, or t
  misc_feature (115)..(115): n is a, c, g, or t
  misc_feature (141)..(141): n is a, c, g, or t
  misc_feature (149)..(149): n is a, c, g, or t
  misc_feature (184)..(184): n is a, c, g, or t
  misc_feature (206)..(206): n is a, c, g, or t
  misc_feature (217)..(217): n is a, c, g, or t
  misc_feature (222)..(222): n is a, c, g, or t
  misc_feature (243)..(243): n is a, c, g, or t
  misc_feature (245)..(245): n is a, c, g, or t
  misc_feature (253)..(253): n is a, c, g, or t
  misc_feature (255)..(255): n is a, c, g, or t
  misc_feature (257)..(257): n is a, c, g, or t
  misc_feature (268)..(268): n is a, c, g, or t
  misc_feature (276)..(276): n is a, c, g, or t
  misc_feature (307)..(307): n is a, c, g, or t
  misc_feature (319)..(319): n is a, c, g, or t
  misc_feature (324)..(324): n is a, c, g, or t
  misc_feature (336)..(336): n is a, c, g, or t
  misc_feature (338)..(338): n is a, c, g, or t
  misc_feature (374)..(374): n is a, c, g, or t
  misc_feature (438)..(438): n is a, c, g, or t
  misc_feature (450)..(450): n is a, c, g, or t
  misc_feature (454)..(454): n is a, c, g, or t
  misc_feature (456)..(456): n is a, c, g, or t
  misc_feature (475)..(475): n is a, c, g, or t
  misc_feature (508)..(508): n is a, c, g, or t
  misc_feature (515)..(515): n is a, c, g, or t
  misc_feature (525)..(525): n is a, c, g, or t
  misc_feature (535)..(535): n is a, c, g, or t
  misc_feature (612)..(612): n is a, c, g, or t
  misc_feature (632)..(632): n is a, c, g, or t
  misc_feature (655)..(655): n is a, c, g, or t
  misc_feature (684)..(684): n is a, c, g, or t
  misc_feature (726)..(726): n is a, c, g, or t
  misc_feature (774)..(774): n is a, c, g, or t
  misc_feature (783)..(783): n is a, c, g, or t
  misc_feature (793)..(793): n is a, c, g, or t
  misc_feature (800)..(800): n is a, c, g, or t
  misc_feature (815)..(815): n is a, c, g, or t
  misc_feature (825)..(825): n is a, c, g, or t
  misc_feature (835)..(835): n is a, c, g, or t
  misc_feature (837)..(837): n is a, c, g, or t
  misc_feature (851)..(851): n is a, c, g, or t
  misc_feature (914)..(914): n is a, c, g, or t
tgagtggcngcgcctttntttgtgggggccttcaaggtagggtcgtggggggcagcggggnggaagagccgagaaactgtgtgaccggggcctcnggtggtgggcattgggggcncctcttgcagatgcccattggcatcnccggtgcngccattggtggcagcgggtaccgcgtcctttcttnttcaacatagggtaggtggcanccacgggtccnactcncttgaggctgggccctgggcncnccattttntntnccaggagcatntggttctntggcgggagccccacgcaggccctgaggatnttctcgatgcanccgcnctggcggaaaancncattgaccaccgggctgccgggcggcacttgtggcnccttgaagaggaagctgagcagggacagcccggggtggaaggtctgcggctcggggtccatttnagttcagaagcncacncnctggcacactcggtcagcngccctaggtccagcatgatgggtgcggccagcngccagtnctcacacgtnttgtgcagcnccagttttttggttccgcccagcatcagctccgaggtatactcatccagcgcgcgctttctgttacccacgttcggnacaaacttgatgaccacgcngtaggggctcttcgccgggcgtntagagcactgggttgctctgcaccatgtngtccaccacgttgctcttggacacctccttagagcggaactncaatggcgccgataggttctccccatcgttgttgcccaggtggttgtnactcacganggacaaggtnttgaggncggagccaattaggnagttcacaancacggacttnantttggtctggcctnatttgaagttatctccgcccacaaaaacccggtgctgccacgcgagcccaagaaccccgggcncagggt

SEQ ID NO: 594334 - DNA, 96 bp, Homo sapiens
gttttttgtttttgggtttttttttaaagacaaagaagtggccctttgccctttcctcccttttgagggcttgatccttttccaggaaaaaggggc

SEQ ID NO: 594335 - DNA, 430 bp, Homo sapiens
tacacacgactaaatagcacttgattattaaatacatccataacctaaacaagatatgttgatacatctatataatcctcatggctcagcacagggcctgacatacataggcatacagccaatataagatctccaaagcatgaccattcatgcatccataatccttttactatagtataaagatggctagacattcaggcccccatgtatatatcaacggaatataataatccccaataagctactaactatttaaaaggtgattaacagttctagtgtacaatttcaaaatcaaaatgacaccatatcaggtgtcacatccaaaagacaaatgccaaaccatatttgcctacacaccagtgccttaccccatatacttacatcaataatctgtccataatgaaagccatggtcaccaacagaaatacac

SEQ ID NO: 594336 - DNA, 156 bp, Homo sapiens
ccaggtcaggtcacaggatagcatcctcaccaataaaactgggtttgttgtactgatgacgctagtattaccagcaacgctctgacacatccccaccgaacgtgcgaatcgcctgcgtttaacatgcctgaaaatctggcctgctttttcccgtgg

SEQ ID NO: 594337 - DNA, 118 bp, Homo sapiens
ctccgtttattcactgccctgatctctacgcgttgcttctgctcttcgctctgtaggattctggattggtgccaatgataatctcaatgacacctcccttagctactcaggaggccgg

SEQ ID NO: 594338 - DNA, 827 bp, Homo sapiens
gtcctgggggagaagattaacatcctgtctgggagagactgtacaaagctgggtgacagggacccgctgggtgaactgactgtccctgagcaagataggctcccccagacgctcctgtgagtgcagaagtgtgcctcctacgtgtttgtgccctgatgtgccctggagcttcatgtgcctcactcacacctgtgtggccctgtggcaagtgcccttgcctacagatcccacttgtgtcctggatcccagtgctcttgtgttgggtttgttgcctgtgtgcttgtcctgtgctgtgcacggtggccggtaattttgtgtcaacacttactatgactatttccaatgggcatttgaccacaaaaagagtgatagacagtgacactatgtggaccgaatcttgtgagcctgcaggatgtcgtccggttcggagtcttcctctacacgttgggctgcgtcttgtgcctgcttgcctctactacctgtcccctctgaaacttggagcacttggctcttatctactttggaggcctgtctggctccttttctctagcacaggagtcctcatactagccacctgaaggcaagagtcgcccaacattcatgtgagccagccaggtgcgtcaagcgtcccaagaaaagttgcatagatgaaacttgtctatcctaagagcttggactccctgagaaatggggcttgggcacacttacggaaggggagcgaaggtgagcccatatcctgcttcggggtgggagggcattggacgctgaccattgatgctggtccagaccaggataccacgcacgggtcaggagatgtggtcgaatgc

SEQ ID NO: 594339 - DNA, 389 bp, Homo sapiens
tattaccaaccatttagacatcctttaggatagtacgtccattattcttgtaccattctgtaaccgggaaccattgcaaccatttaaaaaagtctgggttcccatgactcatctcattgcaacctttgcatccctggcctttgacccctggttctctgaaccctagtcacttctttctttttgagacgctctcgctctgtcacccagtctgaagtccagtggcgcgttcttggctcattgcaacctgtgcctcctgagttcaaccgattctcctacctcagcctccagagtagctggcactataggcgtgcaccaccatgcgcggctaatttgtgtatttatagtagagatagggtctcctcatgttgcacagtatggtctcgatctcc

SEQ ID NO: 594340 - DNA, 113 bp, Homo sapiens
ggtcagtgctgcattagacgtgaactatctgatgattcttccctccagaagatttggcattgtgtcttggaatgctcaatgtcaaatggggaccggattgccctgctagcaat

SEQ ID NO: 594341 - DNA, 306 bp, Homo sapiens
ctagatgaccatgttctcatccactctattctgactgtgaatcactttctcttcggcaccgatcagccccccatcctgctctcccactccagagccttcgctctcaggcagggctgggaaggggtggaaggggtggaacggcgggatctccacactctgctcagagctcacccgcacgtgcacaggggtctctgagacagaggcagtgaactggaccatatctgcacgctgctcctgaaggagctcaccaatttcctctagaattgcttgagctacataagtgactctcgagagcagagagaggct

SEQ ID NO: 594342 - DNA, 293 bp, Homo sapiens
agctataactagtgaacactatcacgcaaaagagtcaacctctctatactaatctaccctacaaatctcctataattataacattcacagacacagagactaatcatatttcatatcttcttcgaaaccacacttatccccaccctggctatgatcacccgatgagggaaggagaccagaacgccatgaccgcaggcacgtacttcctattctactccctccttaggctccctttccctcttcttcgcgctgtgattacactctcaaacaaccccagacctagttatgtgcgt

SEQ ID NO: 594343 - DNA, 871 bp, Homo sapiens
cttttgttgccccctaagtacaaaaaccttctccctccccctgtttatttggcgcccccccctaagtcccataatttggcaaattgtggcggacaccacaacaccagaatttttcttacaagggaaaccaccctttccgaaaatgtttttctccttagtgaacccaccataactgataagtactaatgcccccataagggccttcccccaaaacaacaatgtctcaagtgagtggaaatgcactactaagtctacccaactcttcaaacggcacatttatgtacactgtatacaccaaacacgcacgactcccctttttagtttatatcaagagcccacaagatcccccctttaaaatttagctttagctaaatctacaagaggagttgttgtcatcaccccgcaccaccaattctctccccccaccctccaaaagcacttttcacgcactttatgtatgactaaattccacagtatatgttttttccttatcaagagtattaaaaacgagccaccacttttattccggtaatacaacaatcccaccgtattaactgtgtttagaagagaaacacaacaaatatatggtagcaccttagaatccccatataggacatcttataaagattcttaatacaagataacataccacttctatagaatcttgtacaaaatcaggatatttctaccttataaacagaccctttgagttcactacctaccaccatgaacgcacccggtacttccactcatttcttgaagtgagaatggtccttgagtatgatgtgtcacccacaaccacctacaacacttgtttccttcccttcttcaacaaaaaaaaaccttttagaaacgaacacaacataacaca

SEQ ID NO: 594344 - DNA, 149 bp, Homo sapiens
gtcgagagaaattaggatagttaagagagctgcctataggctggagggagaggcttaggcagaatgccctattagctttgcaaggggccctgtcaggaagtcgctgggggctcgagagaggcttcttaggttcggtggcttggggaagt

SEQ ID NO: 594345 - DNA, 439 bp, Homo sapiens
  misc_feature (6)..(6): n is a, c, g, or t
  misc_feature (179)..(179): n is a, c, g, or t
cctacnaaaccacaaaaccccttgccaaatgtccattgaataaattgtaccccttgagacccctgaacccaagagttttagatatgtaagttagaaacagtagatacctaggtgtaagtcggtgccaaaagtaattgtggtttttgacattgaaaagtagtggccagctgggtgccagntgtcacgccctgtaatccccagcactttgggaggcccaaggtgggcggatcatctgaggtcgagttcgagaccagcctgaccaacatggagaaaccccctctctgctaaaaatacaaaattagctgggcgtggtggcagatgcctgtagtcccatctacacgggaggctgaggcaggagaatcacttgaaccagggaggcagcggttgcagtgagcggagatcgcaccactgcactccagcctgacaacagagcgcgact

SEQ ID NO: 594346 - DNA, 609 bp, Homo sapiens
tcccttatttttcgctatttttcttatttttattttttgtttttcttctcttcattcatctccctcatttatcgttgtattttatggtgctttttttgctattttatcatgtttgtttttatctattggtttttctcttcttctttatgtattcttttttattttctctattgggtgttcccctagtttataattttttttttgtgatctttactgtgtctctgtaagtgtgtattgtttcgtatctctgtagctctgttttgtttttcttcgttggtttttaatatgtgtttgtacttgtctttttaatgtttctctttctcccttgtatgtttgtgtttcatgtcctccgtcatattgcttatcttgtcgctccctcttgcaatcaacatgtgcatcttcaagtgatccacccttcccttgtgggcgaactcctgatgaacgcaacatcttccccgcagtgcccccagcctacaggggtggccatatttgggcagttctccagtcctgtgggctcggctatacttgggagcagatttccttggtctggatttgcctggggagatgggtcctgggcttggatctttccctaggcgggccctgcgacta

SEQ ID NO: 594347 - DNA, 116 bp, Homo sapiens
gctcgacataggatgcagatttaaactcaatatgtaaataatacagggagaaacatgatataacagcacatcactccatactcattatgggatgtctacattttatattgaaaacg

SEQ ID NO: 594348 - DNA, 316 bp, Homo sapiens
aggaccgatctgtgcctgagagccttcccacgattcatgacatatatgagcttcatccccagaatgaattctctgacgctgaacaagggctgagctcctttggaaagtagcgccacattcgttacactgactaggttcctccccactatgaattctcggatgtcagataaggttggagctcgaactgaaagcttttccacattcactacattcatagggttactctccactatgtattctcgtgatgagtaatcagctctgagctctgcctgaaagcgtttccaggttcactacgttcatagggtccctctcctgt

SEQ ID NO: 594349 - DNA, 854 bp, Homo sapiens
  misc_feature (118)..(118): n is a, c, g, or t
gcccccccaatttatctggatcttccgggaacacatgttaggaaaccgttccagatggacctacttttcctcagatgctgccttacagtattataactaattcaggtacaagtgagancttgtcttccaaggaggtatccttgtggtccgattgccaaaaacagctgcacctctgccccaggaagatcccataggaaagggtgaagggctgctacagggccttcaaccccaggcacctcctccataatgaaacttgggctttggagtttccatgtgatgccatcaagggctttttcagctcaaatatatgtctttcatgattcaggatggcaataagaaactttgagctggctgtagctacttacacgatctcattttatcctgagagtggcctgcatctcagtcacctctgtgtccttagcatttagcatgatgcctggaatacagttctgcttctcattttgtttgatgaacaaccctgagtccattagagatgactcctttggctcctggttttaaatttattttctgtacgtttatttatttatttatttatttatttttgagacagggtctcactctgttacccaggttagtgcagtggcacgatcttggctcactgtgacctctgcctcccaggctcaagtgatcctcccatctcagcctcccactgaatagctggaaccacaggcacacactcctcactttctaagctccagtcctaagtcatatcattctcattgccatacctcaaaagcacccaagtctcaggcacctggactttctacctagaaggtccaccccagtttgtttactgtcctgatgaacattcagctaagccacggcacgagcgg

SEQ ID NO: 594350 - DNA, 283 bp, Homo sapiens
tacagagctcccacttgctggctgcacattgaggcccgtctctactaaaatacaaaaattagctgggcggggtggcgggcgcctgtagtcccagctactcaggaggctgaggcaggagaatggcgtgaacccgggaggcagagcttgcagtgagctgagatcgcgccactgcactccagcctgggtgacagagcaagaatccgtgtcaaaaacaaacaaaaacctaacacatttggcagggcacggtggctcacgcctgtaatcccagcaatgtggcagccag

SEQ ID NO: 594351 - DNA, 121 bp, Homo sapiens
ataaactggctaggtgaaagtagtagcataaaaaggacggcttagcaacagaggcataatactagcttatggtaataagacggacaacacaagagaaaagaggaaccacagaaggacaaaa

SEQ ID NO: 594352 - DNA, 468 bp, Homo sapiens
  misc_feature (67)..(67): n is a, c, g, or t
  misc_feature (75)..(75): n is a, c, g, or t
tcaatcacaataagggtacaacagacttgaatacgacatagccaattagacaaacagcatcaatttncaaacaancggtaaccaaagtcacaaatcatcctagtaataaagtgaaatcagacccacaacgaatgaatgaacagccacgtcagttttttttgggagagggggctacaaggcctgagtgccatcagatgtaccaaaccaaattataaaacccatggccctccccaggggtcttcagggagtgggtccaggtagcattgatgagacctttatatctgctgtttgccagtgctttgcacacaggctctgcgccaatcacagggcaagtctcccctgctgtggaaagaccctgctgtttggcttaacacatctcacccctctgcaagcttttattgtcacagatgaagacatcaggaacaggagagcgagtccagcaagtacgcagaaatgggagagcactca

SEQ ID NO: 594353 - DNA, 993 bp, Homo sapiens
gtctgtggatgtgttttattttttatagtgtcgagtgatcgtgccttggttcagggactgtccgttgtgtaccccctgtttttaccctctttgcgcttcttcccccccgtgcgccccgtttttggtgagaccccgctaattttgttagccaccttatagagtttccttgcccggccccgcaaaaatgccgggatttgccccttccaccgggggttccccagagaagctcccttgtctgtaagtgggcttccccgcactgggccctgccttttacacatccccgggggcgtttttcccgcctgcccccgatattgtctccgaaactccgcgcgccaccagaagcgggtggttcttgcgcccccacgtgccagtgtccctggctcaaatggggtgccgccaccacagtacttggacggccccaaggctttggtcgtaaccttcgtcgtgcacagaagcccccccgggggggttaaaaattacttcgtcgcccccacgcgtgttttctattcgatacttcccccccgggacatcgtccttcaattctggcgaacaccctcgtctacaataatagcggcgagctcggcggcactaaagtgagacaaaccggcccccccttcggtgcgatcccacacggtgcctttcgttcaccacagccagaagaaaatatttccttttgaccccggcccgattggtggtgacaaactccccgcctccttccttccagcgacagaatccacgcccttcacgacgcgtcctctcatggggttagagtactgtgttcagcgagtagattctgccctttcccaacccctcgcgggcagcttccagcgtcattggttctcaggccgccttgcaatgtattcttcccgaagttgcgccacgaggccccccccgttgggggctgggttttccctcgctgtccatggaaaagggttgtctctcgttttttaacaaccccaaaattgcccccggggcccaacaaaccaaaaaaca

SEQ ID NO: 594354 - DNA, 575 bp, Homo sapiens
aaggccggacgcagtggctcacgcctgtaatcccagcactttgggaggccgaggcgggcggatcacttgaggtcaggagtttgagaccagcctgaccaacatggtgaaaccccatctgcaataaaaatacaaaaattttagccgggcttggtggcaggcgcctgtactcccagctacttgagaggaggctgaggcaggagaatggcgtgaacctgggaggcagagcttgcagtgagccgagatcgcaccactgcactccagcctgggcgacacagcgagactccgtctcaaaaaaaaaaatgttctaagatggccgggcgcagtggctcacgcctgtaatcccaacactgggaggctgaggcgggcgcatcatgagttcaggagttcaagaccatcctggccaacatagtgaaaccccacctctactaataatacaaaaattagctggacatggtgggacatacctgtaatctcagctactcaggaggctgaggcaggtagatacacttttcactgggaggcggtaggctgtggtgaagcaaatacggtcccacggaacttcagccggggcaaca

SEQ ID NO: 594355 - DNA, 102 bp, Homo sapiens
tgctgggattatgggcatgagccaccgtgcctggccaggaaacagtttttaatttaaaaaaaaaatttatcccaaaaacaatatctgctgggtaccgagctc

SEQ ID NO: 594356 - DNA, 918 bp, Homo sapiens
gccatcaagtataacctcaagcaagcaaacggattccatgaatccttctaatagtctatcctctatcaagcaagtatactctgcccggataatgaacctataaccaatactgaccaattcaataactcgatcgattaataatacattaagtggtctatgagcaatgaaaatctaggtagatagccccctttgcagcttctagaggtcctcacaaggtgtacccaaggacacccctctggaacattccgggcaaatggctttcttgactacaccgatgaacaaaaaggtagtccgccacatacctgcgaattcatataccataatgctctcaccacagaaaatgttaagccttgctccgtacagctctcgtcacatcttatccatcattagcaggcagtggaggtggaattcaaaccaaagcccagctacgcgggaacctcttagactatactcctcaataacccatcataggatgtaacttaatagtcagtgtctaccgtaacaagcctgaatataaggcatctcttaatttagctatctgatgttgatcctaattatgtagcggcatgcctactatctcaatggtgaaatttccatgtaacactgactcgtagtaatatctaagcgccggaaacaagtaaaaatgactaaaaagcttttaatttcgatgtcagccgtcctctaccattaggaggcgtgccccccgtgaaaacgggcttttgccgcaatagtggcgcagtaatctgacagaattcccaatataccagtggcgtggtttattcgcacattttagtgacatacctgcttgaacttgtatttactagctagttatgcacctaatgagtagccaattaaaggaatcacgtggcggtgggttaaaccgccttttccaataaactaaagttctctttccttaaa

SEQ ID NO: 594357 - DNA, 331 bp, Homo sapiens
cgcgctagtgtgctcatagcgagggacaggggatataactggaggttagggttactagtgagcagactacttggggtgactagtattggcatcagaaccaaatccaggcgctcagggcagccctgcaggtggggtgggtctccaggctgctccatactcagcgccggtgatgccgtcgtccattcggcggggatccatcgagaggatactccattgaggtacccccaatcccacgcccctgtttcagcgttcacagggtttcacaggaaactttctcaccacgcgtgtttaaaagataaaaagtaattcagccctcgtggacataggcttc

SEQ ID NO: 594358 - DNA, 163 bp, Homo sapiens
cgcccatttccagaaggcaagggtgttgaggacgtagggatagaaagtcgagaagagggccgggtgagtggctcacgcctgtgatcccagcactttgggaggccgagacaggcggatcaccttaggtctggacttcgagaccagcctggcctacatggcgaaa

SEQ ID NO: 594359 - DNA, 174 bp, Homo sapiens
ccacgtgcgcggcattggcgccggctgaccagtcacgtggacgtcgcctccgatcttggcagcggcggtgacggcgttcaggcttgcgcccttaagctgggcgttatcgtgttcggcaataaccagcgtcgtcatctcaaaccaccttcgcttcgttcttgagtttgtccacca

SEQ ID NO: 594360 - DNA, 466 bp, Homo sapiens
aacacggcagtgcacgctactttctcatgtcgattcttgaggtatacccccctagatggtccctggctcacctttgacctctacccccatgttgtgtgctttctcaatcagttgatgaaatgccaaatggtgccaacgacattgcatgtcctctcacacgctgcccgaggagaactaccagagtgcttcttttcctgactagctattcctggtgcagatttctgcacacagtgaccagaacaagatgaccaacactaacctggctgttgttttcggccctaacctgctgtgggccaaggatgcggccatcaccctcaaggccattaatcccatcaacaccttcaccaagttccttctggatcaccaaggggagctgttcccaagcccggaccccagcgggctctgaacctggcccctgccccaccagccccttctctggtagcccgggtttggactcttcctcctg

SEQ ID NO: 594361 - DNA, 316 bp, Homo sapiens
tcacagagaacccaccatggagctgtctgctgacgacaagaccaacggcaaggccgactggggtaaggtcggcgcgcacgctggcgagtatggtgcggaggccctgcagaggatgtgcctgtccttacccaccaccaagacctacttgccgcacttcgacctgagccactggttttcccagattaagggccacgggaagaaggtggtcgactcgctgaccaacgccgtggggcacgtggacgacatgcccaacgcgctgtcctccctgagcgacctgcacgcgcacaaacttctggtggacccggccaacttgaag

SEQ ID NO: 594362 - DNA, 150 bp, Homo sapiens
aaatccgaggcgttctgtatttatgtcgcccacagttgcttgttagtagtggccatagataacagcatctcctcatccgcatggcattggtcgttaaggtgcctaacctcctctgcagctttctcaaactcagcctgagacatcctggcc

SEQ ID NO: 594363 - DNA, 390 bp, Homo sapiens
cgctccacttggttgtcaaaaatacagcatattattaagaaatgtcaagctggccggggcacggctggctcacgcctgtaatcccagcacttagagaggccgaggatgggaggaccacttgaggccaggagttccagaccagtctggccaacatggcgaaaccccatctctactaaaaataaaaaataaaaaatagctgggtgtggtggcacacgcctgtaatctcagatacttgggaggctgaggcacaaaaattgcttaagccaggaaggcggaggttgcagtaacccaagagctcgccactgtactcccgcctaggtgacagagtgagactccgtctcaaaaaatgaaaattttggctgggcacggtggctcacacctgcaatccca

SEQ ID NO: 594364 - DNA, 212 bp, Homo sapiens
tctaaggaccgtgtatgtgcatgaccaggatgtattcgaggccactagagagcagtataaatactgtgtgctatgtggtaaagacatagagccttcatgtgtgcatttcgagatcagctgtgtgagtctgaatatgctaataacatcagaaccttgtgagattgtgccttgtgtcgcggaggaccagagtatgttgaggttccagggggtgc

SEQ ID NO: 594365 - DNA, 109 bp, Homo sapiens
gacaaaggaaaacaatgagagatctttaaaattaaaaatgtatgtgcttcaaaggacactatcaagaaagtgaaaagacaatccacagaatgggagcaaatattgcaaa

SEQ ID NO: 594366 - DNA, 430 bp, Homo sapiens
  misc_feature (378)..(378): n is a, c, g, or t
  misc_feature (388)..(388): n is a, c, g, or t
agttggggcactgaatgaactccgcacagaacaccggccttgcaccaaccagttgtgcgcttgcaacaggcacctggaggaatgccctctggactcgagcctctgttctgaccatagctgcagctctcgtgctccctttcagagcagcaccacttctctggttcctgtccacctgagacgcagacccatcctgccacccactagcccgagccccagcccagctcttgccttttggaaacgtgtcaggattggcctggaggatatctggaacagcctttcttcagtgttcacagagactcaaccagtagaaagaatccagaggtaatggccatgtctccctcaagagaagatgtctacattataaactcccttttcaanccccaacacnccactatatatttttaatatatagaaaaaaaaagctaaaaaa

SEQ ID NO: 594367 - DNA, 1040 bp, Homo sapiens
gactcgggaaaccttcagaggagtctccagaaaggacacggtggctgcttttctcagcgccgaagccggcatgtcgtcctcagaagcgcccgagtcagggcgctctgaggaaacatggctgacagatgaggatcaagggaaatatcgcggtcgataattggtcatggagggcccgtagatagatgtgaatgtggaggttgccgtggcaagcacttgtgtggacgagaacgggtcaattgtaggggaacaaggatacacattgtcgggaactgagggggaggggaatagctgggacgtggtaaaaattggggggggccctgaatgtggattaccaggtggtcacagttatttggggaaggtactgataaattgggctccttcgaaactgtggaaggtcgggaaaaggccgtgtggccaaagagatacggacttgggccacagaacaatttcctacattcccaaaattgtggctactcattctgataaaaccaagaaggagtgggatttacattatctgggtaccaggggcaaacttagcaaaaacctccaagaagaacggagttctattgaacctggcaattctccaagaatgaacacgggggggccagcctcggggcggtgctgcattctaacaaggcacagctccactgccgctggtaactccaggctacccgcccactcagctggagggggcccccaacaggagtaggggaccacccaaaggaatccaaggtcgttgggggcacgagaggcgggacgaagcaggcaaggcggcacatacagcaccagaaggctccaacacggggggatagatcgagcgaggtgactcataaggtagtaacgaggaggcctgcgccacatcgatacaagcaaatgagttcagcgacacacaacctaaccgaagcgctgcgtggtggcgtacacactacaacgccaggcggcagacagtacagagcaacaaagagaaccgacacaaagatcagagtcaacgacgagctggacatgaagagacgcgtaggagagtacgtaaggtaatatga

SEQ ID NO: 594368 - DNA, 366 bp, Homo sapiens
  misc_feature (23)..(23): n is a, c, g, or t
  misc_feature (25)..(25): n is a, c, g, or t
  misc_feature (27)..(27): n is a, c, g, or t
  misc_feature (35)..(35): n is a, c, g, or t
  misc_feature (37)..(37): n is a, c, g, or t
  misc_feature (46)..(46): n is a, c, g, or t
  misc_feature (48)..(48): n is a, c, g, or t
  misc_feature (53)..(53): n is a, c, g, or t
  misc_feature (57)..(57): n is a, c, g, or t
  misc_feature (60)..(60): n is a, c, g, or t
  misc_feature (63)..(64): n is a, c, g, or t
  misc_feature (67)..(67): n is a, c, g, or t
  misc_feature (71)..(71): n is a, c, g, or t
  misc_feature (73)..(74): n is a, c, g, or t
  misc_feature (79)..(79): n is a, c, g, or t
  misc_feature (85)..(85): n is a, c, g, or t
  misc_feature (92)..(92): n is a, c, g, or t
  misc_feature (97)..(98): n is a, c, g, or t
  misc_feature (109)..(109): n is a, c, g, or t
  misc_feature (126)..(126): n is a, c, g, or t
  misc_feature (131)..(131): n is a, c, g, or t
  misc_feature (136)..(136): n is a, c, g, or t
  misc_feature (139)..(139): n is a, c, g, or t
  misc_feature (142)..(142): n is a, c, g, or t
  misc_feature (153)..(153): n is a, c, g, or t
  misc_feature (156)..(156): n is a, c, g, or t
  misc_feature (159)..(159): n is a, c, g, or t
  misc_feature (164)..(165): n is a, c, g, or t
  misc_feature (173)..(173): n is a, c, g, or t
  misc_feature (176)..(176): n is a, c, g, or t
  misc_feature (184)..(184): n is a, c, g, or t
  misc_feature (186)..(186): n is a, c, g, or t
  misc_feature (193)..(193): n is a, c, g, or t
  misc_feature (195)..(195): n is a, c, g, or t
  misc_feature (199)..(199): n is a, c, g, or t
  misc_feature (202)..(202): n is a, c, g, or t
  misc_feature (206)..(206): n is a, c, g, or t
  misc_feature (209)..(209): n is a, c, g, or t
  misc_feature (219)..(219): n is a, c, g, or t
  misc_feature (223)..(223): n is a, c, g, or t
  misc_feature (227)..(227): n is a, c, g, or t
  misc_feature (229)..(229): n is a, c, g, or t
  misc_feature (234)..(234): n is a, c, g, or t
  misc_feature (236)..(237): n is a, c, g, or t
  misc_feature (241)..(241): n is a, c, g, or t
  misc_feature (243)..(243): n is a, c, g, or t
  misc_feature (246)..(246): n is a, c, g, or t
  misc_feature (261)..(261): n is a, c, g, or t
  misc_feature (281)..(281): n is a, c, g, or t
  misc_feature (285)..(285): n is a, c, g, or t
  misc_feature (291)..(291): n is a, c, g, or t
  misc_feature (293)..(293): n is a, c, g, or t
  misc_feature (298)..(298): n is a, c, g, or t
  misc_feature (329)..(329): n is a, c, g, or t
  misc_feature (337)..(338): n is a, c, g, or t
  misc_feature (348)..(348): n is a, c, g, or t
  misc_feature (352)..(352): n is a, c, g, or t
  misc_feature (354)..(354): n is a, c, g, or t
  misc_feature (356)..(356): n is a, c, g, or t
  misc_feature (362)..(362): n is a, c, g, or t
  misc_feature (364)..(364): n is a, c, g, or t
cgtcggtcgctagctcgctcggngngngtggtccngngtccatggngntcttngtgnggntgnnggntctngnnctggntctggncctgggncccgnngcgaccctggngggtcccgccaagtggncctancagcnggngcngcagcacagcnggntcnggggnngccagcgnggncccaaggngngtgcggngnaganggntatnggnactaataggnagtncttnancaacngnnagcngnggnaccaaaggaaaatcngtgggaaatcaacagtgatnagcnaggagngnggtgntggatatgaaaaggtccctggggagaagggntgtccagnngccctaccantctnananctttangnga

SEQ ID NO: 594369 - DNA, 487 bp, Homo sapiens
  misc_feature (338)..(339): n is a, c, g, or t
  misc_feature (395)..(395): n is a, c, g, or t
  misc_feature (401)..(401): n is a, c, g, or t
  misc_feature (407)..(407): n is a, c, g, or t
  misc_feature (410)..(410): n is a, c, g, or t
  misc_feature (418)..(418): n is a, c, g, or t
  misc_feature (424)..(425): n is a, c, g, or t
  misc_feature (427)..(427): n is a, c, g, or t
  misc_feature (429)..(429): n is a, c, g, or t
  misc_feature (431)..(431): n is a, c, g, or t
  misc_feature (440)..(440): n is a, c, g, or t
  misc_feature (454)..(454): n is a, c, g, or t
  misc_feature (471)..(471): n is a, c, g, or t
tgtaccactcagatgggagatgttgctaatgggggaggctatgcatgtgtgggagcagagtgtatctggcagcagtccccagcctttttggcagcagggaccagttttatggaagacaatttttccacagatagttgggggaatgggggtatgatctggggatgaaactgtgaaactattccacctcagatcaacaagcattagttagattctcataaggaacatgcaacctagatctcttgcatgcacagttaaaaatagggttcgcactcctatgagaatctaatgccaccactgatctgacggaaggcggggctcagttggtaatgctggctcannactgcgtggtccagtttctaacaggccaccaactggtactggtccatggcccgggngttggngacctntgngatacctntgcacnntntncncagtttttntgtgaacgtacaancgctttaaaataaggtntataattaaaaagaaa

SEQ ID NO: 594370 - DNA, 206 bp, Homo sapiens
tgtttatgttgatctagagtgatcccgcttaatgccaaggtgatctcccgtcagcagatctggaagctcatcaaagatgtgctgatcatcctgcaagcctgtgactgtgtccattcactgttgctcgatgccttgaaaaacaccttgtgactgccggaaagggcaggcacattggcatatggtaatgctggcatgggtacagacca

SEQ ID NO: 594371 - DNA, 179 bp, Homo sapiens
agagtgtactcacgacgtaggactgggagagataggagagtagacgcgtgattaggagggatcagacgaagaggggcgtgtggtattgggttatggaggtggttttatattgagtaatctgtgtgatgaaatggtatggccccgtaagatagtgctagcgtctgtatagacactcttgt

SEQ ID NO: 594372 - DNA, 485 bp, Homo sapiens
  misc_feature (474)..(474): n is a, c, g, or t
aaggcagaaataattaggctagggctcttagttttcattcctattgcccaagtattgtcaaactatggtattattttaatgttactttaaaaatccataatctgctagttttgcatgtacttatatgaaaacagtgcagtaagttgaaaactcagtatctatggaattgataaatgttgatctggtgtagtatattttatcgcattttcttatattaaaaaatgtctgcatgattacattttatttcctttgtaattaacatttaaaaatagtgcactaccatatgggcgcccacattcaatatcacccaacccagtgttcgtagaacaacacatttaaaacaaacatgtgtggtcaaacaaccataagaatcggtctcaaataaactctgaacatgtcatattttgatcaaaaatttttaactttataaattggacatcaccatgtatatctttaaaaaatgaacataaaatnctgattttttt

SEQ ID NO: 594373 - DNA, 253 bp, Homo sapiens
  misc_feature (40)..(40): n is a, c, g, or t
  misc_feature (101)..(101): n is a, c, g, or t
  misc_feature (113)..(113): n is a, c, g, or t
  misc_feature (136)..(136): n is a, c, g, or t
  misc_feature (153)..(153): n is a, c, g, or t
  misc_feature (186)..(186): n is a, c, g, or t
  misc_feature (208)..(208): n is a, c, g, or t
tgcctgcttgagtgaaactatgtgtgggttttccctgtancttgtagaaatgttggggtgttttcctctccatatgctcgtgcctgcgagccaactatttncagctgtatttnccttcatttttgatgaggtgganttaaattttgtttcacnttgtgttagtgaattccacagtagttttctgantgttgttaaaaatgacttaacnttattacacagatattcaataaaaatgttttatttcctgttaaaa

SEQ ID NO: 594374 - DNA, 2726 bp, Homo sapiens
  misc_feature (1083)..(1083): n is a, c, g, or t
  misc_feature (2509)..(2509): n is a, c, g, or t
  misc_feature (2556)..(2556): n is a, c, g, or t
  misc_feature (2606)..(2606): n is a, c, g, or t
  misc_feature (2677)..(2677): n is a, c, g, or t
gggttcctgcatcgggcctgagcagaactaggcgcgccgcggcccggcacgcgcaggcgtacagagctgcccgggggtgccagttcctctccgattcccggcttctgtcaccttcctcacggaccttggtcacggccgcaggtgaccccttagcccagctccagtgggcgggtggcagggtcatggaggacgctggcggcggcgaggagaccccggccccggaggccccgcacccccctcagctcgcgcctccggaggagcaggggttgctcttccaggaggaaaccatcgatcttggcggagatgagtttggatccgaagagaacgagaccgcatcggaaggctcgagtcctctcgcggacaagctgaacgaacacatgatggagagcgtcctcatctctgactcccccaacagcgagggcgacgcgggcgacctgggccgagtgcgggacgaagctgagcccggaggggaaggcgacccaggcccggagcccgcgggcaccccgagtcccagcggcgaggccgacggcgactgtgcccccgaggacgcggcacccagtagcggaggggccccgaggcaggacgcggcccgcgaggtcccaggcagcgaagccgcgcgcccggagcaggagcctcccgttgcggagccggtcccggtgtgcaccatcttcagccagcgcgcgcccccagcctccggggacggcttcgagccgcagatggtgaagtcgcccagcttcggtggcgccagcgaggcctcggccaggacaccgccccaggtcgtgcagcccagccccagcctcagcacgttcttcggagacacggccgccagccactccttggcctcggacttcttcgactccttcactacctccgccttcatttccgtcagcaatcccggcgcgggctccccggcccccgccagcccgcctcccctcgctgtgcccgggaccgaggggcgccccgaacccgtggccatgcgagggccccaggcagctgcgcccccggcgtcgccagagcctttcgcgcacatccaggcagtgtttgcagggagtgacgacccctttgccaccgccctgagcatgngcgagatggaccggaggaacgacgcctggcttcccggcgaggctacgcgtggagtcctgcgggccgtggccacccagcagcgcggcgccgtgttcgtggacaaggagaacctcaccatgccgggcctcaggttcgacaacatccagggagatgcagttaaagacttgatgcttcgctttctgggtgaaaaagctgcagcaaagagacaagtcctaaatgccgactcagtggaacaatcttttgttggattgaaacagctaatcagctgcagaaactggagggcagcagtggacctgtgcggacgtctcctcacagcccacggccagggctacggcaagagcgggctgctcaccagccacacgacagattcactgcagctctggtttgtcaggctggcactactagtgaagttgggccttttccagaatgctgagatggaatttgaacccttcggaaatcttgatcagccagatctttattacgagtactacccgcacgtgtaccctgggcgcaggggctccatggtccccttctcgatgcgcatcttgcacgcggagcttcagcagtacctggggaacccacaggagtcgctggatagactgcacaaggtgaagactgtctgcagcaagatcctggccaatttggagcaaggcttagcagaagacggcggcatgagcagcgtgactcaggagggcagacaagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctccagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcactggtgtctgctgcntgttttcttggtcccaagccacggcccagcccaggactgccccgcanttggtcggcgttcagcacgcagtccctgcagctgggtcactgttcatgantgcaaggggcaggcgtgctgggaggacacagctcgtagacaggaaatctggagtcagcctcggggcctctnttctggaggccaatcctgctttgctcgttccttctggacatcctcagag

SEQ ID NO: 594375 - DNA, 1394 bp, Homo sapiens
  misc_feature (38)..(38): n is a, c, g, or t
  misc_feature (40)..(40): n is a, c, g, or t
ggggcagccgaagggggtgggggatggagggttacagngnattgctgtcttggtacctgcactccgcggagtcctgagttcttgtcctgcctccaagaagaacgagattatgccgacaaccagagggagatgcagttaaagacttgatgcttcgctttctgggtgaaaaagctgcagcaaagagacaagtcctaaatgccgactcagtggaacaatcttttgttggattgaaacagctaatcagctgcagaaactggagggcagcagtggacctgtgcggacgtctcctcacagcccacggccagggctacggcaagagcgggctgctcaccagccacacgacagattcactgcagctctggtttgtcaggctggcactactagtgaagttgggccttttccagaatgctgagatggaatttgaacccttcggaaatcttgatcagccagatctttattacgagtactacccgcacgtgtaccctgggcgcaggggctccatggtccccttctcgatgcgcatcttgcacgcggagcttcagcagtacctggggaacccacaggagtcgctggatagactgcacaaggtgaagactgtctgcagcaagatcctggccaatttggagcaaggcttagcagaagacggcggcatgagcagcgtgactcaggagggcagacaagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctccagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcactgg

SEQ ID NO: 594376 - DNA, 885 bp, Homo sapiens
gaagtaggttctctttaagggacaccctagatgggctaatcggggcagatagaaaaggaggaagcctctgtagggccgtcaagtgcttggggttccgaaaatcttgaggactgaaagacaactaatgcctttcaggacgatcatcatggaggatcctcccgcctcggccttgggtctacaggcctgtattatcccacccctgtttttttttttttttttttagtagagacggggatttgttatgttgaccaggctggcctcaaccgcctgggctcaagcaatcctcccgccttggcctcgggactacaggcacgaaccaccccaccctcactaattgtttttatttttatattttgtttagtacagacggttttgctatgttggccaggctggcctctgccgccgtgggcttaagcaatccttccgcctcggccctgggactacagaagtgcaccatcctgcccatgcttgtttctttttttttagtagacaccgggttgcctatgttggccaggtggcctcaacctccggggcccacgcggactcctcacccctgggctcgcgactacagttgtgtgccatccgccctgttaatttgtgggggtcggccattttagtaaagaaaggggttccctatggtgggcgaatggggttgacctcgtcggttaaggtgttcccccccttggcaggaataagggaagaacccctgtatgtattattgggcgcactacatgcgcaacagcgcgttctgctagtaggaccagggccactaccccgtgagaagacctgtgtcttgcggaaaagggaaactaccgccacaatttgcaatttagttgagcaacgctcgcggaggatatacggggaaaagccctgaagtgattgtgc

SEQ ID NO: 594377 - DNA, 2397 bp, Homo sapiens
  misc_feature (1083)..(1083): n is a, c, g, or t
gggttcctgcatcgggcctgagcagaactaggcgcgccgcggcccggcacgcgcaggcgtacagagctgcccgggggtgccagttcctctccgattcccggcttctgtcaccttcctcacggaccttggtcacggccgcaggtgaccccttagcccagctccagtgggcgggtggcagggtcatggaggacgctggcggcggcgaggagaccccggccccggaggccccgcacccccctcagctcgcgcctccggaggagcaggggttgctcttccaggaggaaaccatcgatcttggcggagatgagtttggatccgaagagaacgagaccgcatcggaaggctcgagtcctctcgcggacaagctgaacgaacacatgatggagagcgtcctcatctctgactcccccaacagcgagggcgacgcgggcgacctgggccgagtgcgggacgaagctgagcccggaggggaaggcgacccaggcccggagcccgcgggcaccccgagtcccagcggcgaggccgacggcgactgtgcccccgaggacgcggcacccagtagcggaggggccccgaggcaggacgcggcccgcgaggtcccaggcagcgaagccgcgcgcccggagcaggagcctcccgttgcggagccggtcccggtgtgcaccatcttcagccagcgcgcgcccccagcctccggggacggcttcgagccgcagatggtgaagtcgcccagcttcggtggcgccagcgaggcctcggccaggacaccgccccaggtcgtgcagcccagccccagcctcagcacgttcttcggagacacggccgccagccactccttggcctcggacttcttcgactccttcactacctccgccttcatttccgtcagcaatcccggcgcgggctccccggcccccgccagcccgcctcccctcgctgtgcccgggaccgaggggcgccccgaacccgtggccatgcgagggccccaggcagctgcgcccccggcgtcgccagagcctttcgcgcacatccaggcagtgtttgcagggagtgacgacccctttgccaccgccctgagcatgngcgagatggaccggaggaacgacgcctggcttcccggcgaggctacgcgtggagtcctgcgggccgtggccacccagcagcgcggcgccgtgttcgtggacaaggagaacctcaccatgccgggcctcaggttcgacaacatccagggagatgcagttaaagacttgatgcttcgctttctgggtgaaaaagctgcagcaaagagacaagtcctaaatgccgactcagtggaacaatcttttgttggattgaaacagctaatcagctgcagaaactggagggcagcagtggacctgtgcggacgtctcctcacagcccacggccagggctacggcaagagcgggctgctcaccagccacacgacagattcactgcagctctggtttgtcaggctggcactactagtgaagttgggccttttccagaatgctgagatggaatttgaacccttcggaaatcttgatcagccagatctttattacgagtactacccgcacgtgtaccctgggcgcaggggctccatggtccccttctcgatgcgcatcttgcacgcggagcttcagcagtacctggggaacccacaggagtcgctggatagactgcacaaggtgaagactgtctgcagcaagatcctggccaatttggagcaaggcttagcagaagacggcggcatgagcagcgtgactcaggagggcagacaagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctccagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcactgg

SEQ ID NO: 594378 - DNA, 293 bp, Homo sapiens
tacccgggcttcagcaagaatctgtcaggtcagtttagtaacaatccccctttaccctgatgtttcctcgcattagtcattttccatcgacgggccccactctgctccggggctatatttataaatccccacttgtccacgttgtatttggaattgagcccagttctataccgaagtatcttttcccctattgtaatagttctgaataatctattttcactgctttaactattgtccagctctggttttcttggacagtttgggtgctacaactcggataagatcagactgat

SEQ ID NO: 594379 - DNA, 412 bp, Homo sapiens
acttacccttactggtaatgagctttcaatggctcgatcctctcacactgaaactctgtatagcatctcatagtccacaagcattcccaacattgagccttctgggggtagctgtctgtgtcatcccacaggaaggagctggagatccccattaggactgtccacccacactttaagccacaaagcctggagggattggggctctcacgtggtttggtcggctaagtcccgcctagaaggccagaaatttctggaaaacaggtaacagaccaaaaactaaagtgctatcagtacaatgaactatttatctactgcccgcgaatctctggcttgagactacctactggtgtccagttggagacagactaaaatgcactgaaggactattaggatagctgactcctaagttatc

SEQ ID NO: 594380 - DNA, 461 bp, Homo sapiens
tcgagccggtacctgaacattcgtgtcagcccacctgcctgcacttgtgtcatgccctatcgttggtatatcacagtcaagtcttacgaaaaggataataggccagcctgccacgcagatgaagataagctttgggcaaatatggtcctgccgttatgtagtaccccacaagaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggacacgaatgttca

SEQ ID NO: 594381 - DNA, 2783 bp, Homo sapiens
  misc_feature (1083)..(1083): n is a, c, g, or t
gggttcctgcatcgggcctgagcagaactaggcgcgccgcggcccggcacgcgcaggcgtacagagctgcccgggggtgccagttcctctccgattcccggcttctgtcaccttcctcacggaccttggtcacggccgcaggtgaccccttagcccagctccagtgggcgggtggcagggtcatggaggacgctggcggcggcgaggagaccccggccccggaggccccgcacccccctcagctcgcgcctccggaggagcaggggttgctcttccaggaggaaaccatcgatcttggcggagatgagtttggatccgaagagaacgagaccgcatcggaaggctcgagtcctctcgcggacaagctgaacgaacacatgatggagagcgtcctcatctctgactcccccaacagcgagggcgacgcgggcgacctgggccgagtgcgggacgaagctgagcccggaggggaaggcgacccaggcccggagcccgcgggcaccccgagtcccagcggcgaggccgacggcgactgtgcccccgaggacgcggcacccagtagcggaggggccccgaggcaggacgcggcccgcgaggtcccaggcagcgaagccgcgcgcccggagcaggagcctcccgttgcggagccggtcccggtgtgcaccatcttcagccagcgcgcgcccccagcctccggggacggcttcgagccgcagatggtgaagtcgcccagcttcggtggcgccagcgaggcctcggccaggacaccgccccaggtcgtgcagcccagccccagcctcagcacgttcttcggagacacggccgccagccactccttggcctcggacttcttcgactccttcactacctccgccttcatttccgtcagcaatcccggcgcgggctccccggcccccgccagcccgcctcccctcgctgtgcccgggaccgaggggcgccccgaacccgtggccatgcgagggccccaggcagctgcgcccccggcgtcgccagagcctttcgcgcacatccaggcagtgtttgcagggagtgacgacccctttgccaccgccctgagcatgngcgagatggaccggaggaacgacgcctggcttcccggcgaggctacgcgtggagtcctgcgggccgtggccacccagcagcgcggcgccgtgttcgtggacaaggagaacctcaccatgccgggcctcaggttcgacaacatccagggagatgcagttaaagacttgatgcttcgctttctgggtgaaaaagctgcagcaaagagacaagtcctaaatgccgactcagtggaacaatcttttgttggattgaaacagctaatcagctgcagaaactggagggcagcagtggacctgtgcggacgtctcctcacagcccacggccagggctacggcaagagcgggctgctcaccagccacacgacagattcactgcagctctggtttgtcaggctggcactactagtgaagttgggccttttccagaatgctgagatggaatttgaacccttcggaaatcttgatcagccagatctttattacgagtactacccgcacgtgtaccctgggcgcaggggctccatggtccccttctcgatgcgcatcttgcacgcggagcttcagcagtacctggggaacccacaggagtcgctggatagactgcacaaggtgaagactgtctgcagcaagatcctggccaatttggagcaaggcttagcagaagacggcggcatgagcagcgtgactcaggagggcagacaagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctccagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggtaagatccccaagctgcaggatcctccatcctctgcctttcacagacgctagaaacatacacccacacacgtctcagcaggggcctgcgcgctctctctccagtccaccagctccaggcagtggctgtggcccttaggggaagtgacccaacagggccacctaggctctgcccagcagctctgcaccacccccaggcccctaacacggcccagcacgcagcctggaatgggcgggcgtctgtcctggttgtgtgggccaaccctgggcgtgtgctcctccctaggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcactgg

SEQ ID NO: 594382 - DNA, 1115 bp, Homo sapiens
tctaccaatatagcacatccacctaccgcacccacacacacacactcactcatcccatctcacactctcactgctaaccctcacctctcaactctaaagcgctaaggttacgaggccctcgggtgtttatcggctgtcgtgggtcgcccgtaggtgtactgctgtagtggtacttcccagaaactgccagtagagggcagcctgggcatctaatgcttactctggttgttacacaaagcaaaatattggggtcactggcgagcccacccacactcaccagaatctccactgtagtccccctaacaaacagcccttcacttcctctcccactatcagcaatatctgtattttgatgccatatggcctcagatcagagtgtattaaatcatcacgccctaggcttatccctggtcgagccaggacacggggtagcttcagtagggtctagtacaccctactacatccttgaagcatagtagcttaatatttatttacttataactactcaccctagctacctagtacacagcaggggccactatcaaagccaaaggtacagggtagataacttcgtaggtaccagcatcagcttattctaccagcttctttactcccactacaccacacagcaaggtgcctggggcagcacttgagccacgatgtcccattctaggcctggaccagtggctgtacaagccaaggcactgcaaatggcacctgtgacctactggcattgcccgcagtcagactttcccaagagaaggccacaaggggtctatatctcaaggcccgggattcatccatgctagccatcctagcctagctagcaagacttgacaggcaatatacttgcactgggacaaacgttggacagagcacaagggcacaccacgtcactgtccatgagagacctatacgaacctacgggtacaccacctaccccagcgttaacccctgcatgccagcactcaacaccagcatcacgatcccatcatctcagcgcagtcacatcgtggccacattcgctggcagaatgaggaccaacaacgacaaacctcactctccacagctatctagccaagaacaacatgcgttccatccacaacataccgact

SEQ ID NO: 594383 - DNA, 113 bp, Homo sapiens
actaaggacacgggcccccttccgtcctcgggcttccggtcccctcctatttatggggtttgaccaactgcacccactccctaataaattcattctccttgggaaaaaaaaaa

SEQ ID NO: 594384 - DNA, 316 bp, Homo sapiens
ttcctttctcacctttccggtaccatttacccaagatcctgttccccttaattgaatgactcatttaccgagtttcatgtacactttgcaacgcaattcccatgtgtcatagaccatgaaatctccatttaccttttaaggtttactcgggtaaactcaatattttctgggtaataaccgtgtgtgatataagtaagcccaaggccagtatagagaaaaagctatagcgcaaaatcactgtgttttttaaagaacctttcctactcaggaatatattttacgctttttgtccactcgttatgtgttgtatgtgtca

SEQ ID NO: 594385 - DNA, 1233 bp, Homo sapiens
  misc_feature (34)..(34): n is a, c, g, or t
ggggggggaaaaaacaatttaccgcgtctatggntgccgatggcccctgggtttaatcggcaccgagggaaacagctaatcagctgcagaaactggagggcagcagtggacctgtgcggacgtctcctcacagcccacggccagggctacggcaagagcgggctgctcaccagccacacgacagattcactgcagctctggtttgtcaggctggcactactagtgaagttgggccttttccagaatgctgagatggaatttgaacccttcggaaatcttgatcagccagatctttattacgagtactacccgcacgtgtaccctgggcgcaggggctccatggtccccttctcgatgcgcatcttgcacgcggagcttcagcagtacctggggaacccacaggagtcgctggatagactgcacaaggtgaagactgtctgcagcaagatcctggccaatttggagcaaggcttagcagaagacggcggcatgagcagcgtgactcaggagggcagacaagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctccagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcactgg

SEQ ID NO: 594386 - DNA, 687 bp, Homo sapiens
  misc_feature (176)..(176): n is a, c, g, or t
tataccatctcacttctaggaatactagtatatcgctcacacctcatgtcctccctactatgccgtaggaaggactatgtactatcgctgttcattatagctactctcataaccctcaacacccactccctcttagccaatcactggtgcctattgccatcactgagtctttgccngccgtgcgagagcagcgagtgggcctcgccctactgagtcgtcaatcgtcccacgcagtatggcctagactacgtacgatctgctacgcctactccattgctagaagtaatcgtcccaacaattatattactaccactgacatgacgtttccaaagacaagcagcatagttggacactcgagacagcagaccacccgacagccgtaattagttagcagtcatccctctacatattttctagatcctatatcaacagagcaatcctatttaggcttgttcccctagagcgttttcctccggaccccctaatcgatcccccgctccgtaatagtagtgtactctgatccgtacccctcgcaatcttggctggccagtgccgcttatccgagtgtccctctatcgcgtcatcaagggtctagctctctatgctaatctccctacaaatctccttactgatcacttccccgcacggaagtaccttttatatcgcgtcggccaatgttccacttgg

SEQ ID NO: 594387 - DNA, 2018 bp, Homo sapiens
  misc_feature (1083)..(1083): n is a, c, g, or t
gggttcctgcatcgggcctgagcagaactaggcgcgccgcggcccggcacgcgcaggcgtacagagctgcccgggggtgccagttcctctccgattcccggcttctgtcaccttcctcacggaccttggtcacggccgcaggtgaccccttagcccagctccagtgggcgggtggcagggtcatggaggacgctggcggcggcgaggagaccccggccccggaggccccgcacccccctcagctcgcgcctccggaggagcaggggttgctcttccaggaggaaaccatcgatcttggcggagatgagtttggatccgaagagaacgagaccgcatcggaaggctcgagtcctctcgcggacaagctgaacgaacacatgatggagagcgtcctcatctctgactcccccaacagcgagggcgacgcgggcgacctgggccgagtgcgggacgaagctgagcccggaggggaaggcgacccaggcccggagcccgcgggcaccccgagtcccagcggcgaggccgacggcgactgtgcccccgaggacgcggcacccagtagcggaggggccccgaggcaggacgcggcccgcgaggtcccaggcagcgaagccgcgcgcccggagcaggagcctcccgttgcggagccggtcccggtgtgcaccatcttcagccagcgcgcgcccccagcctccggggacggcttcgagccgcagatggtgaagtcgcccagcttcggtggcgccagcgaggcctcggccaggacaccgccccaggtcgtgcagcccagccccagcctcagcacgttcttcggagacacggccgccagccactccttggcctcggacttcttcgactccttcactacctccgccttcatttccgtcagcaatcccggcgcgggctccccggcccccgccagcccgcctcccctcgctgtgcccgggaccgaggggcgccccgaacccgtggccatgcgagggccccaggcagctgcgcccccggcgtcgccagagcctttcgcgcacatccaggcagtgtttgcagggagtgacgacccctttgccaccgccctgagcatgngcgagatggaccggaggaacgacgcctggcttcccggcgaggctacgcgtggagtcctgcgggccgtggccacccagcagcgcggcgccgtgttcgtggacaaggagaacctcaccatgccgggcctcaggttcgacaacatccagggagatgcagttaaagacttgatgcttcgctttctgggtgaaaaagctgcagcaaagagacaagtcctaaatgccgactcagtggaacaatcttttgttggattgaaacagctaatcagctgcagaaactggagggcagcagtggacctgtgcggacgtctcctcacagcccacggccagggctacggcaagagcgggctgctcaccagccacacgacagattcactgcagctctggtttgtcaggctggcactactagtgaagttgggccttttccagaatgctgagatggaatttgaacccttcggaaatcttgatcagccagatctttattacgagtactacccgcacgtgtaccctgggcgcaggggctccatggtccccttctcgatgcgcatcttgcacgcggagcttcagcagtacctggggaacccacaggagtcgctggatagactgcacaaggtgaagactgtctgcagcaagatcctggccaatttggagcaaggcttagcagaagacggcggcatgagcagcgtgactcaggagggcagacaagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctccaggtacctgtgcacggtcagacatgagccagaaaggccttatgatagttctttgctcagatg

SEQ ID NO: 594388 - DNA, 122 bp, Homo sapiens
  misc_feature (11)..(11): n is a, c, g, or t
  misc_feature (17)..(17): n is a, c, g, or t
tcaatagagtnggagtngagcccagataagcactatatgtgtggaataggatataggtgctgtgaaatgtgatgtatataaatgtagatgtcagccagtgtgtatgtcacggaacgtgtctc

SEQ ID NO: 594389 - DNA, 1519 bp, Homo sapiens
  misc_feature (38)..(38): n is a, c, g, or t
  misc_feature (40)..(40): n is a, c, g, or t
ggggcagccgaagggggtgggggatggagggttacagngnattgctgtcttggtacctgcactccgcggagtcctgagttcttgtcctgcctccaagaagaacgagattatgccgacaaccagagtgtgaggagggcggacaagagttttattgagcacaaaacagctctcagcagagaggggaggcgagggtggtcccccaccgaaagtcaggtggtgtctctcccagtgtggctggctcaggggcttttttgggctcagaatggaggggtgcatgctgattgtgagtatgcaaaaaagaaggctaaaacaaagtcaccactcaaaggtgggcacgacagtggaaaaaaccagttggggaaggggagatgcagttaaagacttgatgcttcgctttctgggtgaaaaagctgcagcaaagagacaagtcctaaatgccgactcagtggaacaatcttttgttggattgaaacagctaatcctctggtttgtcaggctggcactactagtgaagttgggccttttccagaatgctgagatggaatttgaacccttcggaaatcttgatcagccagatctttattacgagtactacccgcacgtgtaccctgggcgcaggggctccatggtccccttctcgatgcgcatcttgcacgcggagcttcagcagtacctggggaacccacaggagtcgctggatagactgcacaaggtgaagactgtctgcagcaagatcctggccaatttggagcaaggcttagcagaagacggcggcatgagcagcgtgactcaggagggcagacaagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctccagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcactgg

SEQ ID NO: 594390 - DNA, 2639 bp, Homo sapiens
  misc_feature (1083)..(1083): n is a, c, g, or t
gggttcctgcatcgggcctgagcagaactaggcgcgccgcggcccggcacgcgcaggcgtacagagctgcccgggggtgccagttcctctccgattcccggcttctgtcaccttcctcacggaccttggtcacggccgcaggtgaccccttagcccagctccagtgggcgggtggcagggtcatggaggacgctggcggcggcgaggagaccccggccccggaggccccgcacccccctcagctcgcgcctccggaggagcaggggttgctcttccaggaggaaaccatcgatcttggcggagatgagtttggatccgaagagaacgagaccgcatcggaaggctcgagtcctctcgcggacaagctgaacgaacacatgatggagagcgtcctcatctctgactcccccaacagcgagggcgacgcgggcgacctgggccgagtgcgggacgaagctgagcccggaggggaaggcgacccaggcccggagcccgcgggcaccccgagtcccagcggcgaggccgacggcgactgtgcccccgaggacgcggcacccagtagcggaggggccccgaggcaggacgcggcccgcgaggtcccaggcagcgaagccgcgcgcccggagcaggagcctcccgttgcggagccggtcccggtgtgcaccatcttcagccagcgcgcgcccccagcctccggggacggcttcgagccgcagatggtgaagtcgcccagcttcggtggcgccagcgaggcctcggccaggacaccgccccaggtcgtgcagcccagccccagcctcagcacgttcttcggagacacggccgccagccactccttggcctcggacttcttcgactccttcactacctccgccttcatttccgtcagcaatcccggcgcgggctccccggcccccgccagcccgcctcccctcgctgtgcccgggaccgaggggcgccccgaacccgtggccatgcgagggccccaggcagctgcgcccccggcgtcgccagagcctttcgcgcacatccaggcagtgtttgcagggagtgacgacccctttgccaccgccctgagcatgngcgagatggaccggaggaacgacgcctggcttcccggcgaggctacgcgtggagtcctgcgggccgtggccacccagcagcgcggcgccgtgttcgtggacaaggagaacctcaccatgccgggcctcaggttcgacaacatccagggagatgcagttaaagacttgatgcttcgctttctgggtgaaaaagctgcagcaaagagacaagtcctaaatgccgactcagtggaacaatcttttgttggattgaaacagctaatcagctgcagaaactggagggcagcagtggacctgtgcggacgtctcctcacagcccacggccagggctacggcaagagcgggctgctcaccagccacacgacagattcactgcagctctggtttgtcaggctggcactactagtgaagttgggccttttccagaatgctgagatggaatttgaacccttcggaaatcttgatcagccagatctttattacgagtactacccgcacgtgtaccctgggcgcaggggctccatggtccccttctcgatgcgcatcttgcacgcggagcttcagcagtacctggggaacccacaggagtcgctggatagactgcacaaggtgaagactgtctgcagcaagatcctggccaatttggagcaaggcttagcagaagacggcggcatgagcagcgtgactcaggagggcagacaagcctctatccggctgtggaggtcacgtctgggccgggtgatgtactccatggcaaactgtctgctcctgatgaagaaggtgtcctttgttctccctatcttcgtggagggtgtttttttcacctcatggttttgattttatgattgatgcttacaacacctgaagacaggcttccccacaagaccttcttaggacgtcaccccagagctctcagcctcctccttaaaataagggcatagatctgagatctctgaaatccctcccagctctgacattcacacagctctctcctctccttcaacacactggataaaggaaattacggttttcaagttctgtggtttgctcagagcaggtttttcttccgctgccactcctgagatagtcccactgaggtcaggtggcccgcacaggtgctttgttctggtcctcaccctcctcccacccgcccccttcccttctccagccccctctggcttctgcagcagggcttgcccacctctgagtgggagtgaaaagtaggccctcctgctcccctgccctggtggcctcttcaccacccaaggcttggccagcaaccaggtgaccccgaagcacccggcctgacccctctgcctcccaaaacaggccattctccctgtgctgcctgtggccagccctgacacccccacctggcggtctgggcggtccacagtaggcctccacttgctgagggcattgtcagcgtcacctgaaagtcaccagcttgccggaacattcttatgcaaagacatgaagaatcaattataaattcacaggactgacgtttcactaatcatggggctaaaactccccagggaaggtaagctcctgttc

SEQ ID NO: 594391 - DNA, 411 bp, Homo sapiens
  misc_feature (128)..(128): n is a, c, g, or t
  misc_feature (157)..(157): n is a, c, g, or t
cctcttccccactgtgtgatttggacaccttccttgacctctctgagcctctgaccttctgccggacagtgctgacttgcagagttgttgtaaggtttggagatcatggatgcaaaatgtctccaacnagcctagcacgtgctgaacatctggcttntcggcctctgcactgtggacatttgggcctggataagtctccgttgtaaggggcttccctgtgcttgcaaaatgtggagtagcacccctggtctccacccactagatgccagtagcatccttcagttgtgaccaccaaacatgtctccagacattgacagatgtccccagagacaaaattggccctggtcgagaactactggaataatcatagtttataataatagtttataataataatagattatttataat

SEQ ID NO: 594392 - DNA, 830 bp, Homo sapiens
cagacgtcggcatctacttcctcacctgcatcagcgccgcaccgtttcctggccatgtgctcccggtcaagtccctcaagctccgcaggcccctctacgcacacctgggctgtgccttcctgtgggtggtggtggctgtggccatgggcccgctgctggtgagcccacagaccgtgcagaccaaccacacggtggtctgcgctgcagctgtacccgggagaaggtctcccaccatgccctggtgtccctggcagtggccttcaagccttcccgttcatcaccacggtcacctgctacctgcgtgatcatccgcagacctgcggcaggacctgcgtgtggagaagcgcctcatgaccaaggcagtgcgcatgatcgccatagtgctggccatcttcctggtctgcttcgtgccctacacaggtcaaccgcatccgtctacgtgctagcaactaccgcagccatggggcctccatgcgccaccgccagcgcatcctggtccctggcgaaaccgcgatcacctcctgcctcaccagactcaacggggcaacatcgaccccatcaggtatgtcttcgttggctgaaaagttccgcacgccctgtgcaaagtggctctgtggcacaagggctcaagggcccgaccccccagctgtcgaaagggaagaaccaacggagagctcgcatgagtgcaagtcagagctgtgatcggggggcgccgccaggccgagcgcagacgtgaggactcaccagagccgcaagaggctctgcctttcccagcactcccagcaagaacgaatcgtagacatgccacattctctagacgctagctacca

SEQ ID NO: 594393 - DNA, 1907 bp, Homo sapiens
  misc_feature (1083)..(1083): n is a, c, g, or t
  misc_feature (1470)..(1470): n is a, c, g, or t
gggttcctgcatcgggcctgagcagaactaggcgcgccgcggcccggcacgcgcaggcgtacagagctgcccgggggtgccagttcctctccgattcccggcttctgtcaccttcctcacggaccttggtcacggccgcaggtgaccccttagcccagctccagtgggcgggtggcagggtcatggaggacgctggcggcggcgaggagaccccggccccggaggccccgcacccccctcagctcgcgcctccggaggagcaggggttgctcttccaggaggaaaccatcgatcttggcggagatgagtttggatccgaagagaacgagaccgcatcggaaggctcgagtcctctcgcggacaagctgaacgaacacatgatggagagcgtcctcatctctgactcccccaacagcgagggcgacgcgggcgacctgggccgagtgcgggacgaagctgagcccggaggggaaggcgacccaggcccggagcccgcgggcaccccgagtcccagcggcgaggccgacggcgactgtgcccccgaggacgcggcacccagtagcggaggggccccgaggcaggacgcggcccgcgaggtcccaggcagcgaagccgcgcgcccggagcaggagcctcccgttgcggagccggtcccggtgtgcaccatcttcagccagcgcgcgcccccagcctccggggacggcttcgagccgcagatggtgaagtcgcccagcttcggtggcgccagcgaggcctcggccaggacaccgccccaggtcgtgcagcccagccccagcctcagcacgttcttcggagacacggccgccagccactccttggcctcggacttcttcgactccttcactacctccgccttcatttccgtcagcaatcccggcgcgggctccccggcccccgccagcccgcctcccctcgctgtgcccgggaccgaggggcgccccgaacccgtggccatgcgagggccccaggcagctgcgcccccggcgtcgccagagcctttcgcgcacatccaggcagtgtttgcagggagtgacgacccctttgccaccgccctgagcatgngcgagatggaccggaggaacgacgcctggcttcccggcgaggctacgcgtggagtcctgcgggccgtggccacccagcagcgcggcgccgtgttcgtggacaaggagaacctcaccatgccgggcctcaggttcgacaacatccagggagatgcagttaaagacttgatgcttcgctttctgggtgaaaaagctgcagcaaagagacaagtcctaaatgccgactcagtggaacaatcttttgttggattgaaacagctaatcagctgcagaaactggagggcagcagtggacctgtgcggacgtctcctcacagcccacggccagggctacggcaagagcgggctgctcaccagccacacgacagattcactgcaggtgagaacanctttcaggtgctggagtttaacctggcttatcacagtctggggacatggacaggaccatggcctttcatgccaataacaaaaagtatgttttcatatcctgcttctttctctcctaattatattgtatatactatactggggcactggaattctcacttcggcccgtcaggacgcctgtgcgccccagaagcacgctcacaagtgcccacactcagtctcatggtggaaccggcatggctttgggtcagcaggtgggttcgcctcacgactggcagtagcaactggcctgtgcggggctctggggcgtgtctgggcccggtaggaaacagtgacaggagcagttggttctgtccaccccaaggacggagggtccatgtgccatttgctcctcgtggtatatcacttgctattaaaatacattaaactataaaaaaaa

SEQ ID NO: 594394 - DNA, 279 bp, Homo sapiens
ccgtctgtactaaaaatacaaaactagccgggcgtggtggcaggtgctggtaatcccagctactcttgtggctgaggcaggagaatcgcttgaacccaggaggcacaggttgcagtgagccgagatcacgccactgcacaccagcctgtgtgacagagagagaatgtctccaaaaaaaagtgttgttgttctcagtattcctttttgtaccatcctctttcctgtttcatgaaggcagtccgttttagacacatttctttgtctaatgttttattgatt

SEQ ID NO: 594395 - DNA, 1493 bp, Homo sapiens
cacgagggcggagggcgtgtgccgggagcacaatccgggccgaggctcctggtaagggagcagagcgggaagctgatcccccacggattcttagggggccgacttcccctgtgttgaagattcatcaaagactgattcgagtctgtgttcagcatgtgtgttttagattagaacagtgttgagaatttttatatggggcccagttttagcaggacatcatttaggatctttacaaacgagttcagggtacttcgttttatctgttgtctttgagccactgagtgaattagtaaatgtttgcaaatgtgattgcatcagtgaagaagaacatataccacgagttaaaataaatttcccgtgctgctgaaaaatcagtgccgccatcctctgaccctgctcctcccacgcgccctgcaggctgtctccctctggggtcgagagagcttcacagaccatttgggaaagagccaagcaaacacacttctgcaagccatttgcataagtagacataatccatacggaatgatgcactgttcggttgtagtttcattcgtcagtgacctgcatctgcccgcccagtcttgagttcagctccatccctccctgcagttccgcagcctccggttccccacctcagcttggctgagagtttcacgttcatccaagtgcttctttacagactcactcccagctggaggaggcagaggatcctggccaatttggagcaaggcttagcagaagacggcggcatgagcagcgtgactcaggagggcagacaagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctccagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcactgg

SEQ ID NO: 594396 - DNA, 191 bp, Homo sapiens
gaggatccccgattggtctgttccctggctccagctgtgccctctgccacgtggctgcgttgcatgatttcctggcttgtgatgagcctgttctgggggcaccggccgccgcgcctgcctgagggccaggatcttccgctccagacgctcttggtcaaacgccagcacactgaggctatgcagggacccac

SEQ ID NO: 594397 - DNA, 238 bp, Homo sapiens
aggcggaccacatgatgtcacgctcgagcacatttttctttatccatggatcagttgatggacatttagatttttacctttggactatggtgaatagtgtcgctatgagcattcatttgcaagcttttgtttgaacctcagttttcaattcttgggggtgcatacttaggaggggcatggccgggacatacggaaacgctatgttgaacttacggaggagcgggggagcaaatcatgt

SEQ ID NO: 594398 - DNA, 422 bp, Homo sapiens
  misc_feature (58)..(58): n is a, c, g, or t
  misc_feature (60)..(60): n is a, c, g, or t
  misc_feature (75)..(75): n is a, c, g, or t
  misc_feature (84)..(84): n is a, c, g, or t
  misc_feature (238)..(238): n is a, c, g, or t
  misc_feature (303)..(303): n is a, c, g, or t
  misc_feature (342)..(342): n is a, c, g, or t
  misc_feature (357)..(357): n is a, c, g, or t
  misc_feature (372)..(372): n is a, c, g, or t
  misc_feature (377)..(377): n is a, c, g, or t
  misc_feature (384)..(384): n is a, c, g, or t
  misc_feature (408)..(408): n is a, c, g, or t
ttatttttccatttcaccaggcccattcaaataagaactaataggagtatggggattntnttgtgccattcccanatttgtccntgttgttcagaggaagtgtccccattaagaaaaagtggagtgggccaggtgcagtggctcatgcctgtaatcccagcattttgggaggctgaggcaggtggatcacgaggtcaggagatcgagagcatcctggctaacacggtgaaacccagtntttactaaaaaaatacaagaaattagcccaggcatggtggcaggcacctgtattcccagttattngggaggttgaggcaggagaatggcatgaccccgggaggnggagcttgcagtgancccagttcgcgccantgtantccagcntgggagacagagcaagagacaganccagattccatttc

SEQ ID NO: 594399 - DNA, 419 bp, Homo sapiens
ggcaccccggcaactgcttcggatggggcctggacgggctcctctggcactagtgacccagtcacagaggggagaaaacgatgggaaaaagccacacccacccaaacccttttacatacactcacatcaataggtcctgggccgaccaaagattagaaaaccccaccgctcatttttcctcaactactgaaatgagccagtgagaccacacaggacaggacgcccggtccccctccctaagccacgtttctaataatcttggtctagcaccacccgtaacaaagcggaactttcatatggacgtgcaaatcctgtgtgtccttggaatcctagtgttactgaagataggctgctgcttcctcctgtggatggcagacactgaggaggtggctggatgtcgttcaggtccatttccagga

SEQ ID NO: 594400 - DNA, 291 bp, Homo sapiens
cgtcattgaagtctcccttgatgataaataatctggtgccccgtgcaagctatattcatttctgtctcaagcacatgagaatggatacttaattgaaaatgaagtaaaattctgcctaattaagtaaggtgataaggttgtgaattggtctgtgtccttgaataaatgatttagtaacaggaaatgattggtattatctgtaaagagaattagccaagaggaaaggaattttatttgaagaatgtcgtagccaggtgatatagctgatatgagaaactcacatgcatcagt

SEQ ID NO: 594401 - DNA, 493 bp, Homo sapiens
tcgacctcatcacctgcccctcttggggcgattactgctttaaatacagtatggaaaaatccatgatgactcaagttagcaagcttggaagtataaaaatgatcttcaggaattctgaattaaagaaaacatcactgtagttggaaaatacttcacattactgttggccgagagctcacggtggattaaattggtaaaactcttgaattactgtgcttttgcaactcagaaagtggttcagaaactggacatttttcagggtaccgaagcatttattttctggatgtttacactatgaaaataacaatagaggccaggcactgtggctcgcgcctgtaatcccagcactttgggaggccaaggtgggcggatcacgaggtcaggagatccagaccatcctgtgaatggtgaaccctgtctctactaaaaatacaaaaaattagccgggcgtggtggcaggtgcctgtagtcccagctactcgggagactgagt

SEQ ID NO: 594402 - DNA, 376 bp, Homo sapiens
  misc_feature (85)..(85): n is a, c, g, or t
  misc_feature (236)..(236): n is a, c, g, or t
  misc_feature (359)..(359): n is a, c, g, or t
  misc_feature (363)..(363): n is a, c, g, or t
  misc_feature (371)..(371): n is a, c, g, or t
taaaaattccaagttaagaaccaaacttccccaatttatggtgaaaccctggttggaagaaatggtgaaatccattgatgctttncaaaaagtttatggagtcacaccctgtaatccccagcactttgggaggccaaggcaggcggatcatgaggtcaggagatcgagacccatccctggctaacatggtgaaaccccacatcctactaaaaatacaaaaaactagccgggcgtantggcgggcgcctgtagtcccagccactcgggaggctgaggcaggagaatggcgtgaacccgggaggcggagcttgcagtgagccgagatcgcgccactgcactccagccttggcgactgaagncggntccgtctntaatt

SEQ ID NO: 594403 - DNA, 131 bp, Homo sapiens
  misc_feature (131)..(131): n is a, c, g, or t
agtgaggtggaggatcgataccaggagtctggcttagtgcgctatccgatcggtgtcgcactaagtcggatcatatgtgactccgggagcgggcgacaccaggttgcctaaggagggttaagggctcgcgn

SEQ ID NO: 594404 - DNA, 197 bp, Homo sapiens
gagacaggtatcgagatcgttatgattcagaccgtgtatcgggatgggtatcgggatgggtatcgggatggcccacgccgtggctctggatcgactatggtggccgggatcgcgtctgatgaccgatggcagcagacgactactgatacgaggctatgacttcccggcataggcacgtgggcagtgtgggctacagt

SEQ ID NO: 594405 - DNA, 1283 bp, Homo sapiens
  misc_feature (1)..(1): n is a, c, g, or t
  misc_feature (719)..(719): n is a, c, g, or t
  misc_feature (861)..(861): n is a, c, g, or t
ngctaattaagccaaggagcattcgctttgttgatgggacccccgtcaccaagatgttctctctctcttgggaggatcccctccatctcgccaaccacctgttggtttgttgacgaaccgtcgccatgtaggtaggtcactacccccggtggcccgcttgattccctcattcctcttctcctggtgacttctttttgcgccctgatgggccgacgcgggggggccctcggtgattaacccagcagttgtgttgcctacccacacccagaggcgtgaactacatccgttattttgcacgcctatctctttatgggcccccttttttattatgggtggcaacccaacttatttagggaccactacgtgtttgggtctacccacaagtaatatgccccatggctctgggtacccccgcgttccccgggggattgtcccccgggggattattctttctcgtacccccaacagcgtgttcccgggtctattgggtgttcctcaatcacgtttctcggggggaatgactctgttagtagtacccctgtcctctctcccttgtacacctcgtgtttttttgggggctcttgttgccacactggcgcacacgagtcccaaagacacctgtgttgtcccccccctttgcccgtatctttgttaagcgcgtcctttgggcccccaaagttaccataccccacgcgttctctctctcagagatatatgtntaaagataagagggaacccttggggcacacaccaaaagaagcgtttaaagattttttcccccgcgcctaggggaacactcttccagaaaccacccccttggccacaagatataacctgttgggcccaagccaagacaccctntctcgggtctcacacctgttttggcgtacacaccacagaccaccctctcccctctgtgttccagcctctcagcgccagacctctgagggccctccggacacacgacacattgtcagagggttccctcggcttagatttagacgccccacacacgcccgctgggagatgttgcttaccgccttctctttgagaactttctaccagaaagacccagacttccctcggagaccctctttggcagacttctagactttgcagatcgtgtaattggcccccagatcattgtttttctcgcctcactttccaccacagatgttctagagatcattgtgagacctcgtgtcattctcccggggtggcccccgggctagatccccggtggttttgtgctccaaaattaaaagcctcagtgaccccattga

SEQ ID NO: 594406 - DNA, 352 bp, Homo sapiens
tacagtgcagtgagctacagcagcagagcgccgcgaagttggggagctccaggaccgagtggcacagctggaagaggagctgcgccctgcctggcagagcaattgctgagcagaggcagaactgtgtgcagagtgccgaggagacgcgggggagtgctggcagccctgcaagcaggagctggagctggtggttgtcagagctggagtgctcgcgtgggcgaggaggaggagtgcacgccgtcaaattgcaaaccgagaagaagaggctacagcagcacatacaggagctagaggcccaccttgaggctgaggagggtgcgctggagaagcttgagctggagggggccgcgcg

SEQ ID NO: 594407 - DNA, 807 bp, Homo sapiens
gttgcttaacatcgagattgcattcccccactttatggtgaaaatttattagttttggatcgacccccgtttctggtgtttctttagtgggggtttctaaacaggatcatacccgaaacttttttgggaagctgttgcttgagatattgggtctttttacccccgaagacctccagatacacttgtaataaagctgatagcatatagtcatacccgttgtacacctgggtgaaaagtatggccgtgggagactaagatgtattaacctacctgtgaatcatatgttgtaggaaaagctgttcccaagtctgaccggacttggattccaagcatgtccagtggatagtagatctgtggcgatatgagagggatccgtgcctttcccccttcattcctgatggaattgttatactagggtaacatttgtaatttttttctagttgtaatgtgtatgtctggtaaataggtattatattttggccctaccataccgtaaccatgtttgtcattttgaaatacttaatgcccagtaaccatgcatgctttggaaatttggaagatggttttattctttgagaagccaatatgtttgccttaaatgctttgattgttcatatccagaaattgattgaacgttctccaaccccgtttacggtacttggtaagagggagaccggtttgggagagacccttgcatcgctgtcccagtgtttcttgcttaagtgcttttaaactggagaggctaacctccaaatattttttttaactgccttctataataaatgggccccgtatgctcccttacca

SEQ ID NO: 594408 - DNA, 245 bp, Homo sapiens
catgcaccatcaactgacacataacaatgtgacaaaaatgcatcttcattcttcttctttatattgagtctcactcatgtcagcaaggctagatcatggcccactgcagcctcgacctcccaggctcaagcaatcctcctacctcagtctcctgaatagttaggactacagacacgtgtcaccgtgtccaactcactttttttttttttttcactcatccctgacaaacatttgtgggctggggg

SEQ ID NO: 594409 - DNA, 112 bp, Homo sapiens
  misc_feature (81)..(81): n is a, c, g, or t
gggaagcggtgttgtgtctgcagctctggcagaggactgttccactagacacgctgaagggactgggggtgggttttcctntcggaccagtgctgagaggagctgttttcgt

SEQ ID NO: 594410 - DNA, 283 bp, Homo sapiens
ctaattggttcttcgatgacgcctcgtgtgcccaggcagtgccctgctgctgggggctccctaaccgaacaaaggccagaggagccacctccccttccctccaaggtcatcagggcacagggagtccacagggaggagcatgagcatcgctgcctggccagtggcctccttggagaactttgttcggcagagcaacggcacaggaggtgagggaggatggagccagggctttcgtgaattccatcccaataaaaacgtaacccgtcatcgaagaaccaattag

SEQ ID NO: 594411 - DNA, 821 bp, Homo sapiens
ctaattgtgtgaggctcttgtgttttagtgggaacaccagagtttgcctatagtttaggcacttaataggaagaagctctgtacagaaatctgaaagttgtttgcttttgttttccccttggtaatcaaaattttactatcttttattatttctggcttttcaaccaaacatgttgctaatccctatttttctttaagtgacacacattctcctgtctctggcttcttcaggctgaaatgacatagtctttctcacccttacttcactcttgagaggtagggctcctttataattacatggttgctctcagactttctgtgaaagtttgggagctgtgtgttgtctggggttgttggttgtttaaaaaaaaaatctggttggctttttttttgtgtagactctgtggtgtcgccgtgatagtgtacgtgtgtgtcacgtgaaattacctggagtgaggattacttgtaattaaaatatttataaaaagaaacaactttattcacagagtccagctttgggactagtctgtatcttgtttaaagtctaacaacatgataataggaagtaaaaacagaaaggaacaagaaattaccactgggaaaatctttttagttagattgtaagcttccctggggcctccatgccaggactgcaaagtgatccaagcctacctgtcttcccacctgtggtgtcccccgtgtgggaagttggtgtatttccccttccaccttcaatttgttagcagtagcaaaccctaaaaatcaaatcaccatcaggtgcagttcaaaggtacaaaaggttcctggacatgaatcccatt

SEQ ID NO: 594412 - DNA, 183 bp, Homo sapiens
ttgaaccaggatgctcaggacggactaagcttggctatgtgaaatgtgtgctgctacacgtctcaggatgggcagttaggtgtctctgacgtacgggatgagagtggctaccgggcactggttcatggaagaggatgcgatgcggagatgcttgctaccttcctttggtcggaagtatgtagt

SEQ ID NO: 594413 - DNA, 159 bp, Homo sapiens
tctcggagctacaactatacacacacgcacacacacacatgcatatacacaacacacacaacacacgtgtgtatcgatatacatatgtgtgtgtgtgttgtgtatatatatatgaaggaagagaaaagatttactgaagcctgaagaatagtgagtgtt

SEQ ID NO: 594414 - DNA, 119 bp, Homo sapiens
cgggctccttcaccccagtggcaaagacccccacccttgatttctttctccctccatcctttggggttctggccttcccaactggtttttgctcttttggctcctcttgggctgacgca

SEQ ID NO: 594415 - DNA, 136 bp, Homo sapiens
agagaccctgtcctactcttagaatctagggctctacctcttcttcttctcctcctcctcctccttctcatcactctcctcatcgtcttcgtcatctagtctcactcttgaggcgaaaggaccctgtgatgcattc

SEQ ID NO: 594416 - DNA, 542 bp, Homo sapiens
  misc_feature (38)..(38): n is a, c, g, or t
  misc_feature (185)..(185): n is a, c, g, or t
  misc_feature (211)..(211): n is a, c, g, or t
  misc_feature (261)..(261): n is a, c, g, or t
  misc_feature (264)..(264): n is a, c, g, or t
  misc_feature (268)..(268): n is a, c, g, or t
  misc_feature (312)..(312): n is a, c, g, or t
  misc_feature (321)..(321): n is a, c, g, or t
  misc_feature (334)..(334): n is a, c, g, or t
  misc_feature (360)..(360): n is a, c, g, or t
  misc_feature (420)..(420): n is a, c, g, or t
  misc_feature (436)..(436): n is a, c, g, or t
  misc_feature (476)..(476): n is a, c, g, or t
ttttttttccaatgtttgtagcaggattttattttganacactgactgaggtttctctcattctcctaccacctcacacagtcaggtaccctcaccatcctcaggaaaaaaagaaaaaaaaaaaaaaaaaaatatatatatatatatatatgtgtgtgtgtgtgtgtgtgtgtgtaaatgtaaanatgtgtgtgtgtgtgtgtaaaaaaangtatatatgtgtgtgtgtatatatatatatatatacatatcttatatgcncancccnctaggaaaaaaggttgttcaaggagcacaaatattaaaattttngcctttganttccaaaacacancctttaaagtcgtggtaaaaataacnatcttgaaaaacaacattctttaacagccaaactttctgaaacaggaaataataatggcnccatatatttagcatncattgtgtgccaggcacagctctgagtcccttatattganacctcaggaaaaccctgatataggtaatgctgttgtctccattatatggttgaagggaaccgaggc

SEQ ID NO: 594417 - DNA, 285 bp, Homo sapiens
  misc_feature (136)..(136): n is a, c, g, or t
  misc_feature (146)..(146): n is a, c, g, or t
  misc_feature (165)..(165): n is a, c, g, or t
  misc_feature (224)..(224): n is a, c, g, or t
  misc_feature (227)..(227): n is a, c, g, or t
  misc_feature (276)..(276): n is a, c, g, or t
ggcctgttttggttaaggtttttttttttattccagaaaaaaggcccagggataaccttttggagttcctaaaaaaactggcttttttccctactatacataaagggaaagttttttttttttatgggacccctcngctggactcntgtattaaaataggaatgngaatgctatatactctttttatatccaaagtttccagcccttattttttttttatgccntgnttgttttttacataaataaaatgtttttttgattgaataaagccaaatnctccggtga

SEQ ID NO: 594418 - DNA, 979 bp, Homo sapiens
tgagtctaaataaagttgcatttaaataaataaaatatcaaatgttttaatattttttaaaagtatgtgtgaacatcccttgacaaattgttttcatccagagaaatttgctgtactgagattatattataacaaagtcttagacaaaatttggttcccatgattttgtccttctcatttggaatgattgcagatcctggccaatttggagcaaggcttagcagaagacggcggcatgagcagcgtgactcaggagggcagacaagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctccagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcactgg

SEQ ID NO: 594419 - DNA, 1041 bp, Homo sapiens
cagcttgctccttttctcaggttctggcttggaaacggggcccccggtcggaccattgggcctgtgtctgggctgatgctgagcagccaccctcctggttctctgatgccgagggtctcttcccaaagccacctctggtcccaatgcgagtgctgtattttctgcctcagtgcagcctgcagcatattcagcattccaggccgaaatccagtggtgttaacaagagggatcttttaaagttaaattagaattcacaggacccagtaattgagggctagaaagagcctcgaatttatttgtgcacttacaggctgctcttaccttgtagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctccagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcactgg

SEQ ID NO: 594420 - DNA, 247 bp, Homo sapiens
cggctgcgtgctcgtgcctggagggcagccgcccagcagatgtaccagagcctggccgagctgggtaccctgccccccgatgactggtgagctgggcctggtgccctcccctcttctccctgtgtggcacagcccccacgctcctgcaccctcactgtgctacgtgggtgcagagtgaatgcccacctgagaggcagacctgtggcacgcgggagtgccatgtgccccctgtgcgcagagcactttc

SEQ ID NO: 594421 - DNA, 768 bp, Homo sapiens
ctgaaattagactgcagaagtccttgctggttgcagaatggttgtaaatctagtttcacggcctgtaaacacgtgtggctgctgaaaagaaatggtgaagattgagctaaaatagacttgtccctggaagattatgtgctggccgtggaggcgtatcattcggttatcaagtattacccagagcaagagccccagctgctcagcggcatcggccggatttccctccagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcactgg

SEQ ID NO: 594422 - DNA, 424 bp, Homo sapiens
gctcacgaacatgggctatgccgcaaggccatgacggcggccatgacaacatggacatcgatcaagttgatgagttaatgcaggacattgctgaccagcaacgaacttgcagcaggagatttcaacagacaatttcgacaacctgtagcggttcggagtatgagtttgacgagagctgagctcatggctggccttagaagaactagaacaggaggaactagaccagaatttgctggaactcagtggcacccgaaacagtacctctaccaaaagttccctctatagccctaccatcaaaacccgccaagaagaacgaagaggaggccgacgacatgaaggaatcggagaactgggctggatccatgtaatggggtccagcgcaggactgggcccagacagactgaggtggcctgcgcagcgagca

SEQ ID NO: 594423 - DNA, 886 bp, Homo sapiens
  misc_feature (252)..(252): n is a, c, g, or t
caaatgtaatgaggggaaaaaaaaagttggggggaataataaataatggataggggagagtgtaatttaaaataaagggtgggatatttggtggataggaaaaagaagaggacttgtggagcgaattgtagaaagagattgtagaggaaaaaccttttagaggtgctcagagcttaatactcgggggcacaaatccgggcgcacacccctcgagaagagattgatatagagaggggattgaaccgaaatttntctcgagatatcccccacaggttagccccacgagaatgacccccgaacgctagggtgatattgaacttttggcaccacgccccccagaataaaagggacaaacaagattttttaaacagttttagagaaaagaagaaaaatagcgcccccccgtttggacccccttactgtctcacccctcccccacatgtccccgcgtttgctcccaagaattctttataaacacgtggggtctcacccctttcgaagtttagaagaggccccgcccggcccaccacgccgtggcgccatatgccccacacccgccagtagtgacacccgccgctcttctccacccaccccctgacgcccaacccatgagaatttgccaaacagggagaggaataaaaagatactcccaacctgtcgccaggcccctgctttttttctcttaaaagtacctttaaaaaggaaatttgtttgtatttttttatttaccttttataatttttgtacatattgttagggtcacccctttttaatgatctcggatgcacccaacccgccttcggagcgttctctgtcccacctcatgacatttacattgtggtgggaccctgttccattataatctccaaggagaaaaaaaaccctt

SEQ ID NO: 594424 - DNA, 1068 bp, Homo sapiens
cggtgggtttcctgacatgcgtgataagagtgggtttgagtttggtttggcttgttttttacagttgaattctatattatttggtcaaaatattactttgcaatttgcaaatgtggtggcacctaccattttactagccacaagtaactcataagttgacgtaggccctgctcatattataccaatattttaagtattttatgtttcatcttattagttattcattttattttatctaatgctctgccagaattcattccaaaaggtaaaaattactaaactataagactcttaaataaggcgtgtatattagcaacttagtttctgacatatagaacattaacattccactgtatcttaaatgtcttttgcctttttattaaaaaatgattaaatggttactgaagttttcctctgcctgacatataaatgtcttcatattctaacatgatattagggaactaaatatatgagtatagacttaatatttcttttgtcaactaaactgactaaattttgtcaaagcagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcactgg

SEQ ID NO: 594425 - DNA, 235 bp, Homo sapiens
tatgctgttactgttaggaagaaagctggggactagatgcctctcagtgtaattgcctgcacttaattattctcacactccacagtggactgattttcccctgcattttccacatgcgttccaatgcggggtctcaatgtgtacctcccatgccccaattcctccatgcctaatctctgtgcctgcatgttatgatttaatactgcaaattaaactataaatactagaatttcta

SEQ ID NO: 594426 - DNA, 929 bp, Homo sapiens
cgggtacagtggctcatgcgttaacctcagcactttgggaagctgaggcacgtagatcacttgaggttaggagtttgaggccagcctgccaacatggtgaaaccccatctctactaaaaatacaaaaaattagccaggcgtggtggcagtcgcctgtaatcccagctacttgggaggctgaggcaggagagttgcttgaatccaggaggcggaggttgcggtgagccgagatcgtgccactgcactacagcctgggcaacgagagcaaaactccatctaaaaaataaaaataaataaaaactagagtggctttaatgtgcgagcctgaatgcaaaacgcagctcaccgcctctacctggagatcaggaaccccgggccacacagggccatacgctgggtctctgtgggatccaaagcccctgtgggttgtgttgggggacagcagctcctgggctttccccgctaactgccaccgttgcttgtgttacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcactgg

SEQ ID NO: 594427 - DNA, 1039 bp, Homo sapiens
  misc_feature (15)..(15): n is a, c, g, or t
  misc_feature (223)..(223): n is a, c, g, or t
  misc_feature (265)..(265): n is a, c, g, or t
  misc_feature (269)..(269): n is a, c, g, or t
  misc_feature (276)..(276): n is a, c, g, or t
  misc_feature (283)..(283): n is a, c, g, or t
  misc_feature (289)..(289): n is a, c, g, or t
  misc_feature (304)..(304): n is a, c, g, or t
  misc_feature (306)..(306): n is a, c, g, or t
  misc_feature (330)..(330): n is a, c, g, or t
  misc_feature (343)..(343): n is a, c, g, or t
  misc_feature (361)..(361): n is a, c, g, or t
  misc_feature (363)..(363): n is a, c, g, or t
  misc_feature (371)..(371): n is a, c, g, or t
  misc_feature (376)..(376): n is a, c, g, or t
  misc_feature (400)..(400): n is a, c, g, or t
  misc_feature (432)..(432): n is a, c, g, or t
  misc_feature (445)..(445): n is a, c, g, or t
  misc_feature (448)..(448): n is a, c, g, or t
  misc_feature (463)..(463): n is a, c, g, or t
  misc_feature (476)..(477): n is a, c, g, or t
  misc_feature (482)..(482): n is a, c, g, or t
  misc_feature (487)..(487): n is a, c, g, or t
  misc_feature (492)..(493): n is a, c, g, or t
  misc_feature (497)..(497): n is a, c, g, or t
  misc_feature (555)..(555): n is a, c, g, or t
  misc_feature (569)..(569): n is a, c, g, or t
  misc_feature (624)..(624): n is a, c, g, or t
  misc_feature (681)..(681): n is a, c, g, or t
  misc_feature (834)..(834): n is a, c, g, or t
  misc_feature (1032)..(1032): n is a, c, g, or t
ttaaatataaaatanaatcacataatttcaaaattaaaaaatgtacaaaagagaaagtaagtgacaaaaaaccttccctctcctgtcctcaacctactggttcccctcccaaaaataaatctagtgttacccatttaattctagaataagagcataacataaagcaattaatgtttttatattctactacctttctgaaacacaaatgaggaaagtgacgctnataacacatttctgatgagcttgccttttatcacctgaagantatnacatatnagtatanaaaaanatacaattatttttnanctgcatactattgtattgtaaggntgtatcagaattnatttaaccagtcctttananaaaaaaanatctntagtatctcatctcttgcaattanaaaaaacccatccccaatccagacctcaagangaacagcagtaanggnaataaagcccaaacntggaccaggccannccccnccccncccannccangcccctccccactaggccagacccccacctcacccagggcccagctcattcgcatgcntgaatgtgattggncagcccctcctggctgggtggctggagttgtaggggctttggcttctcatctttnatgcccaccctttgtttccactccagcctcccaaacaggctgttgcagaatacaganccctggtacaaaatggccattcttcattatcattgcacccccaaatcacttgaaatgctaacttgagctgctgctgtcacgatgaccatcctcctctatagagagcatgaggcaggcagacacaaatgcacagaagcagctgtcctgaaacanacccagccccaggacaggggtaggagcaactcctactcccaataagcaacagacacaagggaacgacacacagggattggccactctgattaggggtcccgtgaccttgagacttccatagggctggagatgagacggaacttgactgaaaactgagggctgggggagtacagggggctgggacatagggatatcccncaggatt

SEQ ID NO: 594428 - DNA, 822 bp, Homo sapiens
ccacgcgtccgggaccatgcggaaataacagtcagacgtgtggtggctttgtgaggtcacactcagccggataccagagggaagcagaacaaagtagtgtgggcccttcagagagaggaggacagagtggagcggaaagaggcatgataggtcggagtagctgcacgaggcgcttgctaggggagtggagacggagcgatccaggccgttactggctgagaagtgagggcaagggggaggtggcccatagtagggaactctctggcagccaacatatgcgtgacttgccgaagcatgcacacgagaaaaggctgcatacgccatggtaaaaggacgtggacacagtggttgctggggatgaagatcgcaccactgtggactgacagtgctcaaagagccagcagccgggacacatgttccgggcaatgattaaaagacagtctccgagattccaagaagaggacgtggtagaatcagatgctccaaggggagcggaccacacattccaggaagcgtcaggggagcaaatagtcgggctattctggcaggcatgaagacagtgtacgcagtactgtgattgatccggactggcaacacccctgagtagatgagaacagaatcaggtctagtggccacacttcaaggtacccagggcccggcgccgaggagcagagaagccggggcagctaatatagggattactaccgacaagccgtggccttaagcccggagagggcccaatggcacttgtcagtccggagctggatggaaaaacctgcagactggcctggcagagtgcgtgtgctgccaattgctgatggc

SEQ ID NO: 594429 - DNA, 487 bp, Homo sapiens
ccgacgctctctctgtggggtagctgtgcctcctcgactgtggtggagcagctcagcagtgtaataagcttactcgcctgaccttgtgtgtctctctctcatcctttctcttggctaaccttcatttggtgccaaaacccaggaaggggataggctctggctgggcgtccttagaggattctctctctctctctcctatcatcccttacccagccaagctccccttcccgaacctgctaaagaccctaaggatctcccaaaattctcccattgttggccacctcatccaccatcaaagcctctgagaggggtgagtaagagagactattgcctattacctggaacccttgagcatctcttcactcccaaaagacccagcgctgggacatgggcttcctctggcctccaggcatatggttacctctgtttcctggacgcctgactccgcagctaactcctctattccatgtgctaaggcgtggatacc

SEQ ID NO: 594430 - DNA, 255 bp, Homo sapiens
ttcccagggattctaggatggcctgtggaaacccaaggcaattcatgctcagatgtgcctcatacccaacaagtctagaattcttattacaaaattcacaagagaatgttgctttatcttaggatagctttcaaagacttaggacttgaaggtggagagtttggaaaccctctccacctatcctcctcagccaagaattctcccccctctggggcagaggctacacatggcttccttttttgagaaaaaaaaaaa

SEQ ID NO: 594431 - DNA, 457 bp, Homo sapiens
acagttatttatcttagatggagacgcttctgacggagtatactacgggctagttgagatataatgatcagatatatattctagaacactaggacagatgtgtctcaaatcatctgtggtgaaggacatttttctattttatttctaaaccatcagagactgatccagataatcaaattataaagacaaaatacaagtccatgtttctacatataagattcaacagcatacaattgctgtaaaattgttacgtaagtttttcagtgtgtactctcagtttccatactcatcatagaccaggggtaagtgtaacaccagcactggtttgcacgacctactcctttaccgtacgcactgttcaaagacatcacgtcttagctgcagatggagacttgattggaacgcggattgaatgtgggcagagatcagtagcgcggctatttctctgatccaggct

SEQ ID NO: 594432 - DNA, 296 bp, Homo sapiens
tccactagtgtaggcatattaagaatattatgatgcaacatgaagactattgcgagcaggaacggagatccttgagaaggaagaaaaacacacttgtggtttctctttgcatgactggtgaagaccttttcactcatggtcagttctcagaactcctttgaaaaggactacagagtgcaatttggccagatcagcggtaccgagtaggtagctccaacacagttgttagaggggagaaacgcttatcgtagcaaaaatactatgaaatcatggcgaatttgaaggcccacgataaa

SEQ ID NO: 594433 - DNA, 178 bp, Homo sapiens
cccccccccccccccccccccccctggggggttcccccttgggggaaaaggggggggggtttttttcccccgtttggccccccggggggggggggggggggtttttttggggggggggggcccccccccccctttttttgggcggggatttccccctatgggggttttttccccccca

SEQ ID NO: 594434 - DNA, 704 bp, Homo sapiens
gcataagagcgagagtgtgtgcagggacactttgcatgaagaaaacgtctttaaagttgggtaatagaggacagaggaggcccgagaagattgggtcatacgacgcagccctgcggaggggggaaagaccttggaaaataaggggccttttgggaggggacagagcggatagtatggggtaataagccttgtaagtaatgccctgaaacgaaacggggttctatgaagcctttgaccttaaattaattggtgcactggggatagggatgaaccggtaaaggcttagggtgtatcgtctccaaacgatataagggatcatcatggagtccgttactataggtatcgggtggcaatgtgcgaacgtgtactcgaaagaggtgtcaaagagatgttagaggaggagagataaaggaggtgtcagattttggtcatagggacgcaatgaaggaaagtgcgcatacaggtacactggggggcgatatatactgcgtgttacagacccgacggtcagagggatcagtgcttttagttatagagagtgggcctgcagcctctgaggcacctgcgggtctaagcatagaaggtcaacccccacactccccatcctccaacccgctggtctcatgcccaaagaagagttgaaggcatgggagccaacgttttattgaagaagccacagagggtgaagttcaataaacacaagt

SEQ ID NO: 594435 - DNA, 222 bp, Homo sapiens
tgcctgcgtagcccagctgtcttcgttgagtggtcttcccgactctccgcagacttgatgaatagcggcaggtgtaactccgggtctgcactagcagccccaatcgtctgtggacacctcagatgtagttactcttgcacttcatgggacaaagagacatccctaatagtcaaataatctaggtctttaggcagatggagagctacaatcttgctgaaatcc

SEQ ID NO: 594436 - DNA, 355 bp, Homo sapiens
cctggcctgctccggatgatggaaaccgcttatggttcaaccgcagccgatgggcattggtcactccgcgacgcctatgatgtgttggagctggcccaagtcctgcacctcgccacgctcgacctggcgctacagcccgccgatgtcgttgcggccctgaccgcgctcaccgcatccctgccgacgcatagcgtgcgcagcgaagaacagatcgcgcgccagcaattttcgacaccggccgcgattggctatattgccgcgctcgccgctcgcattaccgccgcggataccgtcctggaaccctccgccggcaccgggctcctcgcggtattcgccgcccgcgttggcgccaagc

SEQ ID NO: 594437 - DNA, 291 bp, Homo sapiens
acatgaagtggatggcaggattgaagacgaatagcaatgagggaaatgtggcattccataaagccgagattccttcatcgcgaatggtcggatgaaaagcatctaagcaagaaatcagggactgttgacaagcatgatcacaatcccccaactagagaagacgacatgaattctgtggaaatgtacccagaacacaaaccatacgggttctataaagatttccttcttgcagccggttgcaagggctcacgcctgtagtcccagcactttgggagtgcgaagcgggtggat

SEQ ID NO: 594438 - DNA, 129 bp, Homo sapiens
aggatcccccggagtattacgttacaaatatgggacattattcctgaagcctggtatgataagaatataacttcagggatgaccgaataatcagtaatagcgtttggtagtagaatggggctctcctcc

SEQ ID NO: 594439 - DNA, 329 bp, Homo sapiens
  misc_feature (184)..(184): n is a, c, g, or t
acagcttcctttgtgcttgggacacagcacaagttccctgtcttcatgggcgagtatatacccagggctgagctgcaggatcaggttagggcgagcgcaccttccagcccagcttcagttcagcctgtgctgcctgctggacttggcccctgccacctcctgctcaggtgtccgctatccaccnaagggctccctagggtctgggcaagggacctgcttctattagcccttctccatggctgccatgctctccaaaccactttttgcagctttctctagttcaagttcccagactctataaataaaacctgcagccatgactttcaaaa

SEQ ID NO: 594440 - DNA, 537 bp, Homo sapiens
atagctggggaggggcatggtacttcgaggaagtgaagtacaagcgtggtcttggttgataggccaggttgtctaggagccattccaggtagagaggcaggagctacagtataattagtaggctgagaagtttgggcagtgtaagtttgtgcaggataattggtcgcctggtactgctgtggcggctgagcaggcagttgttgaggctgaccagaaaaggcaggagctggtgcctgggaagttggttgctggccatatccctggaactgctgaggttgtcggggtccagtctgctgactatagcttgctgaatactgaataccatactgttgaggctgctgaggtggagcctgcggttgctgtgcaccaatagccggtctgttgctggtactgtcggtacatctgaccttcaatctgacctgcttgagtctgagctcctgtatatggtggctgctgtggctcacacgcctggtgggtgagctgctgaggaggaggaagcaatgctgtcgggtgtacctgaacgatcttctgcaggag

SEQ ID NO: 594441 - DNA, 1210 bp, Homo sapiens
catccaggctggttgaggaagaggttggagtcggtgcccaggaggcgtcgtggttaacagacttagctggataggccttggtaggatagcttgaggaatggctacgccagcatgaagagtgagagcaggcgatgagaagtcgattgaggagttcgagcgcaaaataagtagtgaatgaaaagaatggaaggttgagtgagatctccaactgaaggaggtaaagctacatggctggagatgcgcagatcagtgaatatgaatgaggtggcacgataagcgtgtgtcatgatctgaggatgacgatccgtggtaaacgctgcagatggcacgactgagtgctgagttctcagacggccatttgtgccgaatgctttgagagtagaggacctttgtacaagagctgtgacgaagcaggcttgagtgtcacggatagtggcgtccggcggggacgtgactcgcagcagggaatgagggatcatgaggaagagagtcaaggtgccttgcgcgagcatgcctgaaggaggctgaggacgtcgggctgagggagcggagagggcagaaagctaagatggagaaacggcatcgacagactgaagaagcacgaagctggaaagctgcagaagactgggagtaccaagggccatcagcgaggagctggatccaggcgtcgtcaacgatatgacttcgatatacgggtctttggttcagcttctccccaatgattcccttcgggggagccggatggttcaaacctgctccggagaaacggcagtagaggcaagtctccaggttgccgcgtgttacaccctcgtaagaatactgcccttaaacggggcggcccacaggggcgtctcgcaatgggaacagaagacactcgggcccgggtgacaaaccctgggtgtcgcgctcgaccacacagcacacaagcacaacaactgtcgggggcagcctccaggagaccccaaagaacaggttggcggggcgcccaaagtaaaaacaggagccagagctgcaagcaccaccggcaacctgtcgtgctcccacaacaggggggagcacgcgaacacggcgagtgcttgaaaacgcgcagagcgacacgcgcgagctagtacggcacagtaactggtgagagcgtgacagcagtgaatcgacgcagcggagcactagactcgacgtctgcgcgccgacagcacggggcagagccggcagc

SEQ ID NO: 594442 - DNA, 997 bp, Homo sapiens
gtgacgcgcgcgtgggtccgacgtgatggcgccacccgcgcggtgtccccaggatgttaccgcgggcaacaaggaggcgtcagcaaaccctcgttgggaggcctcccgcgccccaacccaggggccccgaagacaaaaccgggggagttccggggataattggtccccacaccccgtcttgaatgcgcgccacaatgacgagggggaaaacacacatcaggcacagcgaaaagtattcggtcccgcagcgccccaaacagcaaggggtttctccctcgtgaggacaacacctcctatcacacgcgcctggggtgcgtggtcccccaagacgacacctcgcttcgggaaaaccttgtgttgggaaaaacaaccgtgcccccgcttttcttttatgtggatccggcgatccccggcttttaaaggatctgtttgcatcgtagctagacaggcttgtcattccggtgcagatgagacatctcggaaatcataatccatacggaacgtggatctttgtttatcgctttcaaaagcgacctggatggtttactcacttgctcctcaaatgcactcgtttgaaatgtgaggataaagacccacagaagtagaagatctacttgcgggcgtctctatcattcgatagtaattgccgaaaccacttcttcatattgcgggtaattaataagagccagtagtttaaaatggcagtgaccccttcttcatgagttgtttgcttgattctgtactctggagaacacaaacatcttatgtctcaggcacccacaaatcgagaaagtgaatacattgctactagtcgagttcataccatgtggggggataccatcgagattatcaaagtggcttccccacgcatcaggtatatgcacgtctgttggaggttgttatatacacacattatacgaattaaattgttttgttaatacatttaaaaaaggcgccccttttttaaacccaacaaaaatttgttccaaccaaaaca

SEQ ID NO: 594443 - DNA, 339 bp, Homo sapiens
ccccttggcaatgtttttgcccagattgcatactttaagatttcccagcgctggaacttccccagcccttttttccgcctgcacttcaagattccacagacccatggggtctgtggccatttttatgctggacccagtgacatgacccctgtggcccaaatgcccccgtatgttaaacccccatggacatgtgtcccagccccagtgttatgctctgtggctggctccccttttcttagttccggggtgcaatgggggagggagggagggaaagcttcctcctaaatccagcatctttttgtttctgatgttccataaaaaaatagttgcccaggctta

SEQ ID NO: 594444 - DNA, 442 bp, Homo sapiens
  misc_feature (423)..(423): n is a, c, g, or t
gatcaggagtatcaatcacctgatgcgagataatacggatgtgtttaggagtgggacttcttaaatcacatccgtgttactcgcatcaggagtgtcgatctcacactgagctcaccatagtctcatcagaaaacaaccgagttccacacattaaattcaatgcacgtgcgtcattacaagtgtttactgggttctctattgtttacccgtcctacaaggcgcatcagtagtgacttctgagttgcgtcctctttcaacacacttctccgtactgcgtgatctttaactggcgtcaacatatttattgctagctcacaggtccttacaccagtggacttcagcgttatatattggcctgaactgtttaactcgactattcttgggctttaattccggtcaagataatatatcttgacatttgtnatcacaatactatcatgta

SEQ ID NO: 594445 - DNA, 462 bp, Homo sapiens
cgtggagccttaaccctaggctgggagtttgagaccagcctggccaaaatggcgaaaccctatctctactaaaaagacaaaaattagctgggcatgatggctgggtgcctgtggtcccggctactcgggaggctgaggcgggagaatcgcttgagcctgggaagtggaggttgcggtgagccgggatcgcgccactgcactccagcctcagcctgggcaagaaggcaagaagagcagaactccatcttaaaaaaaaaaaaaaaagggaaagggaaagggaaaaggaaccaaggaaattgcttgaggcttgaagggaagagaacttgcaaccacttcttgtgaccgggtgggaatagctgtctccaacgggaatggggatagcaatcctgatatggatagagattgattgtatttgggacctagacaggtacgcaaggggttaccaatttgacgggagccggg

SEQ ID NO: 594446 - DNA, 164 bp, Homo sapiens
tcgatgagaattaaaaggaaaatgtgatatggagtgctagttcttttgcggcactgaaactttatatataacatccaccacgtgataacagcaagataacagctgggccaggaacggtggctcatgcctggaatcccagcactttgggagatccagacaggcag

SEQ ID NO: 594447 - DNA, 174 bp, Homo sapiens
atgaggatggtagcatttactactcacttatgctttacttaccactgtcttctactgcctgaatttacccaaccgtcataggtgttgatatattttcacactttctacgtatttgcacccaagaaagtctgtaaaagggacaccccataattagttccacactacagcatgaga

SEQ ID NO: 594448 - DNA, 1023 bp, Homo sapiens
atttgtgtggggtgtttgcttctccccacctatacattcttctctggtgggtgtcactctctccttatatgggggggggagggggactctgtgtgcgccgctgtggtgcgcacagtctcggtggacacacgattgggtggtctatactcactgtgggtaggtatattgctcccctcccagctcgggggtgaggaggagattgttcgtctcctcttagtttgtggtggggagggaggagagcccccttctcctctcttagagagagtattggtgtgtctccccctctttctttcttgggagccgtctctcacaccctgtctgctcttcttagaagagagaggcgcgccccccccccctgcgaggagagaacacctctccctccccgtgtgtccacacaggccgcactatatatctcgctccgcgctcccactctcttctctctgtgaaagagagagttttttttagaggcgccctctgggccaagagttggccacctcgccacaccacagggggtgggagagctctcccccgccctctcttgcgcctctcgtgagagatcctcgggagaaatatgtgaagggatcctcttttgtgtttggggacaccccacgggtcttcttgtcgccacaaatttatatatatttgtagaaagagggcggaaaaacgagatatagaagaagaagaggccgcgccccgccacccctctccccgggggcccacggcgggttttctttgttgcgcccccccgctgtgtcccccccgccccctcccgcgcgggggaatatttctccctccgcgcgcggcgcgcgcgagagaggctccctctctcttctccccgccctcttttccgcggagggtgggaaaggggggggggttttttttccccccggtttcccggcccccccccccccccctcggtgtgtttttttgggtcctcggggccccgcccgcaggggcccccccccgaggtttcattaaaagaaaccaagtgttttccccctttttttttcccccccccccaca

SEQ ID NO: 594449 - DNA, 254 bp, Homo sapiens
ctccagccgtgttggtagcagcaggtaacagcgatgagtggtcagttgcccgagttcggaatgatgaaaagcatgggcctgcaggatgagccaaagcgaccagcagtacaatctgtgtaatagcaagtgcataggccagaaggctgggctaagtctggtagatttgagctaaagccaagatagccatagcgaatggtgcaccagcaaggaagtgatcagcactggggtcatgtaggcgggtgggtcccaggacg

SEQ ID NO: 594450 - DNA, 191 bp, Homo sapiens
ccgtattaatgctagagaccgagtgtctcagctatatcaggacaacacgggtgtcgacgtctggttcaaagagttggagtatcaacactgatggtgcagttcatttccaggagattcctcattctggtgattcagatgggtcgtgggagcccataaaaaacgccattaatcaatgccatcggtcaacccac

SEQ ID NO: 594451 - DNA, 224 bp, Homo sapiens
  misc_feature (112)..(112): n is a, c, g, or t
cattttgccaaaagctatcccacaaatctctaaatggggcagggaagaacaggagtacacacaaatataaacataaattttaaactctggggacatcttcaaaaaactctgnccaggtaaggctcaaatcaagcagataaaataaaagacatcagtactttttaaacttgtactactatagatgcatgccacaagaagccaccattcatatggagataatctcc

SEQ ID NO: 594452 - DNA, 760 bp, Homo sapiens
gtcaacccaacacagtgcatgctcataaggaaaggttaaacaacaatagtaaaatggaactcggcaaatcttaccccgcctgttgaccaaaaacatcacctctacgtcatcaccagtattagaggcaccgcctgctcagtgacacatgtttaacggccgcggtacccataaccgtgcaaaggtagcataaatcacttgttccttaattagggacctgtatgaatgggtccacgagggttcaggctgtctcttacttttaaccagtgaaattgacctgcccgtgaagaggcgggcatgacgacagcaagacgagaagaccctatggagcttaaatctgatataatgcaaactagtacctaacaatacacgcacgaggtccataaagctacctaaacgcatgcgattaaggataatttccggttgggggcagaccgtcgagagcgagaacccaaccgtcctgagcgagtacatgctaagacattactagcagtcgaaagcagaagctactaatactcaattgatccaattagacttgagcaacggaacaagttaccctagggattaacacgcgcaagtcctattctagagtccatgatcaacgaatagggtttacgatcctcgatagttggatcagtgacatcccgaatggtgcagccgctattgacaggttcgtttgttcaagcgatttaaagtcctacgtgatctgagttcagacccggagtaatccagggtcgggtactatctacttcaaatttcctcc

SEQ ID NO: 594453 - DNA, 146 bp, Homo sapiens
tacagatagcgatggcaaagatcacatttagaattagacagaaagaacacagcatccctgcctcgtcttttgtatagaatgtaagaagagggaaagtagtcttatttcatatatcaaaattctgacttaaatgaataaaatttagt

SEQ ID NO: 594454 - DNA, 376 bp, Homo sapiens
ggggggggggggcaccggggaattttttaaaggggcttttttaaaaggggggggagggtgtgggggtccaacccaacccccggtttaattttcaccccttttccaaccccccttgggtttttagggccttgttttccggcccctttcccctgaaaaccccccccaaaggtggaggccaactcccccggcccccccctgtttttcccggggcccctttcccccgggtttaggggaaaattccccaaaaacaaaaaagttttttccccccgggggggggggggggaaaaaaacccttaccctttttttttggggttaaaaaattggggggttttttatttttttggttggggggaaaaaaccggggggaaaggcccca

SEQ ID NO: 594455 - DNA, 329 bp, Homo sapiens
tcactcatccatgctcaactaaactctttaaatttaatttggctgaagtttttcttttaacagtggccatgaccaaaaacatagataataagtatattcaaggatgtgaagaaattggaaccctcacacattactggtgtgtaaaattacactggaatgtaaaattatacagtcgttttgaaaaacagcttagcagttcctgaaatggttaaacatggagttaccacatgacccagtaattctactcctcactgtatacctgagaagtgaaaacatatattcacacaaaatcttgcacacaaatgttccatggcagtattatttataat

SEQ ID NO: 594456 - DNA, 272 bp, Homo sapiens
  misc_feature (242)..(243): n is a, c, g, or t
tagtaagattacacatgcaagcatccccgtgccagttagttcaccctctaaatcaccacgatcaagagggacagagcatcaagcacttctgcaatgcagctcggaaacgcttagcctagccgacccccacggaaacagcagtgattaacctttagcaataaacgaaagtttaactaagctatactaaccccagggtctggtcaatttacgtgccagccaccgcggttcacacgcattaaccnncaagtcaatcaggaagcccggcgttaaaa

SEQ ID NO: 594457 - DNA, 279 bp, Homo sapiens
  misc_feature (2)..(2): n is a, c, g, or t
gntcaggaatatgggggaagtatgtaggagttgaagattagtcctgcgtagtcggtgtactcgtaggttcagtaccattggtggcaattgatttgatggacagggagggatcgttgacctctgtctgtaatgtaaagggatgcgatagggatggagagggcggatgaggactagtgatgatggggggcagtgatagttcaggacggtttctaatttcctgagcgtctgaagatgttaggtataagtatagtttgtgtgtgtgagtgtaacggaaaaggg

SEQ ID NO: 594458 - DNA, 178 bp, Homo sapiens
gacttccatcctacgagcgccaattgatttgatggttaagggagggatcgattgacctcgattttgttatgtaaaggatgcgtagggatgggagggcgatgaggactaggatgatggcgggcaggatagttcagacggatatctattatcctgagacgtctgcagatgttagatatta

SEQ ID NO: 594459 - DNA, 615 bp, Homo sapiens
cctcacggatgtaccctcaatgaaaatgagaattaatcaggaagttattagtcataccacagacggaacattccaggaagagggtagacatgcacatctcccatctaaaactcttagggccatatgtgttttagaatttaggagtttttcgtttggaaagttaatacagtacacatatcatatattatgacgtatatcccagcaggatctgagaaagccctttattaaacatcatttgtattgcagaatgcgttaatattcgcactaaaagggtttatgtaaatgactgaaaaagagaatgaaaagacaatccacagactgggagaaaatctttgcaaagcatatatctgacaaagaatttatatacagaatatataaagactatcagaactcaatattagaacaaataaccagattaagaaaatgtgcaaaagacttgaacagacactctaccaaagaagatatatggataagtacagaatgtatttaacattgttagtcattaagaaaatctacattaaaaccacgagatatgccacatatctattaaaatgactaactttataaaaagaatgacgatatcaagtgtcggtgaggatatggagtaacaggagg

SEQ ID NO: 594460 - DNA, 846 bp, Homo sapiens
agcgggttctgccataggcggcttagagggaggcgcttattcgcctatacctactgtagcttctccacgtatggaccctaaaggctactgctgctactacggggctagacagattactgtctcagctctaggactgtgcgttcttccacgtagaacgctcttctgagggaggtacacttcacaagaaacagtggcaatggaaacaacacagtgctgtagtcatcctgtaatatgctccttgtcatcaatgtatacattcctgctagagtgccatatccacttgctttaagctcaagtcgcatcttactagtgaagtattctgcgcaatgagatggaaatacacatgtatgattatcttccaactactgtgaatgtgtgctcagaactggtgacagctagtattctgtgtgcattgtgtcattctgtgttagtagacgaaagatcatcaaacgtagaaatttgaagtatgcttcctggaaggaattctctgatttcatgaagtggtccatgcctgccttccgttatatttcctggataacttgcacttgtcttctagtgtcctgtcctatcttcaaccagccatggctgttatcttctcaaatgttagcattataacaagagctcttctatacaggatagtgctgaagacggcgtctaaacggggatccacgagacgcgtacccgtaccgtgactttatattctgtctattgtcgggccttgactggccggggaactaatacttctagcagacacaaatgtagtgctggacgtggaatttcatcaacgatgccctttttcagacgcttccaattcatgccttcgtattcagaaagtgaatggtaccc

SEQ ID NO: 594461 - DNA, 145 bp, Homo sapiens
actcagtctgtccagtcacaccttgtacgcaggtagaaggagctgaaatagtaatttacttgcataagtctagaagagagtacaaataaaatcaaagagaggagcatacctaacatatgaataattagtttctatcagataaaaa

SEQ ID NO: 594462 - DNA, 192 bp, Homo sapiens
agcagatgaggaaggggcccagtcctaaacgacggtataaaaaccagaagtttggttttggtggaagaagaaaggctcaaagtggacatcgggagactatatgatgtatctagcttccggccaagaagctcatggcagaggctcaagaggctggcaagaaagggtcaataagagactcgcaaacgaacagga

SEQ ID NO: 594463 - DNA, 563 bp, Homo sapiens
  misc_feature (365)..(365): n is a, c, g, or t
gtgaacacatggacgtagggagggaacaacacacactgggccctgtcgcggggtgggaaccggggacaggagagtatcaggaaaaatagctaatgcacacagagtgtaatacctaggtaatgggttgatagatgcagcaaaccaccatgacacacatttatctatgtaataaagctgcacattctgcatgtataccctggaacttaaaaaaatatattgaagggtcatggttacttgtattgtgtgccaaatatgcatagtatattgtccatattacaaattgcatattatgtacaccattgcgtatgtcttaattttttcattttcgtacatttaattttctagaccaaaacttaaagttcgcntcttaaaggtggatagaataggggccctgtggtttcctttggtgttccattggtggggcgtaccttttctttgagacacccttccttttaagaaaagccaaggtaagcgaagaggaatccatttggaaaggccaacaggaggtggttggggcgttaataggggtaaagctggatttaaacaattatttttccccccac

SEQ ID NO: 594464 - DNA, 179 bp, Homo sapiens
  misc_feature (80)..(80): n is a, c, g, or t
  misc_feature (97)..(97): n is a, c, g, or t
  misc_feature (162)..(162): n is a, c, g, or t
  misc_feature (171)..(171): n is a, c, g, or t
gatgcctgtaaggtgttagcacagctgtccacatgggaagtgttcaatagatgttggctatttctcaacatcggttaatngcatctttcagttctanggatttccattttgtggttcctttttgtgtacaggtggtatagttctttctgccaaaatttccanatcttatgnttttaata

SEQ ID NO: 594465 - DNA, 732 bp, Homo sapiens
  misc_feature (594)..(594): n is a, c, g, or t
  misc_feature (596)..(596): n is a, c, g, or t
  misc_feature (604)..(604): n is a, c, g, or t
  misc_feature (618)..(618): n is a, c, g, or t
  misc_feature (620)..(620): n is a, c, g, or t
  misc_feature (642)..(642): n is a, c, g, or t
  misc_feature (664)..(664): n is a, c, g, or t
  misc_feature (680)..(680): n is a, c, g, or t
cgggcgtgctggctcacgcctgtaatcccaacactttcggaggctgagcccagcagatcacttgaggtcaggagttggagaccagcctggccaacatggtgaaaccccatctctactaaaaatacaaaaatacaaaaattagccgggtgtggtggtgggcacctgtggtcccagctactcaggaggatgaggcaggagaatcgcttgagcctgggaggcggaggttgcagtgagccgaggtggcaccactgcactccagcctgggctacggagtgagactctgtctcaaaaaaaattaattaattaattaaaaagtacaataaaattattattgactatcgtggtttgcactttcacattgcaggcttcaaaaagcatgggtttatttgggcacggtggctcacgcctgtaatcacagcacttttgggaggccaaggcgggaggatcacttgaggtcaggagttggagaccagcctggccaacatgacaaaaccctgtctctaccaaaaaatacaaaaattagcggggcatggtggcacacttctgtaatcccagctacttgggaggctgaggcaggagaatcgcttgaaccananagttgaangctgcagtgagccnanatagcacccactgcacttttanccctgagccaccaaaaagtganaacccttgtcttcaantaaattccctttttttaaattaaattaaattaagcccttgaagttccaaaac

SEQ ID NO: 594466 - DNA, 1030 bp, Homo sapiens
tcgctggagggagcctggctgctgttcattggtgctgtggcgtgcaggcctcggcaggtggcagccccatgcccaggtgcctgcgtatgctacaatgagcccaaggtgacgacaacgctgcccccagcaggactgcaggctgtgcccgtcgggcatccctgctgccagccagcgcatcttcctgcacggcgaaccgcatctcgcatgtgccagtgccagcttccgtgcctgccgcaacctcaccatcctgtggctgcactcgaatgtgctggccctgaattagatgcggatgccttcacatggcctgcgcctcctgagagcagctggacctcaggctgatatatgcaaccagctccggtctgtggaccctagacaaattccacggactgggccgcctacaaaagctgcaactgagacgctgggctgcaggagctgggccacggggccttgttccgcagggcctggcttgcccctgaaatacctctacacatgcaggacaacgcagctggcgaggcaactggcatgattgacacccttcccgcgaagcgtgggcaacccataacaacacactcttcccttgaaagggcaaacctggcatactccaggtcgtgccctgaagacgccgccttaccgtgggctgcacagccattcgaccgtcatcactactggacccagaaccgtgttgggcccatggtacaccggaatgccttcctgtgaaacctttgggcgactcatcgacacattctaatctcgtttggccaacgactataatcaagagcttgcacatttgagtgcctggccccgcgtgcggtggcagtgaaggaacttgacggccacggcaacccctgttttctagcgtgccgggcagcctcatatagtactggtcgagattcgaagaaatccacgaagatgcataacgatccagaagctggtagaagatatgtaaactgcatcacatcactctaggtcgcaggctactacagcaatgaagagaatataaacaatgatccagatcagaacaagaaaagaa

SEQ ID NO: 594467 - DNA, 344 bp, Homo sapiens
cttctgtggacagcagattcttttccttctcacaaggggctcatttaaaatttggaggctgggtgctgtggctcacgcctgcaatcccagcactttgggagactgaggcgggcggatcatgaggtcaggagatcgcgaccatcctggctaacagtgaaaccctgtctccactaaaaatacaaaaaattagccgggcgtggtggcgggcgcctgtagtcccagctactctgaagactgaggcaggagaatggcgtgaacccaggaggcggagcttgcagtgagctgagatcgcgccactgcactccagcctgggcaacagagtgagactctgtctcaaaaaaaaa

SEQ ID NO: 594468 - DNA, 287 bp, Homo sapiens
ctagggcggctggtgggtggaggtaaggggcacgctgacttggtgcatcaccaccaggaaacttccgcggctcagcctgcaggagtgccaagacccaacgttcgggctgatgcaatcgggtgagtgcttaaaggcaagagggcacggccagcgtccactggggcccacgcagatcagtccctaaacagctcccactgtccttcagcctctgtcccagcccctcagatttgacatccctttcaggaacatgtgctttgttttatcacacccccagcccggccgggccg

SEQ ID NO: 594469 - DNA, 180 bp, Homo sapiens
gttatggctggtccggaagacctcacagacaccccacacctgactgacccgggcaaccccaggtaggcagcgatgacaaccaaggagaaaggcgtcggatgaagctgacagtgattgacacaccagggttcggggaccacatcaacaacgagaactgctggcagccaaccgtggactagt

SEQ ID NO: 594470 - DNA, 284 bp, Homo sapiens
agccaactagcgtgttaaagaaaaccctcaaataacactgatcaatagaggtaagcaaaatcataaccatttaagagttaacaaccgccaagccaaggaaggccacattttagggtaaatttataaccaggaaggtgccggttgaggagtagggggtttgggacccatacacacgagttaggggggtgttaattagagccacgatcacacagtggcagagagagagagggtatacccctagtgggggtttatacagagccccccccatgccacaccaccaccca

SEQ ID NO: 594471 - DNA, 338 bp, Homo sapiens
atgggtttgggctgctctgcctccgtggcactgctgcttgcgtggtggtctccgcagcttgaaaccaactataagcatcttttccatctcggagaaggctgatttggcctgaagaagccctgtgtgcactggccctagcaaacccacctatagccagcttgggagcaaaccaccaagggcctagctccgaaacggcacaaaacgcgctcctaggagctgcattcttgaaaggggatcagaggcatctctgcagagccaggtctcaagtatgacacagtgggttgaaaggatccagtgttatgacagttgtggtgtaggtcctaataacggtggcttgg

SEQ ID NO: 594472 - DNA, 176 bp, Homo sapiens
actaagatctcgctgctcctctcagtgtaagaagctggagtattcacagcgaatgaagataagtgagtctcttggtcaggccttatggtaaaaagagggcagcagtatttcttctccccagacctcgaagccagtggggttccaggattggtgaaccctggcgcccacctcaaccc

SEQ ID NO: 594473 - DNA, 112 bp, Homo sapiens
agaaaattaacaccaaagtttttccaggaagaaaatacagagaaattaaagttgaagtactataatttaatgattcagctggatcaacatggagggatcctatttgtctatt

SEQ ID NO: 594474 - DNA, 1535 bp, Homo sapiens
gctctatgtagctaacagtgaagatttacctcgcttctgctcagaggccttgctgtggagctccactgccatgtacccagtagggtttgacatttccattcagcccatgcaaacatggcatcatgtcattgggccagcagcactgtgttctcgtgcacacctgcagcgcatgtcatcacatcttatcagcatgccaacagtcattttggggtcatcattcatccgtaatgggcacgactacacagatgatcattacagacacatgcctgataccacggcggccccctaaccccagatgaccacgtcttcgccgaccgcaactactcaagccacacgacagacacatcaacccgaagccagcacgtagaggacaagatcatgaatcgtgcgagcggaagaccacacgcctgcaacgtgataagtaccggcaacacaagacagcgaagtgccatcgcaaggcgctccaaataggcgcggcggaccgagcatagcgacaccgtgactaaccgcagagcacagccaacaacacactgactggccgcgccccaccaccgccccagccccgacggctgccaactcaccccctcgcgaccacactcggcctcacctcctgccgacaaagagagagacacccacctaccacctgaaccacgaacccacacatacaagctacccaatcccaactagatagccccatggcctagaacaagctgccgcaccgagacaagaacgcatgcaagcagcacatgacacacagcccaccatgcaccaccaacgacgagaccccatcgcacaccgaacgaacgacaactaaacacaccacacccctcgaacacgcacccaccaccacaccaacacaacaccacaaccagcgccgccctccacgccagaccaacacacatacccaacacaacaccacacacaccgagcgagccgaacacacccctacacacgtgagcgccagcgaagaacccaccagacgcaagcacacacgacgacacaggggcacaacccagcaggggaagcaaccacaaccgacacaccgcacacaagcgcgccaaccacacggcacggacctaacctatcccagcacacaggtgacaccaacacgcctacgatcattgcgaccgcgcaaaccgacacatcacatgtacaacaaccacacagccagaccaatagtagagcgcacaaacgacaagaggcgggctacagcaagtgactcgaggacaggacacaaacagcagcgaacattgcgcagcaagcctagcacgacaccgacagggataagtacaactacacgagacctcagagacagagacaaaccaacgaagcagaatcaagccgacaaaccgaaagaagccaactcacctaaatgaggcgcagcaggacaagcaaacgaagcgacaagacgacacggacgaacacaaacgcacacgacgagacaacctaagaacaacactaagcgactaccacgaagagaacgtacggcagaaccaacagcagcagatgacacaataccgagagcgaagaaatag

SEQ ID NO: 594475 - DNA, 296 bp, Homo sapiens
ttggacacgctccagtcagtagataggtcagctcgaggggtgcagaaagcctgtgggcccaggagataggagatgcctgtttgtaggcgtaagatctaccttgcgtactatggacatctaccgggcatcagaccctctaccctggcccttgttatacctactccaccatggcagcctcatatatgtaggccagtatgtgtgcatgctactagacacttacactcgctgcgagacagctggaagggctcgtcgtcttacccagtgtctttactcttactcactcaagctacctctcc

SEQ ID NO: 594476 - DNA, 109 bp, Homo sapiens
ctgggcgtatgccttttctaagactcacaaactaactaatactaacatctcagagctcaggaaatagagacgtctgaactatcctcgccgcatcatcctagtcctcatc

SEQ ID NO: 594477 - DNA, 88 bp, Homo sapiens
cccctgcccccgggcccccccccccgccttccctttttccctgtcttccttaaagtttccctcctgaatagaagttccctttgcctta

SEQ ID NO: 594478 - DNA, 276 bp, Homo sapiens
ttttttttaaaattcaggcccgtggggcccccctggggggcccccccttttgggggccccccgcctacgggggcaagttgtttttcagcctgttgggggggggcatcagggggccccccgtgccccacatggtggcccccgggtgtggctgccggtgacccctgccccgggggggctcctgccccgggggtccgggggggcccccgcttgggcccctttccttttttttttgggcccccagctttgcccccataaaggcccgccagcccccggcca

SEQ ID NO: 594479 - DNA, 488 bp, Homo sapiens
gagacgttcttcgccgagagtcgtcggggtttcctgcttcaacagtgcttggacggaacccggcgctcgttccccaccccggccggcacgcccatagccagccctccgtcacctcttcaacgcaaccctcggactgaccccaaggacacccgaacgcacgcatccagacgaccgacgcagcgcacacgccgccgaacgacgaactctcccattagtcgccgcgcatgacgaccgctgtccacctcgcaggtgcgccagaactaccaccaggactcagaggccgccatcaagccgccagatcaacctggagctctacgcctcctacgtatacctgtccatgtcttactacttagaccgcgatgatgtggcttatgaagaaacttggccaaatacctttcttcaccaatctacatgaggagagggaaaatgctgagaaactgatgaagatgcagaaacaaagaggtggacgaactcttaccttcaggata

SEQ ID NO: 594480 - DNA, 186 bp, Homo sapiens
ttttttttaaaaaagggggggggggggggttcgggggacccaaaaaaaaaagggggggggccctttaaaaattttgggggggtttttttgttgggggggccaaaacccccgggtttttttttttggggtttttggggttttcccatttttcccccttttgttttttttttattaaattttttttta

SEQ ID NO: 594481 - DNA, 851 bp, Homo sapiens
agctgctgctgcctgggccgacccgtcgggtcttccaagctgtcgtccctatggggctgtgttccttgtcccgggagtccggcctcccaggctgacctggaagagaaaagagcaaatgttggaagaatgcgctgcggcagagtgacagacaaaaaaagagcgttgcattctcggggaatttcaggatggtccaatctgttgcacgaaaaggagcaattgacaacaggggaacaaaaatggcacacaccccaagtttgctacattcgggggcccccaaccaagaaggggtgccctttaggggttggacacaggtcccaataaagcgcattaacacgttgagcttaggacgcgaatttcttgctgtggcccaataaacgcttgtttaattaattcttggcaatccaaagggtgggggcttacacagtaccaatttttaaaatttttcgttatccttcattttggagttaaacttggagggattccaggactttgtgtaaattaatatatttggcccctttaagtggtgcaattgctataaaaaaagggttggattttcacagggcttataggagaaatgggctacggactttttccattaaaatacttgattttccctaagcattttggctctttcttgcgaggtaagggggggagtagattagctaagtattctaaggaggctcaacaacattggactaaaatacgttgaattatacataacattgctttgtaaaatttcttgataatactctaggattaaaattcgcagtttgtttatatccttataaatgatttatagctaattgggctgatcgggtaattctgtttattcatataagatttgtaactag

SEQ ID NO: 594482 - DNA, 139 bp, Homo sapiens
tagtgctgctggttctatgatgctgtgaagtgcacggtcagcctcgtgtgagggtgggactgtctactgagtagcctcctctgtgctgaccacctcctctgtgctgtgctgtccacctcctctgtgctgtccgcctcgt

SEQ ID NO: 594483 - DNA, 719 bp, Homo sapiens
  misc_feature (17)..(17): n is a, c, g, or t
  misc_feature (123)..(123): n is a, c, g, or t
  misc_feature (151)..(151): n is a, c, g, or t
  misc_feature (162)..(162): n is a, c, g, or t
  misc_feature (223)..(223): n is a, c, g, or t
  misc_feature (225)..(225): n is a, c, g, or t
  misc_feature (231)..(231): n is a, c, g, or t
  misc_feature (256)..(256): n is a, c, g, or t
  misc_feature (267)..(268): n is a, c, g, or t
  misc_feature (295)..(296): n is a, c, g, or t
  misc_feature (302)..(302): n is a, c, g, or t
  misc_feature (312)..(312): n is a, c, g, or t
  misc_feature (323)..(323): n is a, c, g, or t
  misc_feature (325)..(325): n is a, c, g, or t
  misc_feature (334)..(335): n is a, c, g, or t
  misc_feature (338)..(338): n is a, c, g, or t
  misc_feature (343)..(343): n is a, c, g, or t
  misc_feature (346)..(346): n is a, c, g, or t
  misc_feature (348)..(348): n is a, c, g, or t
  misc_feature (350)..(351): n is a, c, g, or t
  misc_feature (354)..(354): n is a, c, g, or t
  misc_feature (356)..(356): n is a, c, g, or t
  misc_feature (364)..(364): n is a, c, g, or t
  misc_feature (367)..(367): n is a, c, g, or t
  misc_feature (401)..(401): n is a, c, g, or t
  misc_feature (408)..(409): n is a, c, g, or t
  misc_feature (411)..(411): n is a, c, g, or t
  misc_feature (416)..(416): n is a, c, g, or t
  misc_feature (502)..(502): n is a, c, g, or t
  misc_feature (528)..(528): n is a, c, g, or t
  misc_feature (544)..(544): n is a, c, g, or t
  misc_feature (574)..(574): n is a, c, g, or t
  misc_feature (576)..(576): n is a, c, g, or t
  misc_feature (580)..(580): n is a, c, g, or t
  misc_feature (591)..(591): n is a, c, g, or t
  misc_feature (619)..(619): n is a, c, g, or t
  misc_feature (702)..(702): n is a, c, g, or t
attgtttcccacaacanccatggttatgtaaaaaaaaccgccattgtcaattaagatgttaaaaaattatttccataagagtattaaattctaatctatgattcacttaacttcctactttanaattacaaggaaaagaaatctcacaagnagccaaaaaanacatcccaagcagtaatcacagaagatgaagcaccttacaggacccctccaccctcaaacncncatgtncagaaaagaattaaagccttaatanactactgaatnntaactatttacatcattctaaaaaaannaaaaanagaattacanaacaaaaaatncnccttttaannacnaaagnaanangnngtntncttacggngtntgagaggcaaaaaaataaatccatagtaactaangggcggnngnttttntccctgaatttttaaaccccaacaaagcattattttgcaaaaggtcctttagcccaaagtcagtgtctctgttttgatctctttgnaaaagaactctctgttcatccattcnctttccctgggaccgnaaaataaggcggaaaaagtcttcaacgggnantggnggaccctttgnggtagcaggggggggagcacatcttggntcatctaatctgcgatccttgccattttacaaggatgtcaaagaaatcttcatcagcctctttgttgtcattagtcatcaggnggctaagtaccgactgg

SEQ ID NO: 594484 - DNA, 470 bp, Homo sapiens
cttttattattttacagtgtactcctatttatttaacaagttaactataaaacagcctcaggcaggtccttcaggagatattccagaagagggcattgttatcatagatgacagctccattcatgttactgaccctgaagaccttcaagtgggacaagatatggaggtggaagacagtggtattgatgatcctgaccacgggtaggcttaggtttatgtgtgtgtatgtgtcttagtttctaacaaacaaattaaacaagtacaaaaactcaaaatagacaaaatgcttagagcataaggatatcaagaatatttctgtgcagttgcaccatgagtgcttaagctacatgtcatcacacaagagtaacacaacttcacaacattaaaaacgcttcaacttaacaagctctacgcagctacggtccatttattactcgacaactaaacttatttttctcaacaacaaaaca

SEQ ID NO: 594485 - DNA, 502 bp, Homo sapiens
  misc_feature (7)..(7): n is a, c, g, or t
  misc_feature (13)..(13): n is a, c, g, or t
  misc_feature (109)..(109): n is a, c, g, or t
  misc_feature (140)..(140): n is a, c, g, or t
  misc_feature (225)..(225): n is a, c, g, or t
aggcacnggcacnccttactgacctctgggacccttacggggggacccttgatgtaggaatgtgggaggcctttgtcgtggctcagacatactcgctcaaggatcctangggggaacccttacctgtgtccgtgtggtangacttagagtcctcacacttactcacatacaggcctcataatgagaagccttgatgtgataatttagaaatcttcatctatttcnatctatatgaatgtagaacatcttgcttctgctcagaactgctccttcttagaaggcctacttaacatggatgcagaataatttcagaaaccccttaaataattccttaacatctctataaacgctagaatataatgctgaattatatcctttattaagcatcatctccatttcaccatatcctaactgaaaccctatatatttcttgtgtgttcctatttgtaaatactgtaattgtattacatgactaaattatattaatactataattccccgg

SEQ ID NO: 594486 - DNA, 829 bp, Homo sapiens
ggctgcgcacccggagtgcggctcccctcggtctcctcgccatggacgcggacgactcccgggccccaagggctccttgcggaagttcctggagacacctctccggggccggcaaggccatcgggtgctgaccagcggggggatgctcaaggtatgaacgctgccgtccgtgccgtgttgcgcatgggtatctacagtgggggccaaggtgtacttcatctacgagggctaccagggcatggtggacaggaggctcaaacatcgcagaggccgactgggagaggtgtctccagcatcctgcaagtgcgcggcgacgatcattggcagtgcgcggttgccaggacttccgcacgctggggactggccgctagaaatgggctagctttgccaaaccgtgctaggcatgcgctggcacattcaacccaacccttgtgttgtagaatcgagctggggaaccggcgacgacactccaacgagcaggccaacacttctttcaccgggaaccggatgtgggcgatgggcgcctagcatgcgagcgacgcatagcgaacacatggacaacggggaccacgcacatccgactcacaccggacaagccagaatgacaacacacaataccggcccgtaccccgcccaaaccaggtggcggaggccaactgcgtggcgagcatcaccaagtccggacaccaaccggaacgaactcctggcgggaccaacccggaaccaatggaaaccacatccggcacacagatgacacatcccgcaccgctgaccaccagggaatccacatcagccagcggtcagcaccgaaacaacccactaccacgac

SEQ ID NO: 594487 - DNA, 155 bp, Homo sapiens
aaggctgacccagatcccccataagactctggcaccgggctaaggttccaggccgtctgctgaggtatctggctctgcgttagcgaggtcttgctggcggacattcctagtcgggatcatagtggtctagtgtttcacagcttgtgtgccgggag

SEQ ID NO: 594488 - DNA, 168 bp, Homo sapiens
gggagaagcttaaaccttagtcacacatccagcaatggggtccgtctgcccagcgccatctgggaactgagaagcacctctgcccggcccccacaccgtgtggaaagtgaggagcacctctgcctggccgccaccccgtctggcaagtgaggagcgcctctgcccggc

SEQ ID NO: 594489 - DNA, 1108 bp, Homo sapiens
gttttatattgtttttgtgggaattggaacatttaaatatcataaatcgggtgtggggccacacctctcactgccaggtcccgtgggtccctctcctatattctgtctcatgtattgtgcccgtggaacggcggctgttggcctgtgtcgagacgcgaggagggcctgtctcgcgcccgagatgtccctctgtgagaggaagagggcatcttcacaggccacccacaagagcccctgtgagcaggaaagagcggagagagcccaagacagagccagcaggctatcacagaggggagggtgtgggacgagagagagagaggagagagaccagacgaccgaagaaaacaacgcacagtgttgtcggccgtcgaccgaaggcgcccgacaatagttgtagtggtgttgtgtacaaagtgtcgtccactcttttacacacttgttgtggttgttgttgaccacaacggcactctagttgtattgataacacgtagtggtcttcaggaaggggtactcctaaaccacatgaagcaacaactaccgccggttggggcactacttcaagaaggaggggataacacatagcagggtacttctaaaaagaggcgagttaattgctggtgggagccaaaaacacctgctggcagatgaggtaagaaaagcgggcggaagggagaaatgcaacaaaaagacacccggtgcgaccccttcatcatggtgctatatgcacccaaccccgccggtagttcgacggtgccctctttatcccaagccccctgggcacaaaccgccgctatacacctactgaaaagaagggggcgaaaaacaaaaaggacaccaaatgatcaagtgggggtggtgaaactgttgtgacacccacaaaaacaccccgacagaacatctgcgcagatggatgtgtttgtgctccacaatgggctgcttttttccaaggagaatgcgatggagaagaagtctcccttttctgatggagaacgaactctgtggggaatgtgaaactatcgcataaagaaacttaaccacgactttattgaggagcgccggaaagcacacgttgaggaactgtgtgaacctcgcgcagttttgtgttaca

SEQ ID NO: 594490 - DNA, 638 bp, Homo sapiens
tggtttacctccctccattcattcacatgctcatctgaaaagacttaagttcttccagcttgggacaataacggctttaaaaaactgtaaagtagttacaagaaaacagtggcccaagactcagaattttaaaaaaaaaaaagggagcatgtgtattatgtggccaatggtcttcactctaactgggttatgagatctaaaaccattcctcactggctctaacatgctgaaaaaatcatctgagggggagggagatggatgctcagtgtgtcacatcaaaggatacagcattattcaagcagcatccattctggttaaaggccttccagtggttaagaagattggagggtaacatagatatggcttaatggctcataactggatggtgggctgggaaaattgggtattggaatttatagcatcagcaaggaacagaaaatggtgatgtatttaatgcttgtcaataagggaatgacctgtctggttctacagagatgggaattgggaagtcaaacacccttggtattccaaaatagggtctcaaacatttggtaattttcatttaactggtaaggaggctgggaagctataagtaatcttatcttccaatacacggttaatatagcactgaaataatg

SEQ ID NO: 594491 - DNA, 650 bp, Homo sapiens
  misc_feature (1)..(1): n is a, c, g, or t
ngtaatataaaggcctacttgagtggttccaatcaaaagccaaggctcaaggatgttggaccctgtgccttcttctattctaagaagttagtctgacctataccataagtatcccattgtcttgggggaacataaagaaggagtattacatttcaatgcatctcttattgcacggatggacctatacccgccctgtccaagccattccttagactggccctgttttgatcagggtcggatgagtacacccccaatcctggcttaggggcatgatttgggaatctgacactggacgctacccgtcgctatttgtggcactgtgtccgttagtgggcctatatagattcaaggtccgtgtaatgtccttgggccaatcgctataggcagtaactcaatgggtggttccgtctgcgtgtcacagttacatgcatgttcaaaggtgcttggcactaacatatttggtcttccagcatccatgctgattagtcattccacgtgaatctgtcagtatgctgctcccaaaagtcaatgttgcagaaataggaatcttttcatgtacacagtgttgtatatttagaaatcctggctcagtgtacataggatgccctgcaacgtaatgtagggcataacgtatagcgttggactgtatt

SEQ ID NO: 594492 - DNA, 584 bp, Homo sapiens
  misc_feature (16)..(16): n is a, c, g, or t
  misc_feature (76)..(76): n is a, c, g, or t
  misc_feature (98)..(98): n is a, c, g, or t
  misc_feature (114)..(114): n is a, c, g, or t
  misc_feature (150)..(150): n is a, c, g, or t
  misc_feature (267)..(267): n is a, c, g, or t
  misc_feature (291)..(291): n is a, c, g, or t
  misc_feature (348)..(348): n is a, c, g, or t
  misc_feature (350)..(350): n is a, c, g, or t
  misc_feature (357)..(357): n is a, c, g, or t
  misc_feature (373)..(373): n is a, c, g, or t
  misc_feature (399)..(399): n is a, c, g, or t
  misc_feature (403)..(403): n is a, c, g, or t
  misc_feature (419)..(419): n is a, c, g, or t
  misc_feature (446)..(446): n is a, c, g, or t
  misc_feature (448)..(448): n is a, c, g, or t
  misc_feature (454)..(454): n is a, c, g, or t
  misc_feature (465)..(465): n is a, c, g, or t
  misc_feature (478)..(478): n is a, c, g, or t
  misc_feature (491)..(491): n is a, c, g, or t
  misc_feature (497)..(497): n is a, c, g, or t
  misc_feature (512)..(513): n is a, c, g, or t
  misc_feature (532)..(532): n is a, c, g, or t
actcctttaaaaatcnccctatttcttttcagttaatatcctcatctcgcattaccctcatacattgcttagtttnattcattttactaaattctgtnaataattatttaatcnaatctacataaagattagaaaaaattctagcaaganttatacatcatgaaatacagaattaaaagtttaaacctaccaaaagtcctatgtgccttattatttagctgtgtaatgagaaacgtcaggagtataaatctgcacttttcgactgtnagttaaatttgctaatgctggaancgaaatagtgaaggaatactggggttgctaaaagattactttttttttttttttttncnaaatgcngtgtaccttaaaagtnttttacctagaaggcctccccctgtnatcncattaatttttctaangacaatttggtgttttgaagataaatntnattagnctatgataatngcatcttaggccnattagccattttncccttnaccatattttctctnnttagcatatagccatcttnatatttaggtgggagcactaccccaatggcgcaacacgttctcattttaaat

SEQ ID NO: 594493 - DNA, 355 bp, Homo sapiens
taaatgccaacccgggccttacccctatgtactcgtatcttacggacgagagcagagacctctatggacacgtattttgtctttgcaaaacatacatgcaaaacttggacccccgctcgaaaactgatatctttctgtcatgttacaaaaggacatttattcagctactgatgctgaccggtccaccagagcttgaaataccacaccttgccatcttggccggaagacctgcctaatgactaataccttctttcttatgtgtaaacaacctctaatcaacaggaccttccctgacggctttcatatatttagagacaggctcactatgtcatcaaggctggagtgcactgccccg

SEQ ID NO: 594494 - DNA, 404 bp, Homo sapiens
atcgtgctgcagcggggcggtaccggcttcgcgggctccggagtgaagctgcaagcggagaaatcacggccggtgatgcaggcctgagtgtgtgcgggagaccaaataaaccggcttgggtgcgcaacgacgtggcgccttcattcgcggcgtgggcgccccggggacagggcaggcgaggatgcagggccgtgcaaacagtgctcctacagcgcacgctggagtttgaaagagcgggctaagcatattgaatgtggtctcacattaagaacaaaatctggccaggcacggtggctcacgcctgtaatcccagcactttcggaggccgaggctagcgtatcacttgaggtcaggagttcgagaccagcctcattggaaaaatagggtgaggtaggccaagattt

SEQ ID NO: 594495 - DNA, 136 bp, Homo sapiens
ctgtagctgattctacgaggatccttatgggctggtggtaaggaaagtagagtgagggaagcaggtaggtggaggtgtgaaagggagagggcctcatctcaggttggctggacctgcaccagcatcggcctgcatg

SEQ ID NO: 594496 - DNA, 318 bp, Homo sapiens
attctcgataggagagtacagaagggataaggcccaaagattacagcttgacatatgctgaggacttgctaagcactggctgaatgaatatgtaggacaaccatgaccagaggtggggcaggttctctggcacttcatttttgactgacacatttttctctttcccagaatatttctatcttgcagactagaaaagcgcgaaaacagagcaacaacagccaacataccattatctccattagatccacgttgatttatctcgctgaagcgagaaagttatgtcgcgcagcttacgatccacacctcatggaggaccaa

SEQ ID NO: 594497 - DNA, 845 bp, Homo sapiens
taaaaagcacaacacccccgcgggggggggggggggggggggagagaaagagagagaagggggggggggggatgagacacacaacaagcaagggggaggtggaccggtgaagaaaaaaggggtgtaagagagtggaagagggggggggggaggagaccccccgcgggggggggggaacaacacaaatgcaggaggaggaggatagagtgcgggaagaacacaagaactgaaggggacgccgtcggaagaagaaaagaacaagaaattcaaagacgacacacacagacacaagtgggggcgcaccacacacacacacaaagagagaaatgccgcccgcgcaggggagaaataatggaggggggggcgaagagtgggcggtgaaatagcaggcggtggggcaaacaaacacagcctccccacaccacccactctctatggaggggggacaaacaaagggggacagcccgctgagagagagaggagaggaatcaaaacctacgaccgacgagagggagagacctcaccacaaagaacgaagagtaagagaggcagacgaacaaaaaaaaaaaacggaggagctaagaatacccccgggggaggacgaccaaaaacaaaaaacaaagtagggcgcgggcgaagaagaacacccaacagggggaaggtggtgaagaaaacacaaggtgtaggaccaaccccacaacaggagataaaaggtagtaagaaacaaagaacaacaaattaaccacagcaaacccacaaaactcggacttgagtatggtaagcaacacacacgaggggaggggcaaaacactaccccccaccataagagtaacacacacaaggtg

SEQ ID NO: 594498 - DNA, 831 bp, Homo sapiens
tggggccttttcaggcctgaggaccgagctgcagagcgctgacatgcgggcaaagaaccagcttcggtggcctgcctggcctgcccaggtctcagccaggcttggacgctcgatcgagccgtcagcgaggctagctccctattctcgatcgtgtgactcgacacgcctgcttccgcgtgcgctaggtgtggctttagctcgggctcttgaaccgcatgctgtggtggcgtggccaggcgtgctgcctagccgccgtcccgattgctccgtgtggatcatgagggctgagaggggcctggcatggcatgacatgttcgtttgacatgtgagctgtcctgtgggtctggtggtcatgtccaaggataacggtactaagtcggaacactcaagccgtccagggctgccacgtgccatggcagaacgcctcgcgaatgctaagatgtggagagcaactaggctagttagcgtaaggccaacggatcagagtgggtcgcgggcgcacaggggcacggcaaaggtgggtaccggtatctacttgggcacggccacccgatgtgaagcctaggggccttgcgtttcccttggttcgctatagaaaatcccggaggaccacagggatgtggcctatcccgttattagcttccgtgcgcgcgccatggtggaagaccagggggcgtccccggaacacggcgcacggtaagtccgttttctcctgtgtggtctagtgtcgccttttacaggggggtcacgcctcgccgtctcgaagggccaaggggggcgcatttgccgtgtggggtaacccccgcagtttccctggacggggggggtcgc

SEQ ID NO: 594499 - DNA, 637 bp, Homo sapiens
  misc_feature (55)..(55): n is a, c, g, or t
  misc_feature (468)..(470): n is a, c, g, or t
aggctcgaatgacagtagcattgaggtgtttgctgcagagtggagggaagctcancccaccctcccgcaatccgagatagtgtggcacatctgtcctgacaggcgaggagtgtaactgaaccaggaatatttcctccattcctgctctcccactgcacacagggtggtggcacattatccctctggggggtgggcacgcctggtgttttggctcaatttgggtttgttggtcacatggagctcttccatttcgtttagctgaataatgagttgttcctagaggagccagcctgtctctccttgttgcccccaaagcccatgccctgccgtggtggcagctgggactgtgaatgggagggggtccccaactatggatgatgttgcccctctctccggcatagccaacgcacggttcatagtacaaaggcccctgctgcaacatggtagagcaaaaattaattcctatcnnnccgtgagtaggagttgtgagaaattcccaccccacagtggaagacagcttatcgtgcatgcactcgttggtagttcggaagctcttacgtgtgccctgagcgtccatagcttatcacctatcacaaagcataccacctttccttaatacaccagcggggcggggagc

SEQ ID NO: 594500 - DNA, 200 bp, Homo sapiens
cgaagatgggaaggggacttgtatgattttaagaaaccacaggataggatataatcttatgagctaaatgtgtagcacatgcttttgtatcattattaatgatacacttttcttctcttcttagagtcgtttttcccttggcatattgtgatttgtctctctcttcatcaatggtgaggcggataccccttccgggttac

SEQ ID NO: 594501 - DNA, 157 bp, Homo sapiens
gggatcgttaagcacaggaggtcgagtgagccatgatcgcggcactgcataccagcctgggtgacacagtgagatcttgtctcaaaaacaaacaaacaaccctttgcttggtttttccttattgaaattgttctttctttttttattttgggtccct

SEQ ID NO: 594502 - DNA, 464 bp, Homo sapiens
  misc_feature (27)..(27): n is a, c, g, or t
  misc_feature (64)..(64): n is a, c, g, or t
  misc_feature (74)..(74): n is a, c, g, or t
  misc_feature (77)..(77): n is a, c, g, or t
  misc_feature (81)..(81): n is a, c, g, or t
  misc_feature (85)..(85): n is a, c, g, or t
  misc_feature (124)..(124): n is a, c, g, or t
  misc_feature (133)..(133): n is a, c, g, or t
  misc_feature (137)..(137): n is a, c, g, or t
  misc_feature (145)..(145): n is a, c, g, or t
  misc_feature (169)..(171): n is a, c, g, or t
  misc_feature (175)..(175): n is a, c, g, or t
  misc_feature (181)..(181): n is a, c, g, or t
  misc_feature (193)..(193): n is a, c, g, or t
  misc_feature (199)..(199): n is a, c, g, or t
  misc_feature (201)..(201): n is a, c, g, or t
  misc_feature (212)..(212): n is a, c, g, or t
  misc_feature (216)..(216): n is a, c, g, or t
  misc_feature (218)..(218): n is a, c, g, or t
  misc_feature (224)..(224): n is a, c, g, or t
  misc_feature (227)..(227): n is a, c, g, or t
  misc_feature (236)..(236): n is a, c, g, or t
  misc_feature (238)..(238): n is a, c, g, or t
  misc_feature (241)..(241): n is a, c, g, or t
  misc_feature (257)..(257): n is a, c, g, or t
  misc_feature (275)..(275): n is a, c, g, or t
  misc_feature (289)..(289): n is a, c, g, or t
  misc_feature (291)..(291): n is a, c, g, or t
  misc_feature (293)..(293): n is a, c, g, or t
  misc_feature (298)..(298): n is a, c, g, or t
  misc_feature (314)..(314): n is a, c, g, or t
  misc_feature (322)..(322): n is a, c, g, or t
  misc_feature (333)..(333): n is a, c, g, or t
  misc_feature (342)..(342): n is a, c, g, or t
  misc_feature (400)..(400): n is a, c, g, or t
  misc_feature (402)..(402): n is a, c, g, or t
  misc_feature (439)..(439): n is a, c, g, or t
gatctactcggggaaaaagaaataaanggccaggaacctacacgatataagtaaaaaaagcaanaagagaacancancatncagnaaaaatgatggattgaaagcagaaaggataaggaaaacnaggatcatngaanatatgtanaaggaagacgaatacccacagatnnncaanaccaanagagatgagatnaaaacncncaggatgagtnaagnanaaggcntgnacctcggananganaagggttttattgtanaactctttaatggaaaanttaaggatgaagtnananggatnaagaaaaggaagaacntaaaaccnaagggtaaagngagtagganaaaacataacagaagaggcagacgggtgacctgctggggggctcagcgcgcgcttctngnacacaggtgagaactgtgaactcgggcttgcacaganactcgtagctcaactgggtgtactg

SEQ ID NO: 594503 - DNA, 668 bp, Homo sapiens
  misc_feature (80)..(80): n is a, c, g, or t
  misc_feature (129)..(129): n is a, c, g, or t
  misc_feature (158)..(158): n is a, c, g, or t
  misc_feature (169)..(169): n is a, c, g, or t
  misc_feature (180)..(180): n is a, c, g, or t
  misc_feature (203)..(203): n is a, c, g, or t
  misc_feature (306)..(306): n is a, c, g, or t
  misc_feature (327)..(327): n is a, c, g, or t
  misc_feature (341)..(341): n is a, c, g, or t
  misc_feature (373)..(373): n is a, c, g, or t
  misc_feature (375)..(375): n is a, c, g, or t
  misc_feature (400)..(400): n is a, c, g, or t
  misc_feature (404)..(404): n is a, c, g, or t
  misc_feature (453)..(453): n is a, c, g, or t
  misc_feature (468)..(468): n is a, c, g, or t
  misc_feature (477)..(477): n is a, c, g, or t
  misc_feature (493)..(493): n is a, c, g, or t
  misc_feature (505)..(505): n is a, c, g, or t
  misc_feature (511)..(511): n is a, c, g, or t
  misc_feature (520)..(520): n is a, c, g, or t
  misc_feature (522)..(522): n is a, c, g, or t
  misc_feature (551)..(551): n is a, c, g, or t
  misc_feature (662)..(662): n is a, c, g, or t
aacgatttccagagacagtggggaagctttacagagagacaggcaggggaggatcttaacccggctttcgtaagcctctngctatgagtatggaaggactcaggaattctcccactccggaatgccttnctgctggggtgaccaggtcttcacttgtnaaacaggagtnggccacctcanccctgcgcctggcctggtggaanatgggtcaccgccccaaactggggcagccgccccatcccaacgcagttgctgccgctctccatgcctcccatgatagacccagctaaccagggggactatgtnccctgggaaaacctgggtacncaggctagcctttngtttcagcccctactcctcttcccgggctgcntntactccccggacggcccctttcccngggntgtaattcacatcagctgggaagggtcccttgcagacagtatcttggangaggtcgcgtccccnctagtgacnagcaaactcctaaaancggaccttgccncagagnccctgtagncnccaaccggcagtaaggaggcagcgccgtnctcagcgccgcttagtggcgccaggcgtgcctggaaatccgctttcgcagcgccccctcgtagccgcctccgcccgcagaaaggcgttccctggacagagaagcgggcgcncggggg

SEQ ID NO: 594504 - DNA, 626 bp, Homo sapiens
  misc_feature (584)..(584): n is a, c, g, or t
actttaagttcttggatacatgtgcagaatgtgcaggtttggatacatgtggagaacgtgcacgtatacatgtgccatggtggtttgctgcatctatcaacccatcatctaggttttaagtcccgtgtgcattaggtatttgtcctaattctctccctcgccttgccccccaccctctgacaggcccctgtgtgtgatgttcccctccctgtgtccatgtgttcttattgttcaactcccacttatcagtgagaacatgtggtgtttgattttcgtactacagttaattttgtgcagtgatgatttaataccacatctttatgtttgtttacatttttctcaactgtgaatggtgccatgtatggtctgcaggtgttttcataagttttgataaattttaatttttataatatatttgtgtatattttatggtagtaataaaatagactggtatccacatatattttatatattcatgacatatatttttcttaatttttttgatatttctaggctgtgtggttcatctgcaagttttttcaaattgttgcatcagatctccaaatttccaatgtatttatggngaaatactctgggacatgttgttgaggtgcttattagacatc

SEQ ID NO: 594505 - DNA, 310 bp, Homo sapiens
gactctcgaggatcccctatcgtctgccaagccccaggtctttcaggtggagcctcccctggcggtccacaattaccagctgaatctactctgtttccaggacctttgacttatgatggctcagctgggcctgaagagcttttgagcataacttattgtatggtttgagtgtttagaaagatgagcatctactctatgcctgatcagtgatgagtcttgaaccccacccttctccaacttcccttggcagcttcatccagttctgtgacaacatatgaaacctgccagaccacagacatcggtatcgctc

SEQ ID NO: 594506 - DNA, 127 bp, Homo sapiens
gcagcaggagccgcaggtcgggcctgaactgccgctgggagaggaagcagcgccttgccatgaacgaggggctgttgtagctgcaacacctgctccagcttcacctccagcagtgctgcgcacacgg

SEQ ID NO: 594507 - DNA, 375 bp, Homo sapiens
ggttttttaggagggatttttaagttttctaccggggctgacgttcccttgtccggaggggcttgcaggggggttaaacccctggggcaaaaaacaaagggtccagggccctctgggctcccaacagtttttcagttcccacttccgggtgagttttttgggattcaggatcgcaaatccggggcccaaaaagggtggggaacatgggggttatgttggggaaagcacccatgccccccccgccccccagccgggcatcctttatgggccggcaaaactgttttcctatgtttccccaggggcccccctttcaaatgaacggggaaaaaatgaaatgtttttttaaatttaaaaaaataagaacattaaaaagca

SEQ ID NO: 594508 - DNA, 567 bp, Homo sapiens
  misc_feature (3)..(3): n is a, c, g, or t
  misc_feature (8)..(8): n is a, c, g, or t
  misc_feature (19)..(19): n is a, c, g, or t
  misc_feature (24)..(24): n is a, c, g, or t
  misc_feature (28)..(28): n is a, c, g, or t
  misc_feature (33)..(33): n is a, c, g, or t
  misc_feature (37)..(37): n is a, c, g, or t
  misc_feature (42)..(42): n is a, c, g, or t
  misc_feature (53)..(53): n is a, c, g, or t
  misc_feature (69)..(69): n is a, c, g, or t
  misc_feature (89)..(89): n is a, c, g, or t
  misc_feature (91)..(91): n is a, c, g, or t
  misc_feature (124)..(124): n is a, c, g, or t
  misc_feature (126)..(126): n is a, c, g, or t
  misc_feature (138)..(138): n is a, c, g, or t
  misc_feature (144)..(144): n is a, c, g, or t
  misc_feature (148)..(148): n is a, c, g, or t
  misc_feature (150)..(150): n is a, c, g, or t
  misc_feature (167)..(167): n is a, c, g, or t
  misc_feature (174)..(174): n is a, c, g, or t
  misc_feature (192)..(192): n is a, c, g, or t
  misc_feature (196)..(197): n is a, c, g, or t
  misc_feature (199)..(199): n is a, c, g, or t
  misc_feature (214)..(214): n is a, c, g, or t
  misc_feature (217)..(219): n is a, c, g, or t
  misc_feature (222)..(222): n is a, c, g, or t
  misc_feature (229)..(229): n is a, c, g, or t
  misc_feature (231)..(231): n is a, c, g, or t
  misc_feature (258)..(258): n is a, c, g, or t
  misc_feature (261)..(263): n is a, c, g, or t
  misc_feature (270)..(270): n is a, c, g, or t
  misc_feature (272)..(272): n is a, c, g, or t
  misc_feature (294)..(294): n is a, c, g, or t
  misc_feature (296)..(296): n is a, c, g, or t
  misc_feature (308)..(308): n is a, c, g, or t
  misc_feature (321)..(321): n is a, c, g, or t
  misc_feature (352)..(352): n is a, c, g, or t
  misc_feature (399)..(399): n is a, c, g, or t
  misc_feature (418)..(418): n is a, c, g, or t
  misc_feature (430)..(430): n is a, c, g, or t
  misc_feature (434)..(434): n is a, c, g, or t
  misc_feature (454)..(454): n is a, c, g, or t
  misc_feature (461)..(461): n is a, c, g, or t
  misc_feature (503)..(503): n is a, c, g, or t
  misc_feature (555)..(555): n is a, c, g, or t
tantaatnaacgggttttnttttnctanaactnaaancatcnacggttctcanagctaaacttccaaanctacagtcagcaatttttcntnaaagcccaagggagaggggccagggtaaaaaanangagactttaganaggcanaaananaccagtaggaagagggngggaganggcacttatttttctctnttcnntnattgggttaaaaatnaannntgnttaaaananttagggggccaggttagggtttttttnttnnnaattacncnggaaggaacatcaaaaccccancnacaaaaaaaaantcatcaagccccnaatagaaggggagcctcccagtgcacctcanaaatgggggcaacgatggggaaggagcagaatggagagcacacaaanggttaggggtctttaaaantttttttgtaantttnttttattaaaaacatttccnaaaaaangtgtcttttcctttatgtctgggtgatatatatgactataanctggccttgagcactgtgtggagaggaaaaaggacagccaggagtcttcccnagcatcctattt

SEQ ID NO: 594509 - DNA, 112 bp, Homo sapiens
ctcgaggccaagaattccgtactacgttcactcagatttactttaagctcgacactattggtcgttttacatcgtctgggatgcaaaggccctggtcgtacccagggtatgc

SEQ ID NO: 594510 - DNA, 297 bp, Homo sapiens
cgctcgagaccgcgattgctgccagcttagccaggccaggtacaacaggtacagcgcgccccacgatcttcagtagcgctgaacaattgctcggatgccagacagagcgcaccgaggccaagtgccgaggcgctcagcaaacagatcgaagcaaatacgccgcccagaaacgccgggtaagagcggcgcaggccgaagttgaggctgttgctgatcatcagcaataacagcgggccgggcatcaggatcaccaaccaggcgcagcgcccgttaaacaaacagccaggtactccgggt

SEQ ID NO: 594511 - DNA, 160 bp, Homo sapiens
ggcctttggcccccccttttttctatttgcccaaccccttttttagggatgggcttttttttggacccctttttatcccttttcccttttaaagcagggtaagttggatatttctgttttttatggccaagggacccccataaatcatatgggaatttta

SEQ ID NO: 594512 - DNA, 574 bp, Homo sapiens
tgttttttatagagacgtggtttgccatgttggccaggctaatctcaaactctgatctcagggtgatccacctgcctgggcctccaagagtgctgggattacaggcgtcagccacctagaaaactgaaaattgcccgtgggactgccatgctatttctatcagacagactggtctaagcccagcttcttcgctgattcattggatccctcctaatctcttcctgatttcctcatctagggactagggagccgccccactagcgctcacactgcatagtttcgttaccttctccttggcccttgctgacagcattggggagccccttgtgagtctgcagagggcagccagggagggtgaagccgctgccttttgggagagacccctgagctgtctgaattcgagtctgccccagttagacaccgccagggttttcaggaaacaatttccagctttgtaaatatccattgaaaaaataaaaaggaatctattattttgtcaaccttcacaacaacctgaacttataaaacgcctctcacataaaggtctcggagtgttgcacgataaccaatacat

SEQ ID NO: 594513 - DNA, 1299 bp, Homo sapiens
  misc_feature (375)..(375): n is a, c, g, or t
  misc_feature (576)..(576): n is a, c, g, or t
gtaccagtgagccgttagccgctgcgcgccgtatttcccggacaattgtgtcggtcgacgtgtcagtgcgcctgtgcccttcggcgcgcttcgtgatcggtcgccgggcggcccgtggattgcctcgtccgaggcagtggtctgccggagttcagtgttgtccgttcggtgagccatcgagctgatccgctggttcatttagccagctcggtcgttgagctcagagctcgcggactcgctggcgagcgtccgtcgcttcctcagggaggggttgcaattctcgcttgcgcttctcgcttgaacctagctaggtctggcctctttgacatgcagactgggctggtagtcttagacgtctgcagcctagttgcgtantcagcacctgggggtgaacgaatgagcgcattgtatgctacactggttgacctaagtcgaagaacggggatgatttgggctaaaggaggcttcttttccatttccaagggggcatcttaacacgaagtgctatgtaggtcccgtgtcgaacaacttttccgtgaacttctaggaaccagcgtgattagagaaagtcccggntacgggttttgggtgcaggtcgaattagagccttgtgtattcagagaaagattcgaatcatcagatagagtcgaagagctttgagaagaaagaccattttgtgaaagcgtcaaaagattgacagaattcaacaagaaagcagaatatagtattgccagattgttcgcaaggactgggtagacgaatgagccctttacaggaagaccatacaggcgaggcttgaaaaattccaatcaagtgccaagtcagtgatccaaattgaagccttctaattcaaaagtgttaaccccagggaagggattgtgggcgaaaacaacttttggcatccagcccagcaaagcttgaaaaacgtacatggccaaaggcccactgaggggctaatgctattgttcaaacacagggattgttccctttttgctggcaaaaaaatccttggaccggaacacttcttgagaacccttggttgacgcaggaaaaccacataaaaggagcggacatatctatgttggaaagtaatatgcccgaaaaaaaaccatttaagcaggccgaagaatttacctttaagcaacaggctttgaacactctagtgccccagaaaaggggaacccaatgacacgaggatccaacaagaacaggggcttggggagagacacttacacggtgtttgaaccccacaggccaaaaatatttcctctatatgagaaaaacacccccattgtgtgg

SEQ ID NO: 594514 - DNA, 941 bp, Homo sapiens
  misc_feature (156)..(156): n is a, c, g, or t
  misc_feature (203)..(203): n is a, c, g, or t
  misc_feature (369)..(369): n is a, c, g, or t
  misc_feature (371)..(371): n is a, c, g, or t
  misc_feature (428)..(428): n is a, c, g, or t
  misc_feature (509)..(509): n is a, c, g, or t
  misc_feature (536)..(536): n is a, c, g, or t
  misc_feature (540)..(540): n is a, c, g, or t
  misc_feature (544)..(544): n is a, c, g, or t
  misc_feature (560)..(560): n is a, c, g, or t
  misc_feature (580)..(581): n is a, c, g, or t
  misc_feature (604)..(604): n is a, c, g, or t
  misc_feature (613)..(615): n is a, c, g, or t
ggagctggtggcggcgctccgcagggctcggctgttttccgcgcggcaggcgcggccatggcgcagctgggaaagctgctcaaggagcagaagtacgaccggcagctgaggttgtggggtgatcatgggcaagaggctttagaatctgctcatgtntgcctaataaatgcaacagccacaggaactgaaattcttaaaaactntggtactaccaggtattggttcgtttacaattattgatggaacatcaggtcagcggagaagatgctggaaacaatttcttccttcaaagaagcagtatcggcaagaaccgagctgaagctgccatggaattcttacaagaattaaatagcgatgtctctggaagtntngtggaagagagtccagaaaaccttctagacaatgatccctcatttctctgtaggttnactgttgtagttgcaactcagcttcctgaaagcacttcactacgcttagcagatgtcctctggaattcccagattcctctnttgatctgtaggacatatggactagtnggtnatantgaggatcattatatnaagaacatccagtaataganntctcatccagataatgcattagnaggatctannnctagataagccactcccctgcaactgagagaacatctcccagtcctatgactctggctccatatggcaacacactggaccacatgtcatactccatggatctggtgatcatagctagctatttacgcacactcgacttcctgccaccacatggccgaatcacccaccacgtcctacacactcaccactcacacacaaaacattgtactctcccaattactccaacaatctcaaacacacacccctacatattcactcaactctttaataacctcatacaaaacacacccacccccatcaactccacctaaaaccaaacaacccacc

SEQ ID NO: 594515 - DNA, 142 bp, Homo sapiens
gtggatgacactcctgcatagtttctggagcgagagcttacagtgactgtggctgtgaatgattggagtctagtatctgtctcaagtcagactcatctgctcttggtttgccgggctcagtgctctcagcgtgcggcgggga

SEQ ID NO: 594516 - DNA, 902 bp, Homo sapiens
  misc_feature (156)..(156): n is a, c, g, or t
  misc_feature (203)..(203): n is a, c, g, or t
  misc_feature (369)..(369): n is a, c, g, or t
  misc_feature (371)..(371): n is a, c, g, or t
  misc_feature (428)..(428): n is a, c, g, or t
  misc_feature (509)..(509): n is a, c, g, or t
  misc_feature (536)..(536): n is a, c, g, or t
  misc_feature (540)..(540): n is a, c, g, or t
  misc_feature (544)..(544): n is a, c, g, or t
  misc_feature (560)..(560): n is a, c, g, or t
  misc_feature (580)..(581): n is a, c, g, or t
  misc_feature (604)..(604): n is a, c, g, or t
  misc_feature (613)..(615): n is a, c, g, or t
  misc_feature (669)..(670): n is a, c, g, or t
  misc_feature (698)..(699): n is a, c, g, or t
  misc_feature (789)..(789): n is a, c, g, or t
  misc_feature (809)..(809): n is a, c, g, or t
  misc_feature (828)..(829): n is a, c, g, or t
  misc_feature (839)..(840): n is a, c, g, or t
  misc_feature (871)..(871): n is a, c, g, or t
ggagctggtggcggcgctccgcagggctcggctgttttccgcgcggcaggcgcggccatggcgcagctgggaaagctgctcaaggagcagaagtacgaccggcagctgaggttgtggggtgatcatgggcaagaggctttagaatctgctcatgtntgcctaataaatgcaacagccacaggaactgaaattcttaaaaactntggtactaccaggtattggttcgtttacaattattgatggaacatcaggtcagcggagaagatgctggaaacaatttcttccttcaaagaagcagtatcggcaagaaccgagctgaagctgccatggaattcttacaagaattaaatagcgatgtctctggaagtntngtggaagagagtccagaaaaccttctagacaatgatccctcatttctctgtaggttnactgttgtagttgcaactcagcttcctgaaagcacttcactacgcttagcagatgtcctctggaattcccagattcctctnttgatctgtaggacatatggactagtnggtnatantgaggatcattatatnaagaacatccagtaataganntctcatccagataatgcattagnaggatctannnctagatatttcatttcctgtatatcttttgtttatacttttttcttgtcctatnnttttgtgatcttatggatatataaaagnncctacagtcattactccattggatttgttgtatcatagcttaattatttagcatctagttgtgtatatttgatatactaatattggacgnatacctaaaaacgttataanagaaaaaagagggacattnntttttttttnntttaagacaagtgaatttctaaaaaaattgnaaaatgggggctccagaaagattgaatgaga

SEQ ID NO: 594517 - DNA, 171 bp, Homo sapiens
ttctagaacctggcggcctgttgcttggcacccacggtctggtgatgcatacctggtaatcccagctactcaggtactacaggctatgggaagggggagaagtgattgagcctgggaggtggaggctgcagtgagccatgatcatgccactgcgcttcagcctgggcaaca

SEQ ID NO: 594518 - DNA, 3504 bp, Homo sapiens
  misc_feature (147)..(147): n is a, c, g, or t
  misc_feature (153)..(153): n is a, c, g, or t
acaagagcccgcggtggcgctgccaggggatgctagcccgagagcgagcagaggagcagcgcacccgcacgagccttggaccctttggaaccgaaagcacgcccgtcctcagagtcccgtcctcaaagtcccatcctcgccatggcncccggngagaagatcaaagccaaaatcaagaagaatctgcccgtgacgggccctcaggcgccgaccattaaagagctgatgcggtggtactgcctcaacaccaacacccatggctgtcgccgcatcgtggtgtcccgcggccgtctgcgccgcctcctctggatcgggttcacactgactgccgtggccctcatcctctggcagtgcgccctcctcgtcttctccttctatactgtctcagtttccatcaaagtccacttccggaagctggattttcctgcagtcaccatctgcaacatcaacccctacaagtacagcaccgttcgccaccttctagctgacttggaacaggagaccagagaggccctgaagtccctgtatggctttccagagtcccggaagcgccgagaggcggagtcctggaactccgtctcagagggaaagcagcctagattctcccaccggattccgctgctgatctttgatcaggatgagaagggcaaggccagggacttcttcacagggaggaagcggaaagtcggcggtagcatcattcacaaggcttcaaatgtcatgcacatcgagtccaagcaagtggtgggattccaactgtgctcaaatgacacctccgactgtgccacctacaccttcagctcgggaatcaatgccattcaggagtggtataagctacactacatgaacatcatggcacaggtgcctctggagaagaaaatcaacatgagctattctgctgaggagctgctggtgacctgcttctttgatggagtgtcctgtgatgccaggaatttcacgcttttccaccacccgatgcatgggaattgctatactttcaacaacagagaaaatgagaccattctcagcacctccatggggggcagcgaatatgggctgcaagtcattttgtacataaacgaagaggaatacaacccattcctcgtgtcctccactggagctaaggtgatcatccatcggcaggatgagtatccctccgtcgaagatgtgggaacagagattgagacaacaatggtcacctctataggaatgcacctgacagagtccttcaagctgagtgagccctccagtcagtgcacggagggcgggagtgacgtgccaatcaggaacatctacaacgctgcctactcgctccagatctgccttcattcatgcttccagacaaagatggtggagaaatgtgggtgtgcccagtacagccagcctctacctcctgcagccaactactgcaactaccagcagcaccccaactggatgtattgttactaccaactgcatcgagcctttgtccaggaagagctgggctgccagtctgtgtgcaaggaagcctgccgctttaaagagtggacactaaccacaagcctggcacaatggccatctgtggtttcggagaagtggttgctgcctgttctcacttgggaccaaggccggcaagtaaacaaaaagctcaacaagacagacttggccaaactcttgatattctacaaagacctgaaccagagatccatcatggagagcccagccaacagtattgagatgcttctgtccaacttcggcggtcagctgggcctgtggatgagctgctctgttgtctgcgtcatcgagatcatcgaggtcttcttcattgacttcttctctatcattgcccgccgccagtggcagaaagccaaggagtggtgggcctggaaacaggctcccccatgtccagaagctccccgtagcccacagggccaggacaatccagccctggatatagacgatgacctacccactttcaactctgctttgcacctgcctccagccctaggaacccaagtgcccggcacaccgccccccaaatacaataccttgcgcttggagagggccttttccaaccagctcacagatacccagatgctggatgagctctgaggcagggttgagaagacagatctagtcaggaccaccagccatggtctaaggacatggatcgggtgcccccagacgtgtgcacaggggaccctctgccccactctgggcttttcagatactctgaccaaaaagcctgctttaaaccgcaagatggggcctgggcatgcgcaggaggagccatcgggtactacgcagcaacactcacaactgtccaggctgagataaatcccgggacctgaactattagcacgtcactagagactgggagccgaggcagtggtgctggcccaagtgaaggccagagtgaggactgatgcagctctttacgggtcttgagagggaaggactcttccaaagccccaaagccgagggtttcacccacactgccagcctgggttggggcccaaggatgtgaccttgagtgtcaaggctggacagctactgccagatgccaaagataggagaaagtgccagccctgaagctggagccgcttgtgaataaactgttcttcatcattgacactggagaaaggtgtcctccatgccctcaggcagcagagaactggcccagagcccttggagtgttggtggagatcagagtgccgtggtggaggtctgggactatgtcagagtgtcctcactttggggcatgggtggctccaggagatggatttagttattcaattttgtggatgaataaattgaggcacagaaagattaagttaccggcccaaggtgacacagtgaggaggtggcagagctaggatttgaccccagacaatctgacttcatgattgtggcatccaattcgtgtctgtgcctcaatttgtgcaaacgactgtgtcactttgcttggggagggggagcatcccacccacatgccctgggcaggtgacccaagacagagctgacccctccaccaccaaaggcctgtctctcaccaacaagccaactgctcacagatgacccacttcataccacattcacatctggccacctgactccagctatcaggtattaagtcccgggcagcgataagcccccccacaacagtgtgttagctctgtcttagcaacctgataggttagcataggggctgcaaatgttgttccgccacaccaaatccctgtttttgtccatgaactaagaattttattttattttattttttattttttgtagaaataggatctcactatgttgcccaggctgttcttgaactcctggcctcaaatgatcttcccacttcagcctcccaaagtgcagggattacaggcacaagccaccgtgcccagccaagaatttttatttttgcttttaaatacccaaagaagaagattctgtgactcatggaaatgatatgagattcgaattccagtgtctataaataaagttttattggtacacagcccc

SEQ ID NO: 594519 - DNA, 745 bp, Homo sapiens
cacagtggctcacatctgtaattccagcactttgggaggccaaggcaagcggatcacaaggtcaagagttcaacgccagcctggccaacatagtgaaaccccgtctctactaaaaatacaaaaattagccgggtgtggtggcacacgcctgtagtctcagctattcgggaggctgaggcgggagaatcacttgaacccaggaggtggaggttgcagtgagccaagattgtgtcactgcactccagcctgggttacagagtgagactccatctcaattaaaaacacacacacacacacacacagcacacacacacacacacaacaatataacaaatattagaaagacatatacgtgagacataatgtgaaaacagagaaacaatattataaagacgcaatatcttagagcggaagaatatagtgagtgacccaatattatttcaactagagaatttcaacgggcagactctattcacgctgaagactcagtgaaagctaggcagttggtggctcacgcttgtaactcccggtgctgtgagaggctgagaccaggagagatcacttgaggccaaaagttcaggatcagccagggacaacatagtgagacgcgtgtctattcacacaaaaaattatctaggctggcgccgtggcgtaatccagcattttgggaggcagattaggggaaatcacctgaggtcaaagagtcagaaaccagcgcgtggtcaaccagcagagaaaccccatc

SEQ ID NO: 594520 - DNA, 432 bp, Homo sapiens
cggccttagcctatggctacctcttccctgagtattccctggccctggggcctgagatctctccgggcattctcagtcatgagctccgggtccagtagcaaggttggccacaccacccaccagccagctccagcctcgacgcttaaccagccatcagtcccttaactgtcagcgttcgtggactatgcacaacaatcaagcccgggacccattaagcccgcaattttaggcggcccagtggagcgactcacagaggctgctagtgcccgtgctgttggtgctgctgctgtggagtgcccaggaccaggtgctaggggagacggcgtcaataactatcattgtctcgtctactgatccccatgccacgttctcaagtcaggatttagaaccaccaattctctagctccagctactccaggcttggggactgcc

SEQ ID NO: 594521 - DNA, 337 bp, Homo sapiens
aggtcccttttggttttcagtttcagtgggtcctttttttgttcccccattgaattttgtgcccccccctagccttttccataaccttagggattcagtttggaggggttttttggatttttgaggattcctggattttggatcctttccttggatctccttaaatggaaagaaataatgtatttgggccttttgtgagggatggggggaacaagtggtcccagggatccccattttcaagccccccctcccttttcaggtccccccccagcaataaaaggttccccctgaaatccatccctttgtagtttgaacaaatatatttatatgatatgta

SEQ ID NO: 594522 - DNA, 258 bp, Homo sapiens
cttggaggatcttatagtctcgatcgttagtgagttctgatggcttatcagcatctggcatttccccggacagcattcatggtctctcctgccaccctgtggaggaggtgccttccaccatgattctaggtgtcctgtggcttccccagtcactgggaactgtaagtcaattaaacctcttttctttataaattacccagtcttgggtatttcttcacagcagcactgagaatggactaactatacctactgttacct

SEQ ID NO: 594523 - DNA, 295 bp, Homo sapiens
taccctgagtgtggtggtacatacctgtagtcccggctgctcgggaaggctgaggcgggggattcgcttgatcccaggaggtggacattgcagtgagcagagatcatgccactgtactccagcttgggtgacagagcgagactgcacctcaaaaaaaaaaaaattatttcagggaatcctagtggccagtttccttggctcgtataggggcatacaaccaagttagttttggtggtgattttgtggaaccagattcctgggaagcattatcaagagcattctcagcattgattgg

SEQ ID NO: 594524 - DNA, 265 bp, Homo sapiens
  misc_feature (11)..(11): n is a, c, g, or t
ctgaggtgccnagaggaccccggccaccatgtgctggctggacacttggtcactttagaagcatgttactaaatgtcactgattaaaaaaaaaaaaaaaaaaaaaaaaaaaaaaaaaaaaaaaaaaaaaaaaaaaaaaaaaaaaaaaaaaaaccccccctttttttttttgggggggggggggggggggggggggaccccagggggcccccgggggccgtgatacgtgtgggggggagggtgtcccccccccacgatattccccc

SEQ ID NO: 594525 - DNA, 111 bp, Homo sapiens
gtcaacatgaaaggctctcattgttctggggcttgtcctccttctctgtttacggtccagggcaaggtctttgcaaggtattgagttaggcccagacctctgcaaagcata

SEQ ID NO: 594526 - DNA, 151 bp, Homo sapiens
ggcggccaaagtgctgggattacaggcatgagcactgcgcccagccatgcttttataattgtacaattttgttcctcactgtgacttacgtttagattttgttgctttatcttgattttgtgaagtttgaatatgaaatgtgtaggtggtg

SEQ ID NO: 594527 - DNA, 879 bp, Homo sapiens
gacatgagccatcaaactggtggatgttcgggtatgaggttgggattaagccaagggattcaggtgtggtgccgtgtgggaactgaggaagtcgcccaaggtttcaggatggcagcatctatgcatggtcagcccaggtccttctctagaagatgcagaactccgaagagcaatggtcatacgaagtcatagaccacctattgacatatcttagaaagagacctgacacacaaatatatatcaaatggcgacatttggaacaccagcgggtcactctggaatatttctcaaacttcctgttcagacgctgcttcaaggttcaagatgatgctttgaagactatatgcgtcattggctacaacttccattttagtctactgttgttactgacaagctttttgtaatcgatgcttgtattcagatacactataacgcaagggaaacactgtgtttgcagaagctcactgattggcatagttgtggtgtatacctatcccagtacttatggcttttacctaatgattggaccgccgttgggactcaacgtatcatagccggttccactgtcgaccaaaataggaagggtattgcaatccatttgactgaggcattgttcacaacacacaattgacccattagtgtagactacctctaagtcctaccaggaatcatgtctggactattgaaaagtgtcttaaaccactcatgcagttttggaaagcacgctctgggtcataaactatcgctaggcgagttaccgcaacaaatcgtcaatggtggcgttagccaagctcaaataaagatctgcactacaggagggcacaggcatctcgcacgcggtacaacaacattggcgcccacaaatgcgtatgagcgctc

SEQ ID NO: 594528 - DNA, 204 bp, Homo sapiens
tactgcacccacagcatgtgataccgtttcagactttttcttagcattaacagtatctctatcaacatgccatgtgtgccaaacacataacaagggactatatgtgctatatcttatgactccctctttcacacttgtagagtatacctttggggcctttaaagcagaggtcagtgtaactacatcccacagtcaagaaatgct

SEQ ID NO: 594529 - DNA, 210 bp, Homo sapiens
acaaagttagccaggtgtgattacaggcatgagccaccatgcccagctaattttgtatttttagtagagacgggatttctccatgttggtccgcttggtctcgactccccgatctcgggtgatccgcttcgctcaggagtttttatataatttattaaccataagttatataagtaattttacatggctatctgaccgcttgctgtcacg

SEQ ID NO: 594530 - DNA, 421 bp, Homo sapiens
atcctggaacaggaaaagggcattggggaacaactagaaacatcctttgaaaaagagtgtggagtctgggcgtgggggctcacacccgtaatcccagcattttgggaggctgaagtcggagagtttcatgagcccagaaattcgagaccagcttggtcaacatggcaagaccccatctcagcaaaaaattaaaaaattagtctggtgtgctggcgcacatctgtggtcccagctacttgggatgctgaggtgagaggatcgctcgaactcgggaggtcgaggctgcagtgagctgtgatcgcaccactgccctccagcctggataacagagcaagaccctatctcaaaaacaaaagacattttagaatagtttcagatttacagataagttgtaaaaactacagtgtttcctgtatgcccc

SEQ ID NO: 594531 - DNA, 400 bp, Homo sapiens
gaattcggcttagcgtggtcgcggccgaggtacagccgtaataaaagtgcatctatatccataaatttgttttcatttcattccacacaacacaattattataaacatcaagaattgggagctattgaacagatggtttattagtgtcctaattcttgatctttattctagtaaatccttccatttcatatcctttccacaaatcctatggccattcagggcatgatgaatgattttttaaatgctgctttaatgttgatgtcatttttttgtaaacaaatatgtaaatgcagctgtccagcaggataatgataccacgttaaactcttcaaatatttaaactagacatatcctaacatgccagcaggttatgaataagctgaatgcccgcgtacctgcc

SEQ ID NO: 594532 - DNA, 319 bp, Homo sapiens
cttctctgctgattccagattcgtgagcgccggctcagatcctttgtagggttattttgatcctgtccatatattgtagaaatattctcttcataaaactctctgtaggctgggtgcagtgcgtcatgcctgcaatcccagcactttgggaggccgaggcgcgcagatcatgaggtcaagagatcgagaccatcctggtcaacacagtgaaaccccgtctctactaaaaatacaaaaaattagccaggtgtggtggcgggtgcatgtagtcccagctactccagaggctgaggcaggagaatggcgtgaacccaggagt

SEQ ID NO: 594533 - DNA, 755 bp, Homo sapiens
  misc_feature (91)..(91): n is a, c, g, or t
  misc_feature (103)..(103): n is a, c, g, or t
  misc_feature (108)..(108): n is a, c, g, or t
  misc_feature (129)..(129): n is a, c, g, or t
  misc_feature (198)..(198): n is a, c, g, or t
  misc_feature (201)..(201): n is a, c, g, or t
  misc_feature (207)..(207): n is a, c, g, or t
  misc_feature (218)..(218): n is a, c, g, or t
  misc_feature (221)..(221): n is a, c, g, or t
  misc_feature (226)..(226): n is a, c, g, or t
  misc_feature (235)..(235): n is a, c, g, or t
  misc_feature (254)..(254): n is a, c, g, or t
  misc_feature (262)..(262): n is a, c, g, or t
  misc_feature (275)..(276): n is a, c, g, or t
  misc_feature (317)..(317): n is a, c, g, or t
  misc_feature (320)..(320): n is a, c, g, or t
  misc_feature (326)..(326): n is a, c, g, or t
  misc_feature (329)..(329): n is a, c, g, or t
  misc_feature (332)..(332): n is a, c, g, or t
  misc_feature (334)..(336): n is a, c, g, or t
ctctgtgtcacatatctgtcttgcagaaccatgacctatcaaggtgttttgtcaaacacaaactcatactttccctgtgatatattcatanaccgcatttggnttatncactcatctgctgattgtgtncccctcttgggtattatgagtaatgctatgaacatgggtgtacacatctctcttgaagtcccttcttangtnctttanggatacatatncangagcngaactactngatcacatatgctaaggtntgaatgtncccccaccaaatnngtatgttgaagcaaccaccaacgtgataggtgaggctttangangtgatnatntcntnnnagctccattctcattattggataaaccccctttataaacgctgtcatgggaaccaattaccattctttgctccttagaatcctctttaccttatttatgcacgtgtcttcgctccaagccataaagcccaaccttctggctttaaaacatcgactctgcttttaaaggctgtataaccgcttccaaacaaatcataacttgggacttcctgtagtttttatgtggccaatgcctttacctttaattcggcttatatctgtttagatttatgcattttggtttctcacaccctacacttttctgtttaatatattctatttcaccactctccgtcatcaaaacctttttttctctttctcggtaacaataactttcttttcttccacctttgcgagaagcactctttattctttcttttt

SEQ ID NO: 594534 - DNA, 95 bp, Homo sapiens
gaaaaagttatgtcctcaactttttgttaaatgttgctgcctcattgacctgggaaaaatgaaaaaaaaaaaataaagcaaatggtaagaccctt

SEQ ID NO: 594535 - DNA, 546 bp, Homo sapiens
  misc_feature (148)..(148): n is a, c, g, or t
tggaagagatcagaagagagagaaatgatccatgcactggtaaaaagaggcagggatgggttggtgtacatatgccctgcagacaaatgccacactgagtcacacatgcactggtggtcctgctgtccgtgcagaaaagttcaagagnagagtcctccacaatccttcaacctgactttctggctgtatgagttagggatgggagggagaggcaattatattttaagtgtctcctttctagaagaactgagtgttctctgaaggaccattccagctgcagaagtacttctgaatgggtgaagaaagggcactaaaatgtaccaaaagattttgggcccaagtgacatccagaccatttttcttttctattaaagtaaactgaagtttagataagggctagattaaattcaaggaaactcctgataaccatgttaagatcaaccacagtaggctgagttttactgaaaccttggtcctcttaagctactacatactgattctattataagtacattttgattctccccagaaactaaaaatacttaa

SEQ ID NO: 594536 - DNA, 629 bp, Homo sapiens
agcgggtcgggcatgtccgtgatctggccgagtcggacggccccgctggggcttcttgtgcaggtctagggactgtgtgatgccgggcccgcagcggagcgacggaggggctgggctgcgtggaggccctggtgccccgcgcgatctcagccttagagcgcttgctggttgccgtatccagctcccgtgtgtctggtcccgatctccaggcgcatccatgctatgaagatcgcccctgctgctggcagctgcggctgctggcggcagctcctcacgcgagacctgcatggtgtgcgtccagtcgtccgtccgcgctgtcggccagtcggggtacgcggggctttgccagtcccattgcggtgtcagcgcgggctcaacggggcacagccttgatgggaggcgaagggggacttcccggcggcaagggattgccccaaattgttggtggcgccaagccccttgggcccttggcggctttcccaattcctccaaaggggtttacaaagtttcccgaaggggcttcacttttttgggcccccttccggaccaagtggggggcacccccgagttggagcggaggaatggcggccggaaaccgatccttgtgtgcaaccgggaacaagcgaact

SEQ ID NO: 594537 - DNA, 683 bp, Homo sapiens
  misc_feature (502)..(502): n is a, c, g, or t
gcaagaccttgtctcaaaaataaaaagtttataaaaaagaaagctagggtttaatccacgtatatgtgactccagaatgttaactcttaaccattgtaccattgtttcccataatgtggttatatcaccatatgaggggatttctgtggcacctagaaaggactttttattgtaatagctaagtatttattttaatattaccttctatttgtggtaagaaaactactggaagttttccatttaaaagtatgctgatatttaaaagtatgctgatgataagcatacttttaacataaatggaattaaaaattggcttaaagaaaaatagatcgcgcaggtgtggttctggaggctgtgaagtccaagagcaaggtgctggcatatggggaggactgtcctctgcttcaagatgaagcctttggcccttggccgggtgaggtggcttacgcctgtaataccagcactttgggagggcaaggggggtgggttaactgaaggtatngcgtttaagaaccggctcgtcaacatggtgaaacctcatttctactaaaataacaaaaaattaatccagcatggtggcagacgcctgtaattccaactacttggaggctgaagcaagagaatcaattgtacccggaggccgaaggtgcgagctgtgaatgttgcactacacttcctggggg

SEQ ID NO: 594538 - DNA, 594 bp, Homo sapiens
gcttcctttccggctcggctatgttttcctgcgcaggagccgcaggccgtaggcagccatggcgcccagtcggaatggcatggtcttgaagccccacttccacaaggactggcagcggcgcgtggaccacgtggttcaaccagccggcccgtaatgatccgcagacgtaagtgcccggtcaagccaaggcgcgccgtatcgaacccgcagcacctgcgtcgggtcccagtccggcccatcgtgcgctggccactacggttcaggtaccacacgaaggtgcgacgccgggccgcggctatcagacctgaaggagctcagaggtggacgtgcatacacaagaaggtggcccggaccatcggacatgtctgtggatccgaatgaggcggatgaagtctcacggagtcccttgcatgcacaaccgttgcagcgactgaaggagctaccgttaccagagtcatcctctgaccccaggaagacccatcggcccccaagacaggcagacagtcgtgcatgaaggacactgaaactggacatccagctgaccaggaccgggtcatgcccgtaccggaaccgtctataagacaggaggaaacg

SEQ ID NO: 594539 - DNA, 959 bp, Homo sapiens
  misc_feature (3)..(3): n is a, c, g, or t
  misc_feature (81)..(81): n is a, c, g, or t
  misc_feature (94)..(94): n is a, c, g, or t
  misc_feature (102)..(102): n is a, c, g, or t
  misc_feature (109)..(111): n is a, c, g, or t
  misc_feature (116)..(117): n is a, c, g, or t
  misc_feature (120)..(120): n is a, c, g, or t
  misc_feature (125)..(125): n is a, c, g, or t
  misc_feature (135)..(136): n is a, c, g, or t
  misc_feature (138)..(138): n is a, c, g, or t
  misc_feature (143)..(143): n is a, c, g, or t
  misc_feature (145)..(145): n is a, c, g, or t
  misc_feature (151)..(151): n is a, c, g, or t
  misc_feature (157)..(158): n is a, c, g, or t
  misc_feature (164)..(164): n is a, c, g, or t
  misc_feature (167)..(167): n is a, c, g, or t
  misc_feature (176)..(176): n is a, c, g, or t
  misc_feature (178)..(178): n is a, c, g, or t
  misc_feature (181)..(181): n is a, c, g, or t
  misc_feature (187)..(187): n is a, c, g, or t
  misc_feature (189)..(189): n is a, c, g, or t
  misc_feature (204)..(204): n is a, c, g, or t
  misc_feature (259)..(259): n is a, c, g, or t
  misc_feature (266)..(266): n is a, c, g, or t
  misc_feature (299)..(299): n is a, c, g, or t
  misc_feature (349)..(349): n is a, c, g, or t
  misc_feature (396)..(396): n is a, c, g, or t
  misc_feature (410)..(410): n is a, c, g, or t
  misc_feature (413)..(413): n is a, c, g, or t
  misc_feature (417)..(417): n is a, c, g, or t
  misc_feature (765)..(765): n is a, c, g, or t
acnaaatgcaacttatgtttatacataatttacaactccaagcaagcatgcttataaatcatgtgaaatttaaactttaanaactctggatgantacatggnggcaacnnnccatnncanctganaccatcattnncngagtngngtagcnttcagnnttcgcngtngcatattananccntgtttngnacagccctgctcggnttggttttgtccacgtggttgataattgtgttcagttgctgctaagtgattttgngaatttnatttataatcctcgccctacaattacctaagtnctgtttctgcaggttaacctgtttgctacgctcagtcatatacctttcanagttactaatgcaactgccaagggggggcagtgtcaatatcattgtnttcattgggggggnggntgcnccacactgtgggagcactgctgttcctaacagtagtttacttttagagggatgtgagaatcagtttgaccttaattccagatgtgcatgcctcaaaagaaaaatcccattctccttccttttggggagcacttttggtggcaccaaggctggtgtggggtagtggagagagcactgagcttagagtcacaaccagatgaaactgctctggtcttcactagctgtgtgacttgggcaagcagcttgcagtctctgagcctctgagatccctgatggacgaggagaacaatgaccccctccccaggctgtgctgagagagggaattgatcttggatatgaaaatgctgcnctggcacagaggtaggagctgagcaacactgctggatgaataaacacatgtaatgcagggtgaacagaacatttcatctgcaacagctgaaggcacagcttacctatgcccatggaaagaactgcgtggaaaattcatttgttgcatttttgccaggttgatgtttgcaaagcagggcactcttctccacattt

SEQ ID NO: 594540 - DNA, 170 bp, Homo sapiens
cgcggtttatagcaagacctaaaggtaatttactttctactagaaaatctacgcttaacagtggacctgctgtacacacaccagtagatggctttgctgtcaactgagctgcatcaggtctgcattacgaggcctccaaacaagctgtctgcggtggcgcaaagaaaata

SEQ ID NO: 594541 - DNA, 1419 bp, Homo sapiens
taagactctacatccctcaattctcttcgtgatttactgacaactataacaggatgatgcataaggtggtttacaggggatgcgttatagatgctcttacggcatggatgatcttgccttgtaatatgtacgtcatagtaaagtcgatctagagaccatttaacgcatgctcctgtaagactctacgtgactcatcatgtcgtgcatgttccttatgctcgccatagtcttgacacatactcatatcctacatcactacacatgtatcggacctacgcgatacttgcgcttatgagatgccgtttgtaatagttcgacgtcagattggccccttagatatccaaaggaaatttcagttgttagtcgacgtacacttattaccactcttcacatagctaaggcgagactaagtattgtggaataagtagtcgtagcgcaactctgttgacccatgggcacctctttacatactacgtccgagtttaattaaacaacggctcaaagcatatcatttggactgtacactgcagacatttgaacgttccttagagggaatacgtcttctaggtgtagatttgtgacacccgtgttcaacattatacttttcactttgtaacacctcccatcacgtgtccaactttatcaaatagtttcacgcgtcacattctgacgtacacacgtttaaacgccaccgatacataaactacacatgagaagcgcctaccattgacatccgttgacagaaaacgtttatgtcaacttatgcgcacgcaacttcacagagtccgaacgagcaggtaagactccatttcttcagaaacttcaccatcgcggagcaaatactataacgagaacgtcttctaccgtcaaaccccacattcggcgtcaacaatacgtcgacttgacaatcgttccgaacctacacagctagtttccaccaaagatggggggcatagatcaggagacccctaacccatacagggaatacagtactgccatgcacacttcaattggtactatggagcagatacacctctgaagttgccagcctgatacactccagccacactactgggccacactcaaacgcaccccgatacccttaacatcccacagacccgtatgctacgacctcgtgcggaccacaccactattaacgactcaccgcacactaaacagcacgatgcgctcatcaggcgaccacaagcgcccaccaccgcggacgcatccatacagctcttttatccaattcatcccctgcgcgcaatcaccaccaacggttacacgcacccggcccgacgatgcgccccctgcgccgaccgcgcgcgtcaccagtcacaccaacgagcaggccaacgaacctgctacctcaccccgcgacccgacgcgcgcacccatccaagaaggcgccgacacgtg

SEQ ID NO: 594542 - DNA, 261 bp, Homo sapiens
cacgtcatatacagcggatcagcagaattatgtgtcttaccattacgcactccagcctgggaacagaatgagactccatctcaaaaaaaaaaaaaaaaaaaaaaaaaaagggaaccaaattttttggttcccccttttgatcttcaaacgggcggggttttttttgaagccacacccgggggggccttggcgggaaacccccggagaatatggttgtgggccccccagaacccttatagcagccctagtggttaacacaaa

SEQ ID NO: 594543 - DNA, 812 bp, Homo sapiens
gcggagccaacatgccagtggcccggagctagggttatgtctgcaaaacttatagtagaccccgacggagacccttacgagaaatctacgtactacgaccaagagctagaagctagatatgtgccgagtatagggctaccgcgatacaaacgtagatggtctagcgatgggtcaaatattaccctgtgccaagtatccgtctaatggcccgccctgggcaactagctagacagctatgatagagcaaggacccaacaggcgtctagcttccgacagcgcaacggcccctgctagcgcgctgcgcttgcgtacccgccatacacgagcgtagctatggcatgcacggggacacaagcatagcaacgctagcgcatataaccactaccatagcggacccttgcacacggcactaagcaggcatattgcctatacagccaagcatgcatccgcccctagccaacgaaccccccaacgagtacttatacacagcgcctagggccgcattaatgcgccccaacacggttaccaattcgcacccctagcgactaacgccggtagccatgcggcattctcagtcccaaacggccggaccctaatgaattaacaaccgcgtcgtccccacgacgaacatcgaccaccgtcgctaggggtatagacaactcattaaccccaggataacgatgatacaactacccgtccccctcgaccttagggacttttcacccacattgaaatcggccagccatttaccgcacctttatcgtacgttccttagccccgcctctccctaccctccttaacctgtgctgtgc

SEQ ID NO: 594544 - DNA, 717 bp, Homo sapiens
agcgggatcacttgaggtcaggagttcgagaccagcctgccaacatggtaaaaccccatctctactaaaaattaaaggattagccaggcatggtggcacgtgcctgtagtcccggctactagggagactgaggcaggagaactgattgaacctggaagaaggaaaaaacaaaaaaccaaaaacacaccaaacacactcaccaagaaacaaagcaaaacacaaacacaaaaaaaaaaaaaaaaaaaaaaaaagagggcgcgaaagcgggtggtcgtcagaggtgtccacgagtccgcgaaaaagtgtccgcagcccgtgaggagggagaggagcagatggggggtagaattacgcgcgggaaaggccggggagagggcgtgagtacgcggggctgaaggggcacaggagtgagggatctgcactaggggtgaggctgcgagagagaatataagataaataatcgtgtgtgtctgaaggtgagagtatgtattcctgttgtaatagatatgttctttagagcttctatgctatagaatagagtctcttcgatagctctgttgatcatagtattgctttttgaataggtttgttgtaattattttctcagtttgtctttttttgtatttcttctgtggttgtattaatttttaatcttcccttagtaagtatttttgttttattctctttttatttatttttctttctgctctagttatt

SEQ ID NO: 594545 - DNA, 1012 bp, Homo sapiens
  misc_feature (684)..(684): n is a, c, g, or t
  misc_feature (687)..(687): n is a, c, g, or t
  misc_feature (692)..(692): n is a, c, g, or t
agcttgttctttcgctgtttgcaataaatcttgcagctgctcactcttgggtccacactgcctttatgagctgtgacactcactgcgaaggtctgcagcttcactcctgaagccaacgagaccacaaacccacggggaggaatgaacaactccagacacgccaccttaagagctgtaacactcaccgcgaaggtccgcagcttcactcctgagccagagataccacgaaccccctcagaaggaagaaactctgaacacgtccaaacaccagaaggaacaaactccggacacgccgcctttaagaactgtaacactcatcttgagggtccgcggcttcattcttgaagtcagtgagaccaagaacccaccaattccggacacactatcttgatggatatggagtcatagcatttgaaaagaaaaaaaatattgagaactgagaaaaggcactttgggaggtcgaggtgggcggatcacctgaggtcaggagttcaagaccagcctggacaacacggtaaaaccccgtctctattaaaaatacaaaaattagatgggcgtggtggcaggtgactgtaatcccagctacttgggaggctgagacaggaggatggctgaaacccaggaggcagaggttgcagtgagccgagacatgccattgctctgcagcctgcacaaggcatgcantgncctgnacagagagaatccccgcccccccaaaaaaaaaaaaaaactagcaaagggaaaggaaggtatagtggagagtgccgttagttcactgaaatccatttgccatttcttccttacacacagtctagaactacattttccagcgactttcggcaattaggtatggcgtccagtccagctggctcacatgagccaagcaaatgaggaacccaggcctcaggggcagtgggcatgtactcggtccatgactcttatcccctttctcacaatgggaaactcagaactggctcgtataatccagcatcagcccatgcagaagacaatt

SEQ ID NO: 594546 - DNA, 174 bp, Homo sapiens
aaaatgacctattatataaaatgtattgtgtcttactaaggtaaaagagaggtatatactaatttattttttgctcttcccaaaagaaatgtgttttttattatatgtaggtttattttgtattacccaaaatgtgttatatatttaaatatttaatttaaatctactgaattg

SEQ ID NO: 594547 - DNA, 228 bp, Homo sapiens
gaagtggtgcacgcagcacctgcgggcaatgatcatcctacccgagatggtgggcatgcatggtgggcgtctacaacggcaagaacttcaagcaggtggagatcaagcccgagatgatcggccactagctgggcgagttctccatcatctacaagcccgtaaagcttggccttgccatatgcaagggtaccgcactcgcaatcgtcaaccaggtcgtcgctgtttccg

SEQ ID NO: 594548 - DNA, 285 bp, Homo sapiens
  misc_feature (233)..(233): n is a, c, g, or t
  misc_feature (236)..(236): n is a, c, g, or t
  misc_feature (285)..(285): n is a, c, g, or t
atcccagcatttagggaggccgatgcaggcggatcacttgaggtcaggagctcaagaccagcctggccaatatggtgaaaccccatctctactaaaaatacaaaaaaactagactggagtgtgaatgtgcatgcacacctgtggttggtcccagctactcgggaggctgaggcagatgaatcactggacctgggaggaggagggagatttgcaggtgaagccccaacgcatcngangaccactggtacgtccagcctgggcaacagagagagatccatctcaacn

SEQ ID NO: 594549 - DNA, 675 bp, Homo sapiens
  misc_feature (13)..(13): n is a, c, g, or t
  misc_feature (57)..(57): n is a, c, g, or t
  misc_feature (64)..(64): n is a, c, g, or t
  misc_feature (79)..(79): n is a, c, g, or t
  misc_feature (121)..(121): n is a, c, g, or t
  misc_feature (155)..(155): n is a, c, g, or t
atacaactcaagnatgagacaagtcggcaaggtgtgaagacggaagccactggcagngtctgcncccgtcccgtgcggnggccatgcggcgtgctgcgtcggcttgggacggacgagcgcnctcagatccgcgcagactctcgctggctccgcgnagcccagtggcctgggcgcccccgcgcgcgggttaagagcaggggagccgggcagaagaggaaggagcccggccgccgcccaacaccgccccccgccccacgccccgggagacccggcccgagcgccgcgggcaccgccctgaacctcttcgaggccccgctgcgggcgtccagagctggggactgtgggtctgactcctgcgttccagccgtgggtgccacctcttgcgggaagcagggcaaaaccactttggtcaggcgctcctcgtgcctttctcccttcgtaggtgaccagcatctcgtaagaatgataaccatcagtaaccgggaccccaaaccttctcatcaaggcacctctcgggtcaccattactttaactttgaatttgggtctccttcatttttccgctggatgcgttaatgtgcgcgacccacagctccaggcggcggtttcctggcggaactggaccaccgccacaggctgggggtctgcagtgggggatgggaccggccgcggccgc

SEQ ID NO: 594550 - DNA, 390 bp, Homo sapiens
caacctggccaacatggggaaaccccatttctatcaaaaatacaaaaattagctgggtgtgatgatcctcacctgtagtcctagctactcgggagtctgagacaggagaattgcctgaacccaagaggcagaggttgctgtgagctgacattgtgccactgcactccagcctgggcgacagcgagactctgtctctgcaaaaaaagaaagcccaaaaagggactgcagagttactataggattaaaaaatcaggctgggcacaagggctcacatctgttatcccagcactttgggaggcacaggtgggcacatcacttgaggctcggagttaaggaccagcctggccaacatggcaaaaccccgtctctactaagaaatatgtaacaatt

SEQ ID NO: 594551 - DNA, 478 bp, Homo sapiens
gttgaggctgagggaggtcacttggccttcgcgacacgtgaggcgcttatcaggagttctcagtaggaagcgctttcctgcagcctcaggcagagaccgtgcgtgcaaggcgggaccgaccgcaggtgcagaggccccgggcctgcccaagatcgaattggtcgcaaatacgttccctcgccagaaactttaaaaggccagaagaaaataaaccggattcagctccctctcatctccaaatctcggtgaccagcatctcgtaagaatgataaccatcagtaaccgggaccccaaaccttctcatcaaggcacctctcgggtcaccattactttaactttgaatttgggtctccttcatttttccgctggatgcgttaatgtgcgcgacccacagctccaggcggcggtttcctggcggaactggaccaccgccacaggctgggggtctgcagtgggggatgggaccggccgcggccgc

SEQ ID NO: 594552 - DNA, 151 bp, Homo sapiens
gcactggagtcagacactgtactcacagtggtaggactttcatttttgagaagataccatttgatccagcagaaaatgtcccaattatatcaggtcctctattcttcacctacagggaatgtagtcactttgatgaggaaaagaccctggt

SEQ ID NO: 594553 - DNA, 433 bp, Homo sapiens
tggaaggggcagccgttctctttattttcttttttagacggcgtgatttttgctctgccacccatgctggagtgcagcggcacgatctctgcgcactgcaacctttgtctcccatgctcaagcaatcctgctgcctcagtctgctgagtagctacgaccacaggcaccagccaccacacctggctaattgttgtttttattatagaggtggggtactaccatgttgaccatgctggtcttgaactgctgacctgaagtgatctgaccaccttgtcctaccaaagtgctatgattacaggtgtgagccaccgcaaccagtcatgattgaaactataatcttcttctccttggacgacgtccttcttcctttctttgaccaccagtttcttcctatgagcgctgcagccacaccacaagcacaagagcggaattc

SEQ ID NO: 594554 - DNA, 116 bp, Homo sapiens
tgaagctaatagatcaactagatcaagaactttcaactttcaagtcatattatttaagaaacaaatttcctggctggacccggtggctcacacctgtaatcccagcactttgggac

SEQ ID NO: 594555 - DNA, 441 bp, Homo sapiens
  misc_feature (3)..(3): n is a, c, g, or t
  misc_feature (6)..(7): n is a, c, g, or t
  misc_feature (15)..(15): n is a, c, g, or t
  misc_feature (40)..(40): n is a, c, g, or t
  misc_feature (170)..(170): n is a, c, g, or t
  misc_feature (234)..(234): n is a, c, g, or t
  misc_feature (254)..(254): n is a, c, g, or t
  misc_feature (259)..(259): n is a, c, g, or t
  misc_feature (281)..(281): n is a, c, g, or t
  misc_feature (380)..(380): n is a, c, g, or t
  misc_feature (412)..(412): n is a, c, g, or t
  misc_feature (414)..(414): n is a, c, g, or t
ggnctnnggcacgancccgtgcgaatctcaggcacgagangtaaaaatgctggctgccaccacagaggaaactggggttccactaaaacctagaggggagagcagacctacgctgggctggcctccaccccgtttcctgaccgctgccctgaggggctgaggcccatgcntggtctgaccagctttttggacatgcagagcccatgcccaggaatcctgctaatgcagggtgtnttcatgttcctgggggtgtntgggngaaggttggggaaggggaaaantggggagcccgttcttccaagctctcccttggtggatgccctcagccacacgccctgggagttcaaaggccctgaggtggtgagaggttgcactccggntttcaacaacaaggttgcggccccaagctttntnaacctactttaatagctattaaagtta

SEQ ID NO: 594556 - DNA, 620 bp, Homo sapiens
gccaggccagcacccgtgataagacagtgctttcgcgggcgttgatatccgccgtggtgatgttctgcttggcacaagcaatgatgtctggaagcctgattaatgacttcatctcctccgtgcacatgtaacagggtaggtcgattatattgaagagtatcagccccgatgcttctgcaagttgttctgcagaaaggagacataagatctgcacacagtatacagagatctgggtggggtcagaggcgtccatcacaaactcagcttcccaaagtgctgggatcacaggagtaagcccgcgcgcccggcccaaatgaagccgacctggtgtcactcgtctctgtcctcatgtggccatcagttctccatactggtatccgcggcacaggccagagagagaccgccagtttccatagtaactggaccagatggggcccatgcaccccccaagctcccggatggtgatctttctctgtgccacaatgtcagtaagattggtgcccaccgtggcccgtgtcgggggcggctcccacaggtcgcctttcccatcccgggagctcacctcctgcagccgtttcaacaacagtgtcttcccgacgcccgtggcccacagctcgtgc

SEQ ID NO: 594557 - DNA, 404 bp, Homo sapiens
gatggggtttcaccctgttgcccggactggtctcgaactcctgagctcgggcgatccggccctcggcctcccagggtgctgggattgcaggcatgggccaccacactcagccgagcccagtgatttcaaaccctaccaagaccacatagagtgattccccaaagcaaagggtgcagtgtagagaaaaagagggagaaaatggccagaacaacggcatacttcttgtagatcacaccagggaagagttacagaaccagcgttctagactggagggaagccttgggtggtagtagtaaaaagctattagggagctcactttatcccgactgctggaagtagtgtcttcatgacacctgggagtcaaggaactgggttctagtgccttctctgccacatactgttag

SEQ ID NO: 594558 - DNA, 331 bp, Homo sapiens
  misc_feature (182)..(182): n is a, c, g, or t
aaactaaacctctaaacaaagataatgaaatggatggggatgtccaatatagcaccacatgaaaacaagaaaaggaaatctccaggatcagaaaaacagtgtatttattactcagatggcaatcaagaaggatgctgtaggatcccatgctgatggtggtcgcccccacacccttccaccanacatatactggcatcgcgcccgctggtttggtatttaacacccaagcagggactggagatttagcctcttgcccatgaaagacacagagctggaactaagtcttttgtatgtggctggaagcactgaaggctgtcatctattttcttaa

SEQ ID NO: 594559 - DNA, 116 bp, Homo sapiens
catgaagtacaacagtataatcaaaatcaattgtatcatcattagttttccactgcctcacactagtgagctgtgccacgtagtagtgtgacacctgtgttgtcatttcacccatc

SEQ ID NO: 594560 - DNA, 135 bp, Homo sapiens
gttagggggagtatgagatcagttggtccaggctgctttatcgccctgccgggattacagcaacgcgcacttcagtgcccgcgaggatgcacgtctttactatgtgcacgatgagccgttgctgcgttacctggg

SEQ ID NO: 594561 - DNA, 153 bp, Homo sapiens
  misc_feature (51)..(51): n is a, c, g, or t
tggaagcaccctgttatctaaagaatctttgtaaaatttttgtaaaatttngttttacaaaattttatttgaaaattgttttttgcaaaatggttatatttctgtatgaaatgtattttttattggaataacataaaaaaatccttatcatcc

SEQ ID NO: 594562 - DNA, 103 bp, Homo sapiens
cttagtgctgacttgatgctatttgtaggttgatgtagtatcattgaggtcagagttgtatagaatacttctcattgcccactcttttttttttagagtgggt

SEQ ID NO: 594563 - DNA, 1200 bp, Homo sapiens
caagccggggttccccgttgaggattgtgcccgcaagaggtgagcgagggtcgccgcccccctgccccaggagtgggtgggccacggggtccggggggaccactggccacaggggggcaatcccaaatgctcggcctgtggaatggcccccccttccccagtgtttttttgggcccagcctggcccaaaccccgtggttttacggcccacgggtattgacccagcgttattataggacctgcccaacgtgggaggacaccctttgggggcgtgcccgggacttcccccgtgctggttcccccggatttttgacctgtgcggtgtgttccatctcaatagctgtggggatccccagaattggggatccccttgtgagccccgggaactcccgggaggtatctctccagggccccatgggtctccttctgggatgccacccccctttacccgggggccccccttcgggggaggccccgggatttgggcgataggcttataggccccctcttgcggttatagttgctcttggggataatatcctcggcgcacccacaggtgggattcccccccacctcttgaagccacggagaagatttcacgccacggactcacccccacaggtttatattgaagagaagctactcgagcacaccctcttttacacactcgggggagcctccacagagaagggataatataggagagagaagaattggtggagagttgcaccgcactttcactgagaagaaagtaacactccccacttgtgtggccacaaaatgtcactctcacaagcctctgtgtcctcgagacaccacggaggttccggccaccctcaccactttcgcacgaaagaggtattttcacccgcctctgcgccacgtccacggatagcactgaggctcacgaacacccgcccacggaacactctcccacgttatcacggcccgcgaccacctcggagaaacttctgaattcgagactggccccacgccccactggcgaaggcccccactgagccaagactgtggagcctcccacggagtgccgaggaaagctgtggaggttggtccacgctaatgcttatactttaaagaaaggtttctggagaaaggaggaagaaaacgtaagaagccgaaagtgagggatgaatcagagacagaagatgaagaggagaaaagcccagaggacccggagcca

SEQ ID NO: 594564 - DNA, 411 bp, Homo sapiens
tgagtgacagagtgagtagagtgagattctgtctaaaaaaaaaaagctttgatattaaatctgctgctggtctagacccaaaacatttaatagtagtaatctctgatgagcaggattaagggagcctgtcattttttacgttttatatttctacatgcatatatgtatatttaaagtacagttgactcttgaacaatatgggcttgaactgcacaggtgaacttacgtgaggattttcttccacttctgccactgctgcgataataagaccaacccttcctcttcctcctcctcattctactcaatgtgaagacaacgaagatgatgatctgcttccacttaatgagtagtaaacatattttccttatgataagagtccttatgattttcttttttcttttttgagacaga

SEQ ID NO: 594565 - DNA, 110 bp, Homo sapiens
ttatcagctcgtaccagtgctactccacaaacagctgggattagaggtgtgaacactgtgccccgcccattattcacttttgacatttcagtcttttatccatttggaat

SEQ ID NO: 594566 - DNA, 586 bp, Homo sapiens
  misc_feature (557)..(557): n is a, c, g, or t
cgatcctgttctgtgttgtccattctcgaaactctcacctgcctctggtgcctcaacttccccttctgtcgaatgagataggttcttgattggaaaacccctgcggaccctgatcctctgtccacctgtgcaaggggagcacctgagccacggctgcccgtctgcaggctttcttggctcctgggtcctgcaggatccagcgcgtgactttaacaatgagaactcagccaaagagaaggatctggaaaaaccctttgcagcccagcttgttccctgagcccagctcgataaagccatgggaacctctagcttttttctacacacacccaggtggcagggacagccagtttcctgcagtggggcgaggcggggggactcggctgcccccaggttgggagacagagccgtgcatcaaagcagggccgccaggagcctggggtctgtcctggcacagctgacagctcactgcgtagcctggccatcccagtgccctgggcctcccagctggcacagggttggtctcacaagccctatgcccacgttctgcccagtctggncatgatcacccagtggggggagtcgcctt

SEQ ID NO: 594567 - DNA, 315 bp, Homo sapiens
aacaagaaaggagataagggtacaagaagccatatagggcagcaaaacaagtaacatagaaaggagggtccctagtgatagtagtgtagtgctgatataaccatggagatagccctggctcctatgcagcagggctgggcctgcgagacccaaggctcactgcagcgcgctcctgacccctccctgcaggggctacgttagcagcccagcacatagcttgcctaaaatggctttcactttctacttttgttataaaaatgactcataggtccctgacatttagttgattattttctgctacagaccccatgcctg

SEQ ID NO: 594568 - DNA, 345 bp, Homo sapiens
  misc_feature (24)..(24): n is a, c, g, or t
  misc_feature (82)..(82): n is a, c, g, or t
  misc_feature (300)..(301): n is a, c, g, or t
ccccctctcccctccttatcccanactcaaccttcctcatcccaaaagttgaaagaagatggcccgggcgcggtggcctcanaccctgtaatccccagtactttgggagactgaggcaggaggatcacctgaggtcaggagttcgtgaccagcctgaccaacatggtgaaaccctgtccctactaaaaatacaaaaaaaatagctgacgtggcagcacgcatctgtagtcccagctactcgggaggctgaggcaggagaattgcttgaacccgggaggcggaggttgtagtgagccaagnntcgcgccactgcactccagcctgggcaacaagagcgaaactcca

SEQ ID NO: 594569 - DNA, 216 bp, Homo sapiens
  misc_feature (47)..(47): n is a, c, g, or t
  misc_feature (70)..(70): n is a, c, g, or t
  misc_feature (88)..(88): n is a, c, g, or t
  misc_feature (120)..(120): n is a, c, g, or t
  misc_feature (130)..(130): n is a, c, g, or t
gctcattgtaagagcttcattttgtagcaaatggcatatcacagganctgtccagataatcgatattttnagtatacaaatgtaaatnatcacagatgagaatgtacttagctgtatttncaaataagtnatcttccccccttttgtaggactttgaaactaggcatcaatgaaacctgtttttgctattatgactgggatttagtcatgatacct

SEQ ID NO: 594570 - DNA, 245 bp, Homo sapiens
ttctcagttacacactatgctcacacctttgaaactcataccttgtctcccaacttaggggtcatctgagtaatggtgacagtaatattagttaaaatttatcaaacacttatcagtatcaggcactacattagtgcttgttttccatatctcatttaattcatgccaagctgctgttattatttctgctttacagataaggaaactgagacatagagaggataagacattttccagagtttatc

SEQ ID NO: 594571 - DNA, 483 bp, Homo sapiens
gtgactctccccctagggcccaagagatgaagggctgggtgaggaagcccgtggatgatgggtacccaatcagactcaatgaacaagccccgttgcctgtaacactggaactaatgaaactgatataagcagctctaatctatcatgccaactgacagagtactcttgcttcagtgtcttgaagtacatgtctatgtatctgagtgaagtgtcagttctttaatattactgacaagtccatgttatttttgcttctaggatagaattagaaaagcatgttaatctcttatggtgatctttctcattcaactgtgagcaactctgtcttacatctgctttgcacagcctgaaagcaactctcgtgcgtctctgattataatctcagacactttgataaaaatgttctcactggagtcattagaactcaatgtcaaatctgttgtaaacagattgaagtaattacgattctaatgctccaaccac

SEQ ID NO: 594572 - DNA, 188 bp, Homo sapiens
cttcattggcggccaattgttggcccaaaacttccttcaatctcaaactctccaggcccacctttctgctttcccagttggcattgaacaggcccagcttttgactttgagaacagccttcttgcaggcccttgctcttgcttcccaggggcttttttcccccaacattcgggaattcttctagagtc

SEQ ID NO: 594573 - DNA, 113 bp, Homo sapiens
actccttacacaggattggtacaaggaattgggtcactggaccgggtcatatatttcagagggacgagcaacatcacccaatggccagttatagagacggtgaaccattgaag

SEQ ID NO: 594574 - DNA, 399 bp, Homo sapiens
  misc_feature (242)..(242): n is a, c, g, or t
  misc_feature (246)..(246): n is a, c, g, or t
  misc_feature (250)..(250): n is a, c, g, or t
  misc_feature (274)..(274): n is a, c, g, or t
gcaacctgtcctctgcctctgccatcatgggcaaccccaaagtcaaggcacatggcaaagaaggtgctgacttccttgggagatgccataaagcacctggatgatcttcaagggcacctttgcccagctgagtgaactgcactgtgacaagctgcatgtggatcctgagaacttcaagctcctgggaaatgtgctggtgaccgtttttgcaatcccatttccgcaaagaatttcccccgtangttncagntttcttgccagaagatggtgactncagtggccagtgccctgtcctccagataccactgagcctcttgcccatgattcagagctttcaaggataggctttattctgcaagcaatacaaataataaatctattctgctgagagatcacaaa

SEQ ID NO: 594575 - DNA, 514 bp, Homo sapiens
  misc_feature (106)..(106): n is a, c, g, or t
  misc_feature (167)..(168): n is a, c, g, or t
ccatttccccctttcccttgggggcgggttcttttccaattgggggggggttcaaacttttgggggccgggactgtcagttttttgggaagggggaggggcatccncgaggggttttcctcctttgtttttggggaacccagggtttttttcagggggtttaggganngccggggggtttccccccggggggcccaaatcaaggggggggggtaaaaggttgtaaaaaaaaaaaaggggggggggggaacggggggttttttcccccccttgggggggtggtcaaaggggttttggggggttccccctttttttccccccccccttttttttttttttaatcaagagaaacttccagggttatggggggggggggttttcccggggggggaattggttccccccccggccttttttgaaaaggggggttttttttttttaaccaaacttccccccgggggggggggggttcccaattttttcaaaaaaaaagggaagggtttgggaacggccca

SEQ ID NO: 594576 - DNA, 218 bp, Homo sapiens
ggaagatgacaatttggcagtacagattccactgacaggaaaaattgacttgcatatgcgagagagacagccaatggatatttctcatatttgatatttcatggtggaataacacagagacatgttttaactgactttggatcttcatcacctcacagagagtgtgttgatggcagttccactgaaggacaactaatttataacttgttctatattgt

SEQ ID NO: 594577 - DNA, 360 bp, Homo sapiens
  misc_feature (9)..(9): n is a, c, g, or t
  misc_feature (26)..(26): n is a, c, g, or t
  misc_feature (112)..(112): n is a, c, g, or t
cccccttanattgcccaaccccctanatgtgagtcaagcccccctggatgtggtgcctggcagcgaccctgtgattggacaaccccccaattataaaggcaaatggaagccnccctatgattgacaatccccagttcccccaggtttgtgccctcttgatggttgagttgctttcattaatctgtttgtattcagatagaagttttatctagagtaaggctgcccaggttggtcattatattcaagctgttgaattaaaagcagaaagtagacttcctaagttgaaagagagctttcaaggataggctttattctgcaagcaatacaaataataaatctattctgctgagagatcacaaa

SEQ ID NO: 594578 - DNA, 108 bp, Homo sapiens
cgcaaatggcttgcacgtatttaattgctgcggtgctcagcggggacccgcggggtcgcagcccttgctgcgggggtaatgggtagtgataggggcgggagggtccca

SEQ ID NO: 594579 - DNA, 966 bp, Homo sapiens
  misc_feature (8)..(8): n is a, c, g, or t
  misc_feature (29)..(29): n is a, c, g, or t
tgcactcnggtcccacaacggaactaccngcctcacggatagtatgtgcatttcccaacaatgtgcactcacttctagttctctctatcgcatatacatacattcctatacagaacactagagacacataatatatccctcactttcacaattaacctattttcactctcccttaatttttctagcctttattctcttctttttattctttgacttttcctctttagtatatttcgccccacaaggggccgagccttaatctagcagagcatagagaagaggctgagtattgtacttagtttatatatatatatttattcttattttttttttttatttttttttttttttcttcttttctttgattttaatttttattatatatttcttatcaggtcgagaagattaatgaaaaagatgatggagtagcgaacccacgcgcatctcgccggcagctttatgtatccattctctcgttctttcacgtcacttcttcacgcttcctctcaccgtgccccatattctacctcccttcttcttctctgtctctctctgttgttttcgtccttcgtttttcgtgcctgtgcatatcttatctcttctcccctcttcttctccagttgcacacttctggattctaagtctagcaaattcgagcttatgtcgcctattttacgcttccattcatattacttacgtttatctcacactcctcctgcgtttacgtttttcgtttattcttctcctcggccctctgtttaatcggttctttatcgtgagaacacactcatccaagtatggactgctcactatctcctctgcgctccccgttgtacctgatctccattgatctctacttcttcagtatactctccgctcttctcgcatatgacgaaatattactacgttacgatacgttactgtcacactgccagccttctctaatcagtacaagcgtcactccag

SEQ ID NO: 594580 - DNA, 458 bp, Homo sapiens
agcggagtccgcagagcgcgagccgccagcccgtaacggtcgccagtgtgaggggcgggagggaaagaagaggggaaacacaaagccggtacgcgctgcgagataacaagagtaatccacagactatacgagcaacgctcagatgccagacaaggccgtgagtaaccactcctcctcctcacacaactatgcctccactacacgcacgaaggcatatccatgaacgccatccaaggagcaacattgagacccaatctacagtcaaggcgactaaggacaaccaattgtactaccatgcacctcctaacgatagcatagaggagctgtcaaaacactgaatggcaaggctgactgaagcgcgaaagctacagtcgagactccactgagcagatatcccatgcgcgcttaggcgacagaccttgggactggccccactacagacggacgcgactgccgac

SEQ ID NO: 594581 - DNA, 244 bp, Homo sapiens
ctatgctgtctcaacacacttgaactggagtcacccggctctgttggttgaacactagagcaacacttactccttctatctcataagccaacctctcttcatccccttcctaacccaatacccttcccagcctgcagtatctatttcttctactccctgacttcatgagatcatcagggcggtcatgtgcacggcagcatggtagttatcggttattggcaaaattcatgcgacagcatatcca

SEQ ID NO: 594582 - DNA, 211 bp, Homo sapiens
  misc_feature (45)..(45): n is a, c, g, or t
gaggatcccagtgctactccacaaacagattccttacagtctttngtaatctctcttactctttcccactaaggacattccaaggtggttcagacacagcacaagaagtacttttacagatttttttttttcattttacattaaggatgggtcttatcttttttttttttttgggaaagtctcgcttggtcgcccggcgggtgggggaggg

SEQ ID NO: 594583 - DNA, 270 bp, Homo sapiens
gccgggcgtcgagagatacttctacatagacataatcaagtatgactatatggaaaccaagcatcattaacattctctcaacactcctaattgcgaagcaatcgataacatttcaacgcagtgatacacatttctctagaacacagaaaagaagtgattgaccacgattataacaagtactctaggcactggatgctgatgttttctatccccatccctaacatttgaacgacctatgagagaaatgagtacttagatgacaagtagatg

SEQ ID NO: 594584 - DNA, 109 bp, Homo sapiens
tttaggccggacactccccggtgcatatgagctctcggtaccgatcgcgtgattgctcctggaccctgccgctgtacaaactccaccagccccagtgtctggcctacca

SEQ ID NO: 594585 - DNA, 400 bp, Homo sapiens
gctgagggtgaccacggtctgaccttggaggacctagaggcccccggtaaggagcactgaaggagaagaatctagccatgggtgggtctccattgcccagcgtccgtgcccacacttcccgcctgttgccctgatccagagtcatcatgcctcttgagcagatggagtcagccttactgcaagtcctgagaggaattggccttgatggcccgagagagaggcccatgggccatggtgggtgcgcatgtgctcctgctatctgatggatgcaggtgatggcgtggctcctcgctcttcttactctaaggttgaaggtcaccctgggggtaggtgccgtgctgccgatgtcaccaggattcctcccctgaggtcctcatgggatgcctcccagactccccag

SEQ ID NO: 594586 - DNA, 142 bp, Homo sapiens
gagcggagtatggcaaaggtcagctgcctagatagtctggtccaaggatctggaccgcaagctttgagatgacaatgtagcaacatgcttctgtgtgggagcaggagctgaggtgggcgtggacgggactccggctcctgcg

SEQ ID NO: 594587 - DNA, 215 bp, Homo sapiens
aagattccagtactatccacactgctgttacaggcactcatgttgagaactttgatccagactgcagagggctggcatggaaaatcacatgcatgtaggagagtcacctgaggaatgttttaaatgctgatgcctgagtttggaccatgaggattcaaatgtaaatgatctggaatgtggcctgggatcaggattttagtaaagcactttagggt

SEQ ID NO: 594588 - DNA, 1293 bp, Homo sapiens
  misc_feature (1235)..(1235): n is a, c, g, or t
ctgggcctcatatggttttggttcctaagtctacattacacaactggatgagtgaattcaagagatgggtaccaacacttagatctgtttgtttgataggagataaagaacaaagagctgcttttgtcagagacgttttattaccgggagaatggatgtatgtgtaacatcttatgaaatgcttattaaagagaagtctgtgttcaaaaaatttaattggagatacttagtaatagatgaagctcacaggatcaaaaatgaaaaatctaagttgtcagaaatagtgagggaattcaagactacaaatagactattattaactggaacacctcttcagaacaacttgcatgagctgtggtcacttcttaactttctgttgccagatgtgtttaattcagcagatgactttgattcctggtttgatacaaacaactgccttggggatcaaaaactagttgagaggcttcatatggttttgcgtccattcctccttcgtcgaattaaggctgatgttgaaaagagtttgcctccaaagaaggaagtaaaaatctatgtgggcctcagcaaaatgcaaagggaatggtatactcggatattaatgaaggatatagatatactcaactcagcaggcaagatggacaaaatgaggttattgaacatcctaatgcagttgagaaaatgttgtaatcatccatatctctttgatggagcagaacctggtccaccttatacaacagatatgcatctagtaaccaacagtggcaaaatggtggttttagacaagctgctccctaagttaaaagaacaaggttcacgagtactaatcttcagtcaaatgacaagggtattggacattttggaagattattgcatgtggagaaattatgagtactgcaggttggatggtcagacaccccatgatgagagacaagactccatcaatgcatacaatgaaccaaacagcacaaagtttgttttcatgttaagcacgcgtgctggtggtcttggcatcaatcttgcgactgctgatgtagtaattttgtatgattctgattggaatccccaagtagatcttcaggctatggaccgagcacatagaattgggcagactaagacagtcagagtgttccgctttataactgataacactgtagaagaaagaatagtagaacgtgctgagatgaaactcagactggagttcatagtcattcacaagggaggcttgtggatcagantctgaacaaaattgggaagatgaatgcttcaaatgattagacatggagcacacatgtg

SEQ ID NO: 594589 - DNA, 879 bp, Homo sapiens
  misc_feature (821)..(821): n is a, c, g, or t
ctgggcctcatatggttttggttcctaagtctacattacacaactggatgagtgaattcaagagatgggtaccaacacttagatctgtttgtttgataggagataaagaacaaagagctgcttttgtcagagacgttttattaccgggagaatggatgtatgtgaatggtatactcggatattaatgaaggatatagatatactcaactcagcaggcaagatggacaaaatgaggttattgaacatcctaatgcagttgagaaaatgttgtaatcatccatatctctttgatggagcagaacctggtccaccttatacaacagatatgcatctagtaaccaacagtggcaaaatggtggttttagacaagctgctccctaagttaaaagaacaaggttcacgagtactaatcttcagtcaaatgacaagggtattggacattttggaagattattgcatgtggagaaattatgagtactgcaggttggatggtcagacaccccatgatgagagacaagactccatcaatgcatacaatgaaccaaacagcacaaagtttgttttcatgttaagcacgcgtgctggtggtcttggcatcaatcttgcgactgctgatgtagtaattttgtatgattctgattggaatccccaagtagatcttcaggctatggaccgagcacatagaattgggcagactaagacagtcagagtgttccgctttataactgataacactgtagaagaaagaatagtagaacgtgctgagatgaaactcagactggagttcatagtcattcacaagggaggcttgtggatcagantctgaacaaaattgggaagatgaatgcttcaaatgattagacatggagcacacatgtg

SEQ ID NO: 594590 - DNA, 1147 bp, Homo sapiens
  misc_feature (117)..(117): n is a, c, g, or t
tttttttttttggtaacataactgcgtgctttattggagatacacagtaaagcagtcctcataatcacaactagtcaaggccactattattgtgggtgacagctcgtgccatcatgntgtggtgacaacagtgccagtaacacacgtgcacattttaaaaaaataattcgtcaaagtgttcacaggtgtgtgggtgttcaaaacacaatatattatgatactcaagttaagaactcagtaccgtgaaaacaagtgacaaaacagtgccagtggtgagtgtttatgcttcagttacattatgatttacagctttaaatactgtgggtggttataaagaacacaacacgaaaatagggtccaaattaattatgcttaaaatgcagcaataaagctctcaattttggttcaaactcattatgacagactcactccagaagcctcaagtggtgctcctcaacaacaacaaacacaaacaaaaacacacaaaacacacacaaaaacacaacaacaagacaacaaacaacaacacaaacacacaacgaaaacaacaaacacacccgccaacacggcccgcacgcacaccaacacgcacccgacaaagaaagacaacccacgaaaaaaagcaagacgccgagcgaaacggaaacaagaaaacaagagggaaagcagccagaccccacacccgggacaacgcacagcacccgtcagaacgaacgcgagacaccgcagggcgggagagcagggcggggcggaacagagcgcagggaggcagacgcggccgagaggcgagcaccaggcacgagcgaggagcgagaaggcgcacacagcgccgcaagcgcgcaacccgcaaccaacgaacaagagcacaacgcgggcagaagagacgcaggcgacaacgagcagggccagacaacccagaggaacaccgactgaggtggaacggagggaaagccggactcgcgaagagcacggaccaaaaagagccggagaaccgacacacgaccaagcgcacgaacagaaaaacgaagagaccaaaagcaagagaagcgcggcggaaggacgagaaacgcaagacaaccacccgggacgcaacgacaggggaggcgacgcaggagagctagagagagagcgagattgaggcgggggc

SEQ ID NO: 594591 - DNA, 238 bp, Homo sapiens
agtagctgggaccacaggtgtgtgtcaccgcacccggcttattttttttattttttgtagagatttcttctttgacctatagataatttaggaatgtagttttaggccgggtgctggtgtcacgcctgtgatcccagcactttggcaggctgaggcaggaggattgcctgagcccaggagttcaagacctgcctgggcaatatggtgagacgctatctctatttaattttaaatttaa

SEQ ID NO: 594592 - DNA, 149 bp, Homo sapiens
ggtcagatgctgagtccaaattgcaaaatatagcttctggtatagaccatcgtgctttaaaattctcaacatgtcttaatatattctagtgctcgggaaactcttacacatagccttttctggctatttaggggaaagccccagatcag

SEQ ID NO: 594593 - DNA, 428 bp, Homo sapiens
  misc_feature (42)..(42): n is a, c, g, or t
  misc_feature (62)..(62): n is a, c, g, or t
  misc_feature (136)..(136): n is a, c, g, or t
  misc_feature (217)..(217): n is a, c, g, or t
  misc_feature (426)..(426): n is a, c, g, or t
ataccacatttgtcactataaataaacttattgaaaaaaaancatactatttaaataagaantcagttcatgaaagtatacaaaatacaaccaatgtactctgacttgtggttatatcttaactatctcaactgtncttttctgggtatgggccagagccttttgcaaatattaccatggtattttaattttatgatataaaacagtagcaatttangaagttttccattataaaaattaatatgggcaattgctgcaaaatactggaaaaaagctggttttatggaaaggcgaggtagccgcagcatgcagctggcaagcggtatttgcgctttgctgcttaggaaaagcatgcttgcaaaagggcacattttaattactaggtggtttatatgctaaagataggtaggtttgggttttgaattncc

SEQ ID NO: 594594 - DNA, 805 bp, Homo sapiens
  misc_feature (435)..(435): n is a, c, g, or t
catctggcaaaatgtcactttgcctgctgtattctatgttcctattcgaccaaatatcgtgaacttgatcacaccaaacttgcgtcaagaaacaacagacagccctatgctgtcagtgaatcaactggtcatcagacagagtgctgagtcttggaggtactggcatgacttctagtgcgctcgaagtgcccagtatgttctgagtgtgggtgggagctcaccagcatcttggcctagtggctgctattagaaacactatcgtgtcgatgggaagcacgaatcgtttgcacccaaccaaataacactggcagagaccagctaggctatcctgtagagtgagcatcataaccccaaaaacagatcactgacctatcatggtatctagcccttgagctttagccatcatagcccaaccgagcgactagagtcaatgtnctacaggtccatcagcattgagggaagttccgtgaagcttccttaggcttcatgttgaacggtaaccgttgaagagctacaaggaattagccacggaagcgtgttgtagctccttaaccaaacttaaattcctggaatgattatcaacacatacggtcttagtagcttctctcagtggacactgagaatgtcgttggcattaggctaaggtgatgaataccgtacgaccggtatcccagcgcaggggcccgtgcattccttctactagatgaggatactctggtatcatcagggggcctttcatgaaatcatccctgtgacattgatctctgcttaaatgtaagctagctgaacattttgaagcttgctc

SEQ ID NO: 594595 - DNA, 367 bp, Homo sapiens
  misc_feature (186)..(186): n is a, c, g, or t
  misc_feature (211)..(211): n is a, c, g, or t
  misc_feature (217)..(217): n is a, c, g, or t
  misc_feature (221)..(221): n is a, c, g, or t
  misc_feature (225)..(225): n is a, c, g, or t
caagggtgaaaggcatcgtggagcgcaggcctggggggcaaggactccccaaccaaaggcaagggttggctcccagatcctctagcccctgctccatttccacccagtccattgaagaggaatgaacaatcatctgagctggaatttctttctagtcctttctccagccaaatccttcttaaagcnaaagtcctggctgagcccctgtccntggggnccgntctnccgtgtgaccaggggaagaaagttcccgaaagcctgttccaccaattctgcttctgtgttgtgaatccagtctgctttccattagaaaaccgcttcggcacttatggtccctttaataaatctagtatgtaaaaaaaaaaaa

SEQ ID NO: 594596 - DNA, 120 bp, Homo sapiens
aggtagaagcggcggttggcctgtgaccccaggtagagggcatacatgtagctgtagaggcgctggtaggagtgctgcatcatcgtactaggccagaccagataggagtatgcgaggcaa

SEQ ID NO: 594597 - DNA, 493 bp, Homo sapiens
tggcgacgccagtgacgcacggtcggacagaacgtctgtgccccaaatcataacggccagttcttcgcgtactggaatcaccatgggttacttgtagctggtgccatttctcctcatcaacccaaatcccgcttcccagatggaccttgccatggtctaggatatacttgtccatgacaggcgcaggagcggggtaataggacgacgtattggcttcctcactgaaagtgctccgtaactccggctcgggctcgagacattctgactttactttttccagatcaatggcgggaccgctgccaagcctcaggagcagcacgtccgggagcctccggttaaggtcacggagctccttcattccagacacaagtgccccgtactccttgagcttctcggcctgttgtaccagctgcctccgagtccgctccagctcctgctggaggtggcgcatctcttcctgttgctgctggtagttgcgcagaagctcctcata

SEQ ID NO: 594598 - DNA, 534 bp, Homo sapiens
cgggtcttttttttttttggagacggagtctcgctcggtcgcccaagcgggagtgcagtagcacggtctcagctcatggcaagctccgcctcccaggttcacgccattctccggcctcagactccgtgtgtgttagctgggagtacaggcaccgtgccaccatgcccggctaattttttatatatttttttagcagagacagtgtctcactgggtaagtcaggatggtctcgatctccgtgacctcgtgatccgcccggcctcagcctcccaaaggtgctgggattacaggcgttgagccaccggcgcccagcaaggcgggtctggcgtgggttttcccagagctagacgggtcttgaattccagggctcaagagatctcccacctcaggcgctcccacagggctgggattacaggcgtgagccgccacacccagccatattcaaaattttttttctcttaggagacggggctcttgggtggcccaggctggaacggcaggtgatacaatcatagctgactgaagcctcaaatc

SEQ ID NO: 594599 - DNA, 146 bp, Homo sapiens
ttatgtctgacccacccttatgggtagagccagcgtagatatcggaggcggtgtcgtgggagtgatgagtaagaagatcctgctaatctatagtgcttgtagtggagtggggctgatgactgggtgtgggtcacgagacataaggt

SEQ ID NO: 594600 - DNA, 701 bp, Homo sapiens
  misc_feature (133)..(133): n is a, c, g, or t
tcagagaaagaggacagcttcgacaccctatgatttcatctctgacccaaccaatcagcactccccataccctagcctgctacctaccaaattacctttgaaaaatccctaacctccaagccttagatgagtntgatttgagtaataactctgcctcccacatggtgtggctggcatcatgtcaattaacctctttctttactgcagtgccatggtctccatgaactgattttttgtgcaggggcaggaagaacccatcgggcagctacacatcttgaaagagaagctcttcctgtgaggtacatcaactgtggttaagaatcttacatacttatcattttttgtgtgtgagaacatttaaaatctacccttttctttcttttttttttttttttttgggggagggggtcctcactcgttgtggcccaggcgggagttgcaagggcttgatctgggttcaccaaaaccgggggggtccaaggtgatcctggtgggcctcagcctccggagtagcggggatcacgggctgtgcaccactcttttagcaattttattaataacatgggtctttggacaaagtatctaacctttaacttagaataacggcggtatatgtgcaggctggcaaagggggaaaacggggagcagaagctgggggtatgaagatcctgtggcaaaatgtggcttgtacacaagcaaaa

SEQ ID NO: 594601 - DNA, 456 bp, Homo sapiens
tccaggcatacgtagatcgtagatatacaggaactctctttcagcattaataataggctacagctgcatagagccggttagttacttccaaaaatcgtgtacacaagaatcttgatacaattcgcaaatcagacagcatgcttaaaaggcttcgaagtaaacttctatcaattgcttcaccattcctttccctctcaatcaagagaagaatgccatcaattgtcttattctgcactttctgatcacttataatatgagccctaaataactccagtcccatgtcccaaatggagggtagcattgaattctgaagaacgtacgttctatacagaaacaaaaaaatgctcctgatcatgatcattagtcggcaatggttttgccagcatatatcaatcttctttaaaacacaaccgctatccattgactcctctctgactcgatgaatctgtgcttaga

SEQ ID NO: 594602 - DNA, 311 bp, Homo sapiens
  misc_feature (15)..(15): n is a, c, g, or t
  misc_feature (101)..(101): n is a, c, g, or t
  misc_feature (113)..(113): n is a, c, g, or t
  misc_feature (124)..(124): n is a, c, g, or t
  misc_feature (145)..(145): n is a, c, g, or t
  misc_feature (149)..(149): n is a, c, g, or t
  misc_feature (171)..(171): n is a, c, g, or t
  misc_feature (173)..(173): n is a, c, g, or t
  misc_feature (182)..(182): n is a, c, g, or t
  misc_feature (185)..(185): n is a, c, g, or t
  misc_feature (194)..(194): n is a, c, g, or t
  misc_feature (239)..(239): n is a, c, g, or t
  misc_feature (243)..(243): n is a, c, g, or t
  misc_feature (249)..(249): n is a, c, g, or t
  misc_feature (284)..(284): n is a, c, g, or t
ggctcgatggggcangtgcgtggcaatagtgagtgaggacatttaggaagatttttcggcctcgatctgggaggcgagtgtgctggtggcgccgcaggagngattgccatggngcggcggcggngcaacttcagctccaccagcncgtncccgttcagtgcctccgggctngnggctgggcnggngcccctggngcgaacgagcgcggccgcgcgaggctgtggcgagcggcgggtggnggcnaatggnggcggcccttctcgtcgaagcccctcgcagatctngagacagcggcatgttcagctgttcct

SEQ ID NO: 594603 - DNA, 444 bp, Homo sapiens
  misc_feature (22)..(22): n is a, c, g, or t
  misc_feature (65)..(65): n is a, c, g, or t
  misc_feature (149)..(149): n is a, c, g, or t
  misc_feature (188)..(188): n is a, c, g, or t
  misc_feature (290)..(290): n is a, c, g, or t
  misc_feature (334)..(334): n is a, c, g, or t
  misc_feature (348)..(348): n is a, c, g, or t
  misc_feature (440)..(441): n is a, c, g, or t
ccagagccaatcagtagccagnatctgcctcccctcactcccaccgcagatttggctcttggaancctgggaacatagaactcatgcggaagagttgagacctacgagaaatagaaatgggaactactgctggcagtgaactaagaaanccttaggaagaatttttatatccactaaaatcaaacaantcagggagtggctaagcacggccatataataacatggtgtctctaaaatagccataaagggaggactcatcattccatttccctctttctactatttttcanatctctctcttttaagttgggtgatatgttggagattctaatgncttattgagcgatnataacaggaaaagaagcagggttggttccctctttttgtcttatctaagccttctggttttatgggcagagttccgactgccatcttggccnntct

SEQ ID NO: 594604 - DNA, 726 bp, Homo sapiens
gaaaaaaatttaaaaaaaaaatttaaaaaaaaaaaaaaaaaaaaaaaaaaaaaaaaaaaaaagaaaaaaaaaaaaaaaaacaaaaaaaaaaaaaaaaaaaaaaaaaaaaaaataaaaaaaaaaacctttggggccctcttggcccaagttttttttaaaccgagaaaattttaccttggcgcccaaattcgggcctttttggccaaattccccttaaggggggccttttaaaattcaatggccggggttttaaaacgtcgggctggggaaaacccttgggtcccccaatttatatcccttggaataaaaccccttttcgtccggtggcctaaatcccaaagggccccgaccggtggccttttacaaaaattgtgccaccctaatgggcaatggaaaattccaccgccaaatatctggcaaaactcgcctaaacatttctgctaaaccgttattttttaaaacaaatggcccaatcgggtaaactcctttttaaccaaataaattcccccataatgggcccggtgtggttcccactttggaaaagaatgtcccctttaaagaacgtgggtctcaacctcaaagggctaaaaccccttttttaggggcgatggccctctttcgaacacctcccctaaataattttttgcgggctaaggtccccaaaactctaaattggcccccttgggcccccctcttttagagctttgcggtatctgcacatctttc

SEQ ID NO: 594605 - DNA, 195 bp, Homo sapiens
ggaggctgaggcagtgagaacttgcttgaacccttgtaggcagaggttgcagtgagctgaggtcgcgccattgcactccagacctggtcacagagcaagactctctcttgaaaaacaataaaaattaaaaaataaatttcattatctgcataccacatgatattatgggatacatatagatagttgtaaatagcg

SEQ ID NO: 594606 - DNA, 684 bp, Homo sapiens
cgtgggtatggtcaaccagatttttcagccaagttgtcctttgcgggtacaccatatcaagtctttcggaaccagcggtattatctctagctcgtcggcaactgaaagaacaattccagctttaccggtgtatgtggcaggaaataaataacattagttgctaagggtcttcaaaacacagtcgaagataaaaatactgcctttcctttttccagtgaaagtacaaaaagagctgtcagtggaagttatcacaggcagtaatactgatttgaaagactgagataaaagtttttttttcgatcaacagtgccaatggttggacatacagaatggaaagtcctccttgtcttctctcagataacctttgttgttcattgtaaggccaatgtatcttcaaaaacttgccccacgcgcaaagttgcaaaagcatagtacagtttgcgctaaatgttttcctatgttttacaatctgcttggcagccgcaggttaagcatcaaggactgtttggtattaaactttgtgttcacgggatgcgccaaagtgtgtaccccgtaagcatcaaacccgtgtttggcgtaatttttttagttcctagcgcggagcatcaaacaagcacaatacgttctgttattatgacttcctttcgtttcgtttttcagaagcactccactctgatctttgga

SEQ ID NO: 594607 - DNA, 198 bp, Homo sapiens
ccgcagcggcatttcgtcgccccacagcgtccagtagtggatcagggccgagccggacaggttcaggaacagcttgccggcggccgggttctggtcgaagccctgggcgccggcgcggaagctggccagctccagttgcggatgcaggccctggcggcgggcttcggcgaacagggcgtcgggaaagtgcagggtggt

SEQ ID NO: 594608 - DNA, 471 bp, Homo sapiens
  misc_feature (39)..(39): n is a, c, g, or t
  misc_feature (71)..(71): n is a, c, g, or t
  misc_feature (102)..(103): n is a, c, g, or t
  misc_feature (106)..(106): n is a, c, g, or t
  misc_feature (138)..(138): n is a, c, g, or t
  misc_feature (144)..(144): n is a, c, g, or t
  misc_feature (152)..(152): n is a, c, g, or t
  misc_feature (161)..(161): n is a, c, g, or t
  misc_feature (163)..(163): n is a, c, g, or t
  misc_feature (187)..(188): n is a, c, g, or t
  misc_feature (194)..(194): n is a, c, g, or t
  misc_feature (197)..(197): n is a, c, g, or t
  misc_feature (214)..(215): n is a, c, g, or t
  misc_feature (221)..(225): n is a, c, g, or t
  misc_feature (227)..(227): n is a, c, g, or t
  misc_feature (258)..(258): n is a, c, g, or t
  misc_feature (260)..(261): n is a, c, g, or t
  misc_feature (264)..(266): n is a, c, g, or t
  misc_feature (279)..(279): n is a, c, g, or t
  misc_feature (298)..(298): n is a, c, g, or t
  misc_feature (301)..(301): n is a, c, g, or t
  misc_feature (309)..(309): n is a, c, g, or t
  misc_feature (368)..(369): n is a, c, g, or t
  misc_feature (376)..(376): n is a, c, g, or t
  misc_feature (384)..(386): n is a, c, g, or t
  misc_feature (391)..(391): n is a, c, g, or t
  misc_feature (395)..(395): n is a, c, g, or t
  misc_feature (465)..(465): n is a, c, g, or t
tggttcatttggttttatacacttggtggaaagtgaggngagaaaaacaatgacttgggccaattacacgnctgcaaagctagagctgccaacagggctccnnccngcttggcttctgtagaagttctaaggaagccntacganctccacgncggtggggngntaactagcagggacccctgcaagnnttggtnggnggcttcgagttgcttgnnttgacnnnnngngtggggtttgtgtagccaacaggtgaccgangnnttnnntggtcatggtttntttggtcaaggggtttttnttntttttgtnggtaaattttgctttgttgtttagtttttttttaattttgtggggttggtttttttttnntatcccnttactttnnnttggngcantagttttgttttgcacagtgttcagctccataactaggtctgcgttgttggtttttttagttttccccgnacgttg

SEQ ID NO: 594609 - DNA, 645 bp, Homo sapiens
catcgtgactttgagcgactatgtacttgagctaggtcacccctattagtgggtgcaaaaagctgggtggcctccacttccccaagagagcagccccagcaaacagtgattgctgagccactcgctgagcgccagtcacatgggagaccaccatgaaacttctgaaagaccagggatgcatgatctccgccgtggacccgtccactaaagcagtttgctatcccttacggaacatggcagtatgtgccatggttaccagatgacttgccagtactctcttcccttgccaaggttgtctctcgcctggtgaaagtgggatgacaaattgcccatgaggcatgtacgatggcacgcgtgcgacatctcgaccaaagcacagtctggtgggatcgcaggggacttgcgactggggggaacacccaaaatcctcttaacataccatggacagcttcaatcggtgaaggggcactagcctaaacatgctaggccggctgtggtgttgaaccctggctactcctccatcccacctgtatttccaggctctgatctgaactggaaaggggagaaaaccaacagcaagcgatgacaacattcgggccatgcagggcgaagtcattgtgtgctacaaaggagctgtgtggccct

SEQ ID NO: 594610 - DNA, 425 bp, Homo sapiens
gctcatctactctctgtgtctatggacttgcctactctgcacattttatatacatggaatcatactctctgttgtcctttgtgtctggcttatttcatttagtgtgttttcaaagtttatccctgttgtagcatggatcagtacttcattcctttttattgccaagcaacattccaatgtatggagataccacatttgtttatccatttgtcagttgaagagcatttgggttatatccactttttggcttttatgaataatgctgccatgaacatttgtgtacaattttttgtgtaaatgtatgtttgcagttctcttagatgaatagccagaagtggaatttctgggtcataaggtgatatagggcaactctgtgtttaagactttgagaaagccatcaacctggtgaacccgtctccaccaaa

SEQ ID NO: 594611 - DNA, 347 bp, Homo sapiens
  misc_feature (116)..(116): n is a, c, g, or t
  misc_feature (234)..(234): n is a, c, g, or t
  misc_feature (323)..(323): n is a, c, g, or t
ccagactgtccttaactaaccgacactgatactgacttccataaaatttagcttttgccagggaaaaggagagaagaccgctctttggtttggcttccgcttaactgacaacaaanccactaatatgcactaccctcctcctccatccatccctctgcttctctaatagttccagccggtttgttttaaaccaggcttacaaagaattaccaaaccttaattctttttagctgnctggagtttgcaaaaagttcagagtattgatcaagactatttactatgggagatacctagaaagatgcagtataattgaccctgccttnagtggtttttgaaatctagtatgg

SEQ ID NO: 594612 - DNA, 127 bp, Homo sapiens
gaggaggaggtctcattcttaaatatcttcaaattatagcaatacatggcatatttaacagtggcaattaaaatctaaattttccaatctatttagtcataaaattattctgaagaactataaagaa

SEQ ID NO: 594613 - DNA, 889 bp, Homo sapiens
  misc_feature (9)..(9): n is a, c, g, or t
  misc_feature (69)..(69): n is a, c, g, or t
  misc_feature (81)..(81): n is a, c, g, or t
  misc_feature (93)..(93): n is a, c, g, or t
  misc_feature (105)..(105): n is a, c, g, or t
  misc_feature (141)..(141): n is a, c, g, or t
  misc_feature (168)..(168): n is a, c, g, or t
  misc_feature (170)..(170): n is a, c, g, or t
  misc_feature (178)..(178): n is a, c, g, or t
  misc_feature (190)..(193): n is a, c, g, or t
  misc_feature (196)..(196): n is a, c, g, or t
  misc_feature (214)..(215): n is a, c, g, or t
  misc_feature (219)..(220): n is a, c, g, or t
  misc_feature (222)..(223): n is a, c, g, or t
  misc_feature (226)..(226): n is a, c, g, or t
  misc_feature (243)..(243): n is a, c, g, or t
  misc_feature (247)..(247): n is a, c, g, or t
  misc_feature (254)..(254): n is a, c, g, or t
  misc_feature (269)..(269): n is a, c, g, or t
  misc_feature (301)..(301): n is a, c, g, or t
  misc_feature (368)..(368): n is a, c, g, or t
  misc_feature (380)..(381): n is a, c, g, or t
  misc_feature (400)..(400): n is a, c, g, or t
  misc_feature (431)..(431): n is a, c, g, or t
  misc_feature (768)..(768): n is a, c, g, or t
  misc_feature (775)..(775): n is a, c, g, or t
  misc_feature (777)..(777): n is a, c, g, or t
  misc_feature (779)..(779): n is a, c, g, or t
  misc_feature (796)..(797): n is a, c, g, or t
  misc_feature (799)..(799): n is a, c, g, or t
  misc_feature (801)..(801): n is a, c, g, or t
  misc_feature (807)..(807): n is a, c, g, or t
  misc_feature (809)..(809): n is a, c, g, or t
  misc_feature (814)..(814): n is a, c, g, or t
  misc_feature (816)..(816): n is a, c, g, or t
  misc_feature (818)..(818): n is a, c, g, or t
  misc_feature (821)..(821): n is a, c, g, or t
  misc_feature (824)..(824): n is a, c, g, or t
  misc_feature (826)..(826): n is a, c, g, or t
  misc_feature (829)..(829): n is a, c, g, or t
  misc_feature (833)..(833): n is a, c, g, or t
  misc_feature (844)..(844): n is a, c, g, or t
  misc_feature (848)..(848): n is a, c, g, or t
  misc_feature (851)..(851): n is a, c, g, or t
  misc_feature (859)..(859): n is a, c, g, or t
cccctccangatgggtcctggggtgggccagatgcctgcccacctctgtctcctgcctctgctcctctncccctcttatanccagcacttgtntcttctcagcanccttcactttgtccttgtccctttaccattcccccncaaagagtagtctgctatatcaatttntntagatatntctttctttttnnnnccncagagaaaatgcccattnncccnnannatnctctgcactcctctctncttnacattcnacttccctgttctcntctttggtaggattcttccagttgtttttgcntcttctgttcctgggtaatggtgggtcttaatggaggctgggtggaccactgcccgtccattcttcnacaggaggaacnncatgccaccacagtaacanacattagagaaaggacagaggtctgctcctncctgccacctttctcctggccccttagcattcccccagcccccccctcttcaccttgctccgtctatgtcttcccagctcagccttttccccactcttaaatactgtactacttcactgtaagaacgaaagaatagttaggataccaatgagtaaaagggttcctgttcactctgactctgtgcaaattgtattacagtagaccgctgacgttcccaagtgacagatccagggcctttcaaacatcccaaagtcatggcatactcccattagccagttctacatctgttcagggtatccagctgtagatgtcttatcccccatacttgtgagttctnggggtgncncncaaaactaggggttttnntngnattttnancaaanananccnaangncanattnattctctttgnaacngcngtcttacnataaaagaattcttcgcccttccaaaaaaa

SEQ ID NO: 594614 - DNA, 313 bp, Homo sapiens
  misc_feature (16)..(16): n is a, c, g, or t
  misc_feature (19)..(19): n is a, c, g, or t
  misc_feature (29)..(29): n is a, c, g, or t
ggcacgagccggcttnttntaccagtttnaccgagaccagggcctgcgggttgacttgtttgaggtcgaaaatcagctgcgacaaatcctcgatcgagtagatgtcgtggtgcggcggtggcgaaatcagggtcacgcccggcactgcataacgcagcttggcgatcaggccgttgaccttgccgcctggcagctgtccgccttcgcccggcttggcgccctgggcaaccttgatctgcagcacttcggcgttgaccaggtattccggggttacaccaaaacggccagtggcgacctgcttgattttcgagct

SEQ ID NO: 594615 - DNA, 400 bp, Homo sapiens
  misc_feature (101)..(101): n is a, c, g, or t
  misc_feature (108)..(108): n is a, c, g, or t
  misc_feature (111)..(111): n is a, c, g, or t
ccaaccccccactattttattaacctagccatgcccccccccttatgagggggggcagggattaagggctttcgcttaaagattaaaaaggcccaggcccnttttttnccncaggggccccacccccccttttccccatattggtttttttggaacccatcggcctattctttcacccaatagcccgggcgggaggcctacccggtaacattatggcgggccccctattcaggcccctatttgggggcccccccctagcaatttccccctttacccttccctttccatttttttttttcccatttttatttttactggctttcctagaaatgggggtccccttaatccaggcctaggttttcccctttttggtaggcctctcccggccggcccccccata

SEQ ID NO: 594616 - DNA, 301 bp, Homo sapiens
  misc_feature (187)..(187): n is a, c, g, or t
  misc_feature (199)..(199): n is a, c, g, or t
  misc_feature (252)..(252): n is a, c, g, or t
  misc_feature (255)..(255): n is a, c, g, or t
  misc_feature (262)..(262): n is a, c, g, or t
  misc_feature (269)..(269): n is a, c, g, or t
  misc_feature (274)..(274): n is a, c, g, or t
  misc_feature (278)..(278): n is a, c, g, or t
  misc_feature (292)..(292): n is a, c, g, or t
  misc_feature (297)..(297): n is a, c, g, or t
acagctgagaggaccggagcacttccagagactgtgatcatcgtgactgtggtcctattgaggccagtggctgagttatgggcttggcacatataggatccgctattattcacagtgatgttggggataaagagctcttgtgtggattgctggaacgtcccattgattaaccaagagtactgtgcangtaggttagagnctgcgtggcaggagaggttcagattttcccctggacggtattggcctttgagnggnaatgtgngccactntggancatngaggacattcaaantctgnttgc

SEQ ID NO: 594617 - DNA, 877 bp, Homo sapiens
  misc_feature (75)..(75): n is a, c, g, or t
ttgtgcactacactgtgtgggtcccgggtggaggggggcggggtgcggcttcgcttcgtttggtctgcgccacangcgtacgtgctgtggcgggtgcaggatctagcaccttgccttccgccgccgcgtgtgatttcggtgcgccgccactctgttttggttcggctcgccgctgtgggggtctcggcgagtcagccagaattgtttggttggttgccgtcccgctgccccccccccccgctgcctgtcttttgttgtgggctctcccgccccccctgtttttgtgtgtgtccacccgaggctgccgcgagcaccgggttgtggtgtggggtgcgcgcgccccccgttgttggtggggggggcccctggatcgtccgcgccccccgtctgtgtgttttgatgtattgggctggggttctcgcgccctctcactccgttgtggtgtgtggtggcccccgcctcgctttatttttctgatgcggcggctcgcttcccttgtggcgcgtagactgttgtcgccttcgttgttgattgtgttcttctccgccagctgcttctcttctgtttgttgtgcgcggggtgcgcctccccgcccgcgggtttgttttgttatttttgttttgtctgcgcgcagcaagccgtgtcccccggcgggggtagcatcaccacgcgcgggggggcgccccctccgctgctccctgttttctgcagcagcaagtctttttttttttccccccgtcgtgggtccctcctcccccctcctttgtcgtccgctgtggtggccccccccccccccgcggggttcttttttttttttttctttcccccccccccaaatttccccccgcccccccccctttttatggtgggcccccca

SEQ ID NO: 594618 - DNA, 199 bp, Homo sapiens
atgatactaaatggaaacagatgtaaagacattagtagtaaatattaaatatgccaattcatttattcatatggtgaataatagtagagcaataaaggataatttatttgtcagatagaagacagggtggtatagctgataccaccagaggaaagagagaaagtcctggtagtgagttttaaggtgtgggtggtatcag

SEQ ID NO: 594619 - DNA, 380 bp, Homo sapiens
cggatgaacagtaggacttgtagttgattccactaagtgaaagaagaacagtgtttctgaacggtaggagaatttaataaatcagcaagggtattttagctaatagatgaaatagtataacaggaagaatggattaggctatgaaaggttctcttaaagttctatcgaaataatcttcatgcagagatattcagggtttggattagcagtggaataaggagatgggcatagtgtcccctataattgtgcgggtttgataactttcgtaagtattacttttactggctgtgtttgcataacttatccatatgcatgagggtgaaattttaattcgtagccatctgttcccatattatattattgattcatagaaaatatct

SEQ ID NO: 594620 - DNA, 106 bp, Homo sapiens
ttgcgggcgacttagagtagttagataagtgttagcacttggtatcagcagaaagcaggtaaagctcctataactcctgatctatcagacaggtgcagcgatagaa

SEQ ID NO: 594621 - DNA, 184 bp, Homo sapiens
tgaatggtggtccagccgcctggccctgcgtgggaccctccacctggcagcagggtctcgctctgtcacacaggctggagtgcagtggtgtgatcttagctcatcgtaacctccacctcccgccttcatgcgatcctaatgcctcagactcccgagtattttgtattacagtctgctaccagac

SEQ ID NO: 594622 - DNA, 589 bp, Homo sapiens
  misc_feature (589)..(589): n is a, c, g, or t
aggggtcttagggggaaaaaaaaaaaaaaaaaaaaaaaaaaaaaaaaaaaaaaaaaaaaaaaaaaaaaaaaaaaaaaaaaaaaaaaaaaaaaggttcaaaaaaaaaaaaaaaaaaaaaaaaaaaccttgtggggccccctgggcccagtccgtttttaaactccgaccaagtttttgcttggggccgaatttcgggctcctttggccatttccccttttagggggtggtttaacatttaacgggccgtcgtttaacaacgtcgggcctggaaaacccctggggttccccaacttaatcgcttggcagcacatccccttttcgccagtgggggtaataggaaaaaggcccgacccgttcgcccttccaaaaagtggccccaccctgaatgggaattggaatttgtaccctttttttttttttaaaattcggttaaatttttttaaaaaagctttttttttacccatgggccgaatggggaaaatcccttaaattaaaaaaatacaccggatagggttgagggttttccatttggaaacaagaccccttttccggggctctccacctggggggttttgggggtggggggcn

SEQ ID NO: 594623 - DNA, 524 bp, Homo sapiens
  misc_feature (162)..(163): n is a, c, g, or t
  misc_feature (167)..(167): n is a, c, g, or t
gttggtcctcttcctcaagaaaagggataggactcgacataaacaattatagacttccgtgatttttgtttaagattttattaacattaaatttttttaacttttaagttcaggggtacatgtgaaggtttgttacataggtaaacttgtgtcatgggggtnnttgnacagattatttcatcacccaggtattaagcctggtatccattagttatttttcctgatcctctcccttctatttttgctaaagtattttcagaaaacaaaagttgttaagtttgtttcctttggctagaatatctcggaaatataataaacctttgatgaaagaattaaatatgtctggccaggagcagtggctcacacctgtaatcccagctactcaggaggctgaggcaggagaattgcttgaacctgggaggcggtggtggcagtgagcctagatcatgccactgcactccagcctggctgacagaacgcatctctgtctcaaaaaaaagaacaacaaacaaacaaacacattc

SEQ ID NO: 594624 - DNA, 1148 bp, Homo sapiens
  misc_feature (940)..(940): n is a, c, g, or t
aacaagatccgaagaaacttccacttataattgttccccttggcagtacttaaagtacttcaaggttcaatgtcaaactgcagataaaaccccttcattttcaaacttactaagctgttaacaagtacatttgatagtgagcagaatatgaacagtacagatgttcatcacaaacgaggtaaacttcatctatgactacgatacggctctcacgcacgactctaaccacgcaaccttttgcacataccacaggcgcatgtctcactgcacctgggcgacacaactcaacacgcctctactctctgcacacgcggagctggcgcctcttcacatacatcgcagcctaatcaacttaacctgcagaaaatgacgataacatagttatcctgaacatcaaaacaagcaacagctaatacagctaatgcattataaataatgtatttcatcaactgaattagtaaacgcatggttaccactctaggctagcacactaactcagctataaccacttctgtagctctctaagtctctaacaaagctttggcttccctatttacaatcccatctttactatatactatattcacatactatacacactgctcgtctgtcaactcaacactataatcgcttgctctgtcacacacgaacgttttcacataatcagagatgccttacacagtcccacttacctcaacctttatcctggtttataaaaactcaacaaattctgcccattccttcctaagtggtgagcaaattggctccaatgcacatccatcgcacacaaattctcagaggcccattatcacgcacggtacgtctcctcattaagacgtcaatgtcgccggaactacaccagtactcaccaagtcccaatacccgcgcactactcgacacctctcaccagcggctcacgatacccacgcagcagcggggnacccacggcgcaaacacgtgcgcacagcgtgagatagaccatggggcgtcgccagccaccacaaacagcgcgcaccggaccatactagaacacccgcgcacccacgcacgacacagacaacaagaacatcgacagaaagtccaacctcaggacccaaatgagaacgaactaacagaggcaatacgaaatgacaacacaaccgcccaac

SEQ ID NO: 594625 - DNA, 81 bp, Homo sapiens
gggctttcctcggggacccaaagggtgggggggtacacaccagataagaggcagcgagggccgggccgtgtgctagcagtg

SEQ ID NO: 594626 - DNA, 309 bp, Homo sapiens
ccagttgtcccccatttccagacggagacgatgtacgtcttacatgtgttgatggatgtctcatgtctctcttaaagatataaaaccaaatgtggcctgacaaccacagacacatgttctcaggaactcctgaaggctgtgtcatggcgccattggccactcatatttggttcagaataaatatctttaaatattttacagagtttgattattttcatcaacaacttactaaggaataaagaagaaattaatgatttgaaaagcaggaaatgataggatcaattaataggcaccaaagctggttctttt

SEQ ID NO: 594627 - DNA, 381 bp, Homo sapiens
  misc_feature (10)..(10): n is a, c, g, or t
  misc_feature (50)..(51): n is a, c, g, or t
  misc_feature (58)..(58): n is a, c, g, or t
  misc_feature (171)..(171): n is a, c, g, or t
  misc_feature (255)..(255): n is a, c, g, or t
  misc_feature (263)..(263): n is a, c, g, or t
ggccacccgnctattaaagtacgtttaattaaaaaaacagctttgttttnnttaaaanaaaaaaaaaaggccaagcacagtggctcacgcctgtaatcccagcacttcgggaggccaaggtgggcagatcacctgaggttgggagttcgagaccagcctgaccaacatgangaaaccccgtccctactgaaaatacaaaattagtagtggcgcctgcctatagtcccagctactcgggaggctgaggcgagagantcacttgngcccaggaggcggaggttgtggtgagtggagatcacaccattgcacttcagcctgggcaacaaaagcaaaactccatcttttaaattagataactaactaagttaaattaaataagtt

SEQ ID NO: 594628 - DNA, 82 bp, Homo sapiens
cctatgtaacttatttacttttgaatgttcttctgtatctttaaaccttttattaaataaggttttaaaaattaaaaagaga

SEQ ID NO: 594629 - DNA, 476 bp, Homo sapiens
ttttttttttcctcttaatttcacctaaagatctatgactaaagcaaatataacactgtgttgtggggtttatgacatgtgcagatgtaaaatttatggcaacgacagcacaaaggataggagataaatggtgctattctgtagcaagtttttctattttacactcactgtaacagtacaatattaactctaaactgtgagaatgttaatgatgcacactgtaatccttggaggaactgctaaaaaatgaaaaaatgtgtcacttcaatgctaataaaggaatacaacaatacaaaaaagtacttgtataagaatgttcatagatctttactattatgatagcccaaaacaggaaataacccaaatattcatcaacagagaaatgtatgaacaaaccatggtgcattcatacaacagaatactattcagcaatacaaagggacaaactactaaaacacacactatgggggtgtttc

SEQ ID NO: 594630 - DNA, 903 bp, Homo sapiens
accacgcctggctaatcctggtaattttagtagagacgggatttgccatctggccaggctggtcttgaactcctgacctcgcgatccacccaccttggctcccaaagtgctgagattataggcgtgagccactgcacccagccatttttttttttttttggaaacggagtctggctctgtggtccaggctggagtgcaggggcacggtctcagcaacctccacctccggggttcaagtgattctcctgcctcagcctctcaagtagctgggaccgcgggtgcttgccaccacaccgggctagttttttactttttagagatggggtctgatggtggcccaggctagataatgctttttggacattaaatccccccaaaagggtgttgcttccctcccagagcatcctatcggggggttaatgatactgacctgtctttatactggtgatgacggtcatgatcattgcgctaacgtggtgtctgccaggatttttctcctctaacacgggtgctatgagaacctgcttttttcttttctttttttcttgggacacggatttctctcttgggccccagggcggacattccagggggcacacatccgcgcttcaatggcacttcttgcggccggaggtgcagggagatcctgggccacacccccacgagatacggggatataggcgccccggcacaccaccgccaggtaattgcggggctctaggagagacaggggggttcaccccggtgttgtgcagaggtggccaaaaagtccgacgctcacaggatgacgccccaaaggcgggaacagggcaagccacagcgcgggcactgatgatagcgggacgagcttagccatgagacttttcagaagggccgcacaaccggttgggcgtcccgtggccc

SEQ ID NO: 594631 - DNA, 192 bp, Homo sapiens
cacgctgatctcttcccagtcttgctgttcctagcacgacgtttggcctgtgacttgcacttacatgtatatgctcatcagaaactgtcaatgtactgctataactttaacatctgcagtactgtaacatacacgctgtttattaaacaaaaaaacgaacaattcacattaaaaaaaaaaaagtgcggacga

SEQ ID NO: 594632 - DNA, 81 bp, Homo sapiens
ggggggccccccgccccaaaccccccttaagggtttgggggcccccccggcctttttcccaaaaaaggttttcccccccca

SEQ ID NO: 594633 - DNA, 177 bp, Homo sapiens
gaattccccccccccccccccccccacaagaccgaggatgactgccatctcctggaaagacgctcaggtagttctttgggtttaaaaggaagatattgaaaactggaattttttttgggagtctcgctctgtcacccagactggagtgaagtggtgcaatctcggttcactgaaacc

SEQ ID NO: 594634 - DNA, 244 bp, Homo sapiens
actcttatacatagacataacctagtcctgtctgccctttacctaacaaatacacaaccaaactacacatcatactacacatctcacacgcctcaggaaataaaaacagtaagaactatcctgcccgccatacatcctagtcctcatcgccctacccatccctacgcatcctttacataaacagacgaggtcaacgataccctcccttaccatacaaatcaatttggccaccaatggtactgaa

SEQ ID NO: 594635 - DNA, 802 bp, Homo sapiens
  misc_feature (480)..(480): n is a, c, g, or t
agcggcggatgtatctttcgttctctttttcgactgtaataatgagatttgtattgaacgatgtcttgagaggggaaagagtagtggtaggagtgatgacaacagaagagagcttgggaaaagagaattcagacctaccttcagtcaacaaagccaattgattgacttatatgaagaaatggggaaagtcgagaaaatagatgctatctaaatcgggtggatgaaggtttgatgatggaagtatgtagcgagattgtttgactagaggaatggcgtaattactaaagcctagaagagcagtccttgagagatcatgcttgaatattggctttgatagcgtgctatcatgacgcgccttgtgttaaggcaagtctctaatcgtttcataacttacgatctcacattgagtcggcgtcggtaacacgtaccatggcttaaaagcaaaagttaacagtattctctctctcatggttgctgtantctgttggggtccacaggagtcagacagtgaattcaggtttaacttcacctttatgttgatggtgctcaccaatacgaacgggtatcagctatttgttcttgaaattcaaaaagaaatatccctttcatagtcttgtgccttctgtgagcaaaacttgttagtacgcgttatatatccctctagtaatcacaacatgtacaggatgttgagggatacccgatgtcctctttgtacttgcaagtttttaaatttgccaaccttaagtgaattctcgtggaccaaatttccaaggaacttatcgtgtcagtcagctcttgccca

SEQ ID NO: 594636 - DNA, 175 bp, Homo sapiens
tgcgacgcgccgctctgcaccattgcctcatactgcgtgcggatctctttcagggctgcaggtgaggtctgtcttggccacgtcaagctccacatggacctgctgacacgccagctgctcttggagtacccgaacctcctcctcgtggaccttcctgaagaaccggatatcctcc

SEQ ID NO: 594637 - DNA, 637 bp, Homo sapiens
ggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtcccttgtgctatccacgccgcggagaccacttgaattctgtggttctacaaccagggtctggctgaccgaatgtgtcagagacgtccaggaattcatcgataaccccaagtggtaacactgacagaggcattccttacagaatgtggctacctgcttaatgggccccctgggttgcggaaagagcagttttatcacagccctggtctggggagaactgggagcacagcatctgcctgtggagcctcaacggactccagcctcctcttgatgaccgtgatcaaccacttgtgaggcggggcccgaagcaagagcctgtactcctggaggatgtggatgctgtttctcagtcgagacttggtggtggagaaccagtacagtaccaaggctaggtcgctcaccttcaggtggactgtcaatgccttggatggtgg

SEQ ID NO: 594638 - DNA, 282 bp, Homo sapiens
  misc_feature (213)..(213): n is a, c, g, or t
actaactggacactcccatcgtaatcagcaatgagaacatggctagcagcaggcacagtgactcgggcatgtggtcccggtattttgggaggccgaagcaggcagatcacctgaggtcgggagttcgagaccggcgtgggcggcatggtggaacctgtccctgctgaaggtacaaaaattagctgggcatggtgttgcacgcctgcggtcccnggctgcttgggaggctgaggctggagaatggcttgaacccaggaggtggaggttgcagtgagcccgaag

SEQ ID NO: 594639 - DNA, 968 bp, Homo sapiens
  misc_feature (542)..(543): n is a, c, g, or t
agcggaaggtcctctctgcctgccagtgatcccacgcttctcccacctgagacaggcggagcaggaggagaagctccctccatagcccaaggactccagcttttttgacaaattcttcatgctggacaacggcgacaggattaaaggtgccaggtgacagccaacaggaagccaagatgggcagagcatcaatgacaatggtggatgaggttcctggacttatcacgggcacgtccgactgatgtccctgcaggggagaggacataggttgacggcaaggaaaggaagaagggacacagaacttggagagctgctggagttgtctcttgtccctggtgggacccacgcacatggacgtggcatgacgtgcaacaggaacgattgcccaggccatggcagctcatatcgcagaagatatatttcaattccagtcgatgcagtttcgtttataagactcttggtttcaccatagacagagagcttgaacccaagataacaggaccgcagaaggacagcggcgatcgatagaggcagaaagtgtnnctgtgaaggacatatgcgtggtcagtaagacaatccgcaggatccagtgctagcaggctacctaagcaacaaagcacctgttggatagccgccatggctcatgacctcgcctttagaacacattctttaggcattacacggggtgctgaggaagtcacccagcacttcagctgaccttgagtcagacaaaggcaacgtttacatcccaggagacccaagggggcgtggcgagaagtccaaaggatgcgaacccatcggggcacacacagggccgtgagaaccccctgagacctgcgaaggaagggcaccaccgagaagtcagggaccaacgtctcctgcctctgggccaactgttgggaagaaagactcagactccaccgaaagaactatcccaccgcagaagcctgaaccacaggaagcgcaaa

SEQ ID NO: 594640 - DNA, 643 bp, Homo sapiens
caaggtctaattgtaaaatttcaaaaaattgcaacctcaggcataaatgggttaatcgacatttatagcacacacatgcaacatgtaccagagattccttcttttctatgaacatggtacttccaccaagatagaccacattgtgaactataaaacaaatctaaaaacatttgaaatgaaggaaattatataaaatatgttctctgatctcaatgaaattaaattaataactatatctagaaaaactcccaatatgtgaatattaagcaacatacttataaaaaattcatagttcatggatgaaatcaaaagagaattcaaaatatttcaaaataaattatgatgattatataaaatgtagaaatgtgtgggatgccactacaccagttcttagagtgaaatgcacagctttcaaggcttctgttaaaagagttgggaattacaaaacaaggagcagcgactgccaatgggtgtggagtcttttttggggtgatgatgaaaatgttcaaaaattgattttattgatggttacacacgtctataaatatatttaaacggaagaattatatgatatatatgtgatatatgaagtatatctctgtaaaattcctaaggattaaaagaagaatggtatcacaaaaaa

SEQ ID NO: 594641 - DNA, 830 bp, Homo sapiens
tgctggttggctcatcaccatgtaattgccatgacagattgggaggccaagggcgggaggatcaggaggtcagggagatcgagaccaccattggttaacaaggtgaaagcccatctctactaaaaatacgaaaaattagccaggcgtggtggcgggcgcctgtagtcccagctacttgggaggctgaggcaagagaatggcgtgaacccgggaggcggagcttgtagtgagcagagatcgcgccactgcgaccccagcctgggcgacagtgcaagactccatctcaaaaatgggcatttacacaaaaggactaggaaggctactaagccaaaggagtcaaagaaaagtgtgcgactttgtgtttccaataggtgcaagggcatactagcgttccacgctcctggcccgtggtcagccttgaggcaaaagggctcagcggaggtgaagacggggattccagtatatacggcaatttactgagtaattgtcttgccgttacgtccagcacatgtcgagtcaagttacatcagcttactgtcccagttgcactaccgtgaaagatttagaacctgaggcataatccgagaaccaagcccggtgttagaagccagttctttgacactgtgtgcccaggggtgcacgaatgagcctcaaataggcgccgcggtaatccggctagagacacataacgggggaagggccgcaaagggagggcgcagcgatcacacgggggaggatccacgcgaagtccgaggaaccaacttgggggcccaacagataaggtcgaaaacgcccgccgaacgctcactcaaaccaaatcacacaggaca

SEQ ID NO: 594642 - DNA, 1091 bp, Homo sapiens
gctggaacctggctgtgcgcgctgtcgctttaagacagactctgccggcgccgtcctggagccttagaaacctggccccggatcgcgagccggagctggagccggggccggccgggctgctgagtgcccgagcggcagtgatgctgcatgcgctggagcgctgatgccagtgctgcccatgtcgcgagaatgctgcctgcctgcctctgccctgccctgtgtctgtcctgcagccccgtggcggtccatgtgggctgtggcactgtgtgtcgctgcagggcgccgtgctgccctggatggtgcatgccgctttaggcgctgcagcctacttagtccgccagcaaggttcgcgatgaccagtggctgtgctgtgtggctgctgccacaagatccctggaaccccatgtggatgcagcccagcccagatgtgtacccacacaaccatacacaattggaacggcctttacaaagggcgtggtgacattgaaggcccttgggaagctgtgatagccaggcacgcggggcattcgcagtgccccggagcacgacccagcaccaggcacgagcacccaggatggaagcaattgcgggggcaccacggcacattacccaagccattgggaccccggagccaccaggcgcagaaaacaccccgggctagaaggccaggcttcggaggaacacctgcccgggacgacgacgagagatcagaacattggagcaagccggaagcgtgcccagtgacggacacggggacggccgccgggaaaggggagaaaacccccgaacgggagaggcccccgaaagaggaccaacgacgtgtacgcgggggagcggacgcggcggctttgccgcgcgggagcggcgagaacgggaagtccagggaccaagaaataaagcgagaggcaggcaggaggtgggaaaccccgatagagggacgatttcagacaaagggcccaggagaggcttggcaggaagccgacgaatggccaccaggtaccagggaggtgaacgccggtaacgcccgggcgagcgcaggcatgtgaagcggaagagagaaacgagcagcatgagggaggcagagggcgtcg

SEQ ID NO: 594643 - DNA, 235 bp, Homo sapiens
aaaggggggggggggcccttttggggaattttggttttttttgttttaagaaccccaaaaaaccggccttttttttggaaagttttttttgggtcccggatttttgggcctccacccattgtttatatgccctggtcctttggggtaaaactttggaaaaataaagttggttttttttcaattttttcctttgcaaatttttagtaaaaggggggtttttataaattcttaatta

SEQ ID NO: 594644 - DNA, 330 bp, Homo sapiens
agagctactctagagtatccccatgctgcactgacggtcaaaaaaaaaaaaaatgggtagggttgaataagtgacacaatcagatgttccgtttttagcaaacttgattgagtggcaatgaatgagatttctagcatagaggaactagcattggtagagatagggaccacatgggaccacaatatgataaacaggctggaagagagaagtactttagttcagagatatgaccaggcagttaagtccaatggcagttcccaatatggaattccaaggctcaagaagagtcagcaggaagtcactgggtctctataagcctacagaaatggg

SEQ ID NO: 594645 - DNA, 470 bp, Homo sapiens
gacctcaggatcataggcgacaaagcaatacaactaccccaacacctattccagggtacagggatgcaaaattgcctgcccagcaagtggcatggtttccatctggtctcaacctgcatcttgagcagacctagagtgctggctctgcatccactttcacagctcccagaggcagccgagtcctagatgctcgaaacacccagaatcacaaagagtcactgaggagttctgacccaaccaggataaaagagggacaagctccagtcagagaaagggcaggtagcactagagataaccagatggcaagaggcaagcacaaaaatataggcaaaaaaaaaaaaataataaagcaaggctacttggcatcaacacaatctagttctccaactacagcaagtcctggataccccatcacaccagaaatgcaagagccagatttaaagccacatctcatgatgatagtagaagat

SEQ ID NO: 594646 - DNA, 1009 bp, Homo sapiens
  misc_feature (836)..(836): n is a, c, g, or t
ttggtcatggtgggagatcaggaatctgctacggagtgtgttaccaagctcagctgctcgaatcatctagtcctgattgttggatggcgctggacggtggtgccatacccgagcgtagcagatgttagatcagtggaagcggagagagaagttagttgataagcacatggtcaaggaaaggggattagcaagcaatttcgtgatagagccaaatacgagtggggagcaaggaaacgagtaagtagatcgggagcagagaatggaggatgtcaagaagattaaggcagcaaaagtaatgtactgcatttcacgacaagactgttgtgtatgtcactcattgtgtgacagaaatatggttctaacatcgtaggagcgaggagaggacaaagcgtacagagattggcgaatgcgaaagtcgaaagaggagggttagataaagtagtaggatttcggatggattgcgttacgagtaagagtttgtccaggagaagaagaaagatgcctctaaaaggaattctttcagaggtggtagaatgaaacgagacttacagagacatggtgactatgggaagacagagaagatctatagggagagagatcaatctgggcaatagaagatacataggcaggaggggtaataccttggggcaaccttacatcttgaggactacagaggagagaacacgattcttggagctggggtgtatacaatgatgggcccagatttcgtacaagacttgggaaccgcagagcaaaactgaggcgcggatcgaaatgcatcgggacggacacacttcgcagcgaacagcacacgccagtacaatgacttccaaganaaagttaacaccattcttggctgaaggccgaaagagtcccggctcttggcctagaatggtcggacgtcattcctttaccacttggatcttgggaacccacaacaaacatgtggggcgggcgaggtatccaggggggcaaatcgtgtcacaatattcaagggcgcgcatgagct

SEQ ID NO: 594647 - DNA, 254 bp, Homo sapiens
acactcttggttgcttgaaaggggaactgaagaatgtgcacttctctactcccagatggcttgggaaccaggcgtgctgaatatttctgctaaacctgatgggtaatccttggtgtctaagcaactaacccgtttctttttctttttctttttctttttctttttttgagcggtagcaagggttattgtgaagagcgaaagaacaaagcttccacagcgtggaagggtcgatggggacccaaccaagagtgtcg

SEQ ID NO: 594648 - DNA, 321 bp, Homo sapiens
  misc_feature (73)..(73): n is a, c, g, or t
  misc_feature (171)..(171): n is a, c, g, or t
  misc_feature (280)..(280): n is a, c, g, or t
  misc_feature (292)..(292): n is a, c, g, or t
attttattttattttattttttctggcctggcacagtagctcacacctgtaatccaagcactttgtgaggtcnatgcgggtggatcacttgaggtcaggagtttgaggccagcctggctaacacggtgaaaccggttgtctgggcaccgatgacagactcgtcagcgagancaaaccaagcccttcagtgagtcacacaaactgtggagtttgaactgaacatctacaaggagcgtggaaggctgagcttctcaagagtcctgcttgctgtgccaggagnattcctggtggncctgtcaagggtgcctggggttgggggct

SEQ ID NO: 594649 - DNA, 837 bp, Homo sapiens
ataaccagacaagataaagaaaaggcagatcacgagatcaagagatcgagatcatcctggccaacatggtgagaccccatctctactaaaattacaaaaatcagctagacgtggtggcgggcgcctgtagtcccagctgctcgggaggctgaggcaggggaatcgcttgaacccgggaggcggagattgcactgagctgaggtcatgccactgcaacctcccaagcctggcaaacagggcaagactccatctcaaaaaaaaaaaaaggaaaaaaaagaaaatttagggcagcttttaaacttgaggccccaaagtaccaactaggggcacctaaacttcaactctctttggagtggtgatggtactctactcggcaccccagtggtaaattttgcaaaattcaaggcctacggtttttaaacatttcctaatttcacaataacccacaccagaattctataataacatagcatcatgtaatactgacctcagatccagcgggaacgcaaactttcttcacactttgggcacacaactgactgacgctattatttcaacgaaaatagcttggtccctgtggtgagaaagactccatgtccacatatgtccagttctctccctgacttaagtctttcaacaaaaggcctaatattattgccgggccaaatgtattgcccaggggcaggaggggattggcgggaagtggcaaccatgacctgtgtccgggaatggtccctggccaactgctaacatcttgtgaaaactcactgaactggcccttacacgggcgaactcgtcatatccattactcaaataacctaacttaaaaacccaaaa

SEQ ID NO: 594650 - DNA, 666 bp, Homo sapiens
ttcaaattgtttccaatccttaacctccgagtttggtttatataggagccgaagtggggccggtccccattgcccctcctttgacctggcacaagattgccgtgtaaatccaactttaaccggtggttccaccaacacagccttggccttaaaatataaggatccagtggccctccttatccaggaaggggctgccacccttaatatacctctccatccatcccctccggtgtgcaaatgctccttgcctaccaatggggttccctcccaataaatgcttcataaagtcaaaaagttgtaatctgtctggatatatgtattggtctgttctcacattgcaataaagaaatacctgagactggataatttataaagaaaagaggtttaggctgggtgcggtggcttacaccctgaaatcccagcagtttgggaggctgagttgagcggatcacctgaggttaggagttcaagaccagcctggccaacatggcgaaaccccatctgtactaaaaatacaaaaattaaccgggcatggtggcactgcctgtcatctcagctactcaggaggctgaggcatgagaattgcttgaatctgggaggcggagattgcggctgcagtgagccgagattgcgccactgcattctagcttgggcaacagagtgaga

SEQ ID NO: 594651 - DNA, 169 bp, Homo sapiens
  misc_feature (102)..(102): n is a, c, g, or t
  misc_feature (135)..(135): n is a, c, g, or t
tgatctagaggatcgcaacggtcgagtcaagtctgataggattacgtctaactcaatgtataatagcatggggaatagctaaactttttaaaaaaattatgnattttctccctgttaaaagatttcaccaggaanaacttcatataaaaattcaggggccctattttgg

SEQ ID NO: 594652 - DNA, 233 bp, Homo sapiens
tccagcgctgttaccagactgtcgacaggttgctcaaggattgccttccgtctcttagcgctgggccaggtgccacgtagagtgcttggtgcccacgagtgcgcccggttacatctctgtcacggccttggtcgcctcttcttcgcacatggtaattactccatagtgagagaactctttcctcagttggtcgtcatcaatggagtcgtccagcttcttcacatacaagttca

SEQ ID NO: 594653 - DNA, 439 bp, Homo sapiens
gcatgcggaactatacgtaaggtacaaaggctcccttctaacatatcccatactctcttctaccgctacccaacaggaaagggaatgctgtacccatatactaaccagtatgaaacacataaatgttacaagggaaaaaaaaagcatttagactagcatgtgaatttcatcaagcagagacaccttggttaccaagcaacacttgctggggtggcgaggaaggaaaaaaggaaaacctaagaaacaggaccggagtgctcactgtttatcattatcagccctttatcatgagacggcgtctcgctctgtcacccaggttaggagtgcagaggcactatctcggctcactagcaagctccgcctcctgggtacacaccattctcctgcctcagcctcccgagtagctgggactacaggcgcccaccaccacgcccagcta

SEQ ID NO: 594654 - DNA, 1759 bp, Homo sapiens
  misc_feature (1022)..(1022): n is a, c, g, or t
  misc_feature (1098)..(1098): n is a, c, g, or t
  misc_feature (1562)..(1562): n is a, c, g, or t
tgggacaaattatacaagtccaggtctctttcagccccttggggctcataacggtcagacgcgggccctccaacacacacagtcattcaatagggcagcttcgtcctcgtggtgaacctccggtgaactcgtgacctcgtgggctcaatagcttcttccttcactccttcaacactcttctgggcagcattcttgagaggtttccataggtctcaggtgggcccagctgtgcggcgggatatctccggggggcgtggggcgggccccggggtgagcggggtggggagagaaaacgcccgtggaaggataacctcgtggtggacattcagccccaaacttctcaacagagggaggtgaaccaccagaggctcagaggacattgtggcggaggcgtcccatgtggcgacagaggtgaagagagcgcacagctccgggcgccaatacacagaggggctctcactgtgggagccattgtgcgacacactcagagcacaccccaagaggagacacacacaaaaaaagaggcctctccccagagagaagtgcgcccagagagtaatacgcccaagggggggactgacgaaaggggctcataacagctgtgtatcacacacccactggtgtgggtgggtgccccccagctgtgtgtaacgcctgtgggtgttacgacgccactcctagagaggagatgtgccgacgggtgcggaagagtccggcaggagaggagcgaagcgacgtgccagaaaggaccactgtagagaggacctcccggaggggagaaacctcaccccaaacgcgcttggtgtggccccgcaggggcagacagcaccacgtgggtcgctcacaacggaggggccccacagggggttgtctaaaagaggggggggggggaaataaatactcccctcttcgagagaaaaagggtctcctcctccaggggaagacctccgaagaggggacactacaaaacgacgaggccgccagctggcttcccacacaagagaacaagtagttggcggccnctacaaagcgaagacaaattcattcccatgggggaggccgagaggacgcatggtgggcgcagaacaccaacacgancggcgccacaaaacatgtgtgggacgaagcgaattcgggacaaatccactgatgccatgtgcgccaacaggtgatagatcggcctccgtggaaggacaaccgcgtttgaggagcgtagaacacgccggccccacacggggcgcacctcccccccgttatccagccccgtgggggggcgagaaaacaaagcacatcacctagagggatggcccaagagcgcgcccgactttcaccacccaacggggcgaagaatgtaatgatgggcgccccaaaggttgcctgagcgggacacaccacgacacgaccccccgcgagcgcccacctgaacggagaaaaagcactgacggatcgccataacccaagaggggggggctcccccaatacagccgctgtggtggggtggaacccacctcctcggggtgggccctacagaagagagaggggagaaacacctcctcgtgtangaggcagccttggtgaagcacacgcacctgtcggtggagagacacacacgcgaggtcactaaagtggggagagcaacacagcgccagcttgcaactatggtggagcgcgactgacacagagaatacgcagaccacatatataaacgcaggcgagggagggagcgctcactcaggcagacacacaacgttgtgcaggg

SEQ ID NO: 594655 - DNA, 630 bp, Homo sapiens
acatacccatggccaaggctcctactcctcatgtacccattctaatcgcaatggcattcctaaggcttaccgaacgaaaaattctaggctatatacgactacgcaaaggccccaacgttgtaggcccctacggggctacatactaacgcgcttcgctgacgcctataataatctcttcaccaaggagcccctaaaacccgctcgaactatcgtactcagtcatcgctctatcatcatggacccgaccttaggtctcacccatcgactcttctactatgtaacgccggtcctccaccgatgatgcaaccgcctggtcaaagctacagactaagggccgcgcgtataccattactcagcacatctcgttagcctcaacctcgtaataacttcagatatccgctctgagtaccagggtatggagcatcaataaggatcggaaattaggtccaccggattcggcggcattctgaggaaagaagttggtcgccaaaatgcgatctccataatgcaggtcattctctaatgtccatggcagttctaacatattttggtcactaggtatgtacagctggctccctggggatgcgtctcacattccggatatcgcaactataaagatacacttatcta

SEQ ID NO: 594656 - DNA, 272 bp, Homo sapiens
ctgtacgcagcctgcttcacagttccagtgttttggcgtcggtcacacgtatattcttgtgatacagcggttcgtggtgatgcgcagccagatttgcgtcgatctgcggacgtgcgccatagaccaccaccagacggatgccgaggctgtgcaacaacccgatatcattaacgatactggagaaattctcatgctcaatggcttcaccgccgagcatgatgacaaacgtttttccccggtgggtattgatatagggaaccgaatggcggaat

SEQ ID NO: 594657 - DNA, 128 bp, Homo sapiens
gcagctcaagtaccttctctcctgttagctaggtgtccagttttggaaggggcatgtctggagcccggccacttcagtctacatgtcatagactaagtcttagttgttgcggttcccgagaaatacag

SEQ ID NO: 594658 - DNA, 139 bp, Homo sapiens
tgtgtgtaaataaggaaagttttcaatgagtattacttattgtaattatgtgcagaaggacttcccccgtcaaccgaatctgccgaccttttactcagtcaagtagcatctcattaaacccattcatttagcgttcata

SEQ ID NO: 594659 - DNA, 161 bp, Homo sapiens
cctttttccccgggggaaggggggcccccccccccccttttttttttccccgcttttcgggtcccaaggcccccgggcccccttggggcccttgggggtttcctttttttccaagggggccccccccggcccccccgttttttttttgggttttttgggga

SEQ ID NO: 594660 - DNA, 818 bp, Homo sapiens
  misc_feature (482)..(482): n is a, c, g, or t
  misc_feature (521)..(521): n is a, c, g, or t
  misc_feature (573)..(573): n is a, c, g, or t
  misc_feature (597)..(597): n is a, c, g, or t
  misc_feature (642)..(642): n is a, c, g, or t
  misc_feature (654)..(654): n is a, c, g, or t
  misc_feature (659)..(659): n is a, c, g, or t
ttcgtctccggggaggagtatttgtcggagagggtaaccgggaccctagaggcggggcctggatggggggcggagcatcgtctttgtgggcggttcttggtgatcaggaaggcgggcagggcctccaggtaaggtctaggtgttggagggcgggacaggatctccagggaggctctaggtgcctacgaggcagggctgggtctccctaggggttggagctgcatctccggggccagaattaagagcctggctggccgcggtggctcgcgcctgtcatctcagcgttttgggaggtcgaggcgggaggattgcttttacccagttcgagacccatcctgggcaacatagcgagaccccatctctaaagaaaaaaaaaaccaaaaaacccggccagatgcagtggctcacgcctgtaatcccagcaccttgggaagccgaggcgggcggatcacctgaggtagggagtttgagaccagcctgancaacatggagaaatcccgtctctactaaaattacaaaanttagccgggcctgtgaggaaggggaatcgcttgaacccgggaggcggaggtngcggtgagccgagatagcgccatngcactccagcctgggcaacaagagcgaaaccctgtctcaaaaaangaaacaaaaaancccanaaaaactaggagcctggaaggccggactgggtctccgtgggaggggcctgagtctggagagcagggcaggtctcctgggcctaggggatggggatggggctgggtctcagaggaggcagggttcacgtgcggaagagcggacttggtctccgggtcccg

SEQ ID NO: 594661 - DNA, 113 bp, Homo sapiens
tcgccgatgccgcaccagctccgtgaggttagccacgtactcgtctgtctgctgcaagatgtatgccaggcgcttgtccttcttaaatatgatgagttctgtggctgtgaatg

SEQ ID NO: 594662 - DNA, 95 bp, Homo sapiens
  misc_feature (2)..(2): n is a, c, g, or t
  misc_feature (18)..(18): n is a, c, g, or t
  misc_feature (22)..(22): n is a, c, g, or t
  misc_feature (34)..(34): n is a, c, g, or t
  misc_feature (38)..(38): n is a, c, g, or t
  misc_feature (51)..(51): n is a, c, g, or t
  misc_feature (92)..(92): n is a, c, g, or t
gnaattgttataaaaaancagnctacataattgnatgnccaaatataaagncagctgtgttcccaataagatatggcattattgaagaaatnaag

SEQ ID NO: 594663 - DNA, 199 bp, Homo sapiens
agagtggtgcggcatcaccacgtttagaacattttcctcacccagaaagaaacgtgtacccattaccatcactccccattctccccacccctaaaccctggcaaccactaatttactttctgtttctatgtgtttccctattctgcacatttcatataaatagaatcatgcaataggccgcatccaaagcggggatcct

SEQ ID NO: 594664 - DNA, 179 bp, Homo sapiens
tccccctcacctcggcaaatcaggtggttatacgggtaacaaaatatactgtattttcgtgaaatggcacaagaaacaggctttcatctttaagggctatgcctaggcaaactactaacacgcattgtgatgaatgccgtgtatacctcactgtactgtgctactttgtacgatatatt

SEQ ID NO: 594665 - DNA, 112 bp, Homo sapiens
ctatacacaaagatcctataaaacagaaacatgactagaataaaagatacagtcccataacaaagctacatcaaataaatataacccatactacttgacttaatagtaaaca

SEQ ID NO: 594666 - DNA, 148 bp, Homo sapiens
ccggggtgttagtggcatcaatgacgctgaaatgcggtacacagagaagcagcgagtggacttcctcggcgaggcgggcatcatgggccagttcagacaccacaacatcatccgcctagagggcgtaatctccaaatacaagctcagt

SEQ ID NO: 594667 - DNA, 217 bp, Homo sapiens
ctagagtatagtagatgtgtcttgtgtttatcagtaacaatgcataacatctttaaaatatattgcttagaataaataaatataccaactctttacctactttatctttacttatctttactttttttatatacctatttggagaacaggttacttgcttcttgtcgcccagggggcacggaaagatgcagggtacccgaagctccgaattgcggta

SEQ ID NO: 594668 - DNA, 874 bp, Homo sapiens
  misc_feature (302)..(302): n is a, c, g, or t
gccggggattggattgtgagccagggactcagtttctcctctgcccctgacccactgtcccatccacagacaccgtggggctcatacctcggtgcagacccggcgccatggatcatggtcctgggtggctggatggcgtcctaggtggtggtcctctcataggcctgggtccgtgacttgactctggctcctgggggcagtaccttctgatggacggcgtctggtctgcctgccaagcagtcgtcctatttcgagcagtagagatacgaccaatagggagtgacgaaagtgagcactccggncctcccaggagacgacctgaactcggcggctgacagtcctggcagcaatggcaccggggcatctctacaacatcgcgcgcgcatatccaaccagtgagcggtcattccctatgggtcaacgcggatgcctggcagtgggactgttgaacatggacgtgaacctgcagcaagtcccgtcaggacgggtgaggccgacgacggacccggtgaactgtgattcacatcgtattatgccacagaggcgttgtcgaccttggttgtaacttccctggatccagccaaacgagtcctggtcggcgaaagggcgaaagaatatggcacagactggcttcgaagaaatacgatttgccgtatgaaaacggcatggtgcaccagtacggcgaccctcttccatcacgcagcaccccactggacaagtggaagaaggtcaacatgaatcaccttccattttccgcccagacccagaatggcgaacccccatgcaacgccagtgaacgtggtgtccccccgtgttggtcctatgggaggcaccgaagttaactcaacgggctgacacagttctcactctcgta

SEQ ID NO: 594669 - DNA, 254 bp, Homo sapiens
tgtcacacatactcaccccaccatgtcatctattcccagttgaatatttctacaaggcccaatctacgtatactgcaaattatgcctagagacacattccatggactctaagaaagtttgttagtttaatctgtgatacttaaacttattatcagctattaaaactattgattcttgattgtgttttacaatcaaagtatttcctattatcacattcgctatcaggcgcgttcatatctcttttccctgtgtaa

SEQ ID NO: 594670 - DNA, 214 bp, Homo sapiens
gggcgcgggctcagccctgggagaacgggcagtacagccgcccctgtctcggctccacccacagccggaacgcggggctaggatggcagagaagccttcagccagcgttggggcctcgaactgcttcctgtagccatacatgaccatgtctgacacggggatatgagaggagtccgtcatctctcgaaaccggttgttgtgggcgcgcccacaa

SEQ ID NO: 594671 - DNA, 352 bp, Homo sapiens
  misc_feature (286)..(286): n is a, c, g, or t
gtcttgctatgttgtccagtctgatctcaaactccgtgccccaagcagttctcctgcctcagccttccaaagtgctagtattacaggtgtgagccattgcacccggccatttttctctaagtatactatagatcaaaaaagttaaaaatactgaagacccagagtgtgtttacatatttatatgtgtatatatatagatatatacacacatacatacacatacatgtacatagctatgtgtacatgagtgtatataactataaaactgatctttattgggatgaanaaagtgacacttgagtgagggatgacttgtcacatcttataaaattttactgattgaaattttatg

SEQ ID NO: 594672 - DNA, 321 bp, Homo sapiens
  misc_feature (41)..(41): n is a, c, g, or t
  misc_feature (255)..(255): n is a, c, g, or t
  misc_feature (259)..(259): n is a, c, g, or t
  misc_feature (276)..(276): n is a, c, g, or t
  misc_feature (312)..(312): n is a, c, g, or t
ccgaaaccaaataattcaagcccgggttattacaattttanggggtttttattttaccctcccacaagcctcaaaggatttggagtttcccttccccatttccggggggatttaggggtcaacattttttgtagccccagggttcccgggatttcaggtcattatggggtcaactttccccccaatttgtttcatccgccaaaaaaaatttccctttacatccaaacatccctttgggtttgaaacccccccctnaaangggcattttgtaaatgnggtttgactatttttgtatgtccccctctattgatnagggtttta

SEQ ID NO: 594673 - DNA, 643 bp, Homo sapiens
  misc_feature (70)..(71): n is a, c, g, or t
gcctgggagaccctccgccctccccgcggtggcagcgccgatccccggctccggcgcgagggacggccgnntgcgctcggcctgaggttacccggcccggcccttcctcgcttccctcgactattccactgcgtctccgcgccccggcgtcatcctgcgagtccctctgacgggagggaagatggctgcacggagctggcatgtgacgatgctggcccagcaggccgaggagggctcggcccggctgcgggaaatgctctcggtcggcctaggctttctgcgcaccgagctgggcctcgacctgggggctggaagccgaaacgggttaccccgggctggggttgatcctggttggggcaccttcggcgcggcttcgggggctgcttgcttgcttggtatatcagctgggagctaccggctgggggccgcggcgttgcggccgggacggcccggcaaaaaaggcgggagtgaggcccgcgcccgcaaggcggggagcgaaggcggcgggccgaggcccggccggggccccccgaacgaactggggccttgctgaaagaaatctccggagcgaggaacaagaagaagaagaaccggaagaaactgtccgaagaaggcccaaaccaaatgggcggactgttgaagg

SEQ ID NO: 594674 - DNA, 770 bp, Homo sapiens
  misc_feature (510)..(510): n is a, c, g, or t
  misc_feature (552)..(552): n is a, c, g, or t
aataggagaaatggacattaaacagaaatataacttggtaaatcgcctttatagctcgctttttatttattgtaacacataaaggtaagatggctgatttactattattcattccacaactgattccctatttggatattcttttggcactgtctcaatatgcaaagcgtgttaattgcaaaatacctgtgcagaaaacattgtgtgtataagatctaaagcctaaaaggaaaaaccaactttataatttagagtataaaataaggacagggaccgtgtctgtcttgtccaccatagtatccccagcacccagcttcctatttgacgtgtggtaagagttcattaaatattagttgaataatgaatgaataaatagggaataatagaatatgtttattaggaactacatgtgtaattttcatatggagattgaacggttatccatagcattttttattgactggaaagaatttgacttcttgaatgcataagacttgagaagagaagttnttttttttttcttttttttgataagtcccctaccattgcctnctcaccttccttcactacgtgctaagccccttcctgtactgggaagacaagataataagacacagtccctgctgtgaggaagctcatgcactgctgaagaagagattcaccaaacaaagaatcacaatggggacaaattcaggtaccaccaggcactttaccaggaacaaccaatcaggaaggaagagaagcttttgcaccggtgtggatgacttctc

SEQ ID NO: 594675 - DNA, 351 bp, Homo sapiens
  misc_feature (294)..(294): n is a, c, g, or t
gagatcggttttcaccattgttgggccaggctggttttgaactcctgacctcaagtgatccgcccgccctcagcctcccaaagtgccaggatgcacaggcatgagccaccacacccagccccatcaaagctttttggaaatgatctgtaggccaggagtggtggcttgcggcctgtaatcctaggatcatgaggccacaaggtggagtttagatctagccttgccaaatggcagaccctgttctctacaaatctacaaataggttggcttggctgtctggcacgtttctgtagngccctgctcttttgggctagggtggggagtctccctcgacctgaagttattgctcac

SEQ ID NO: 594676 - DNA, 679 bp, Homo sapiens
caagttattactatttaatattacacattctgatcaatgcactctctaagcctgtacctcactggattttgagacattacattctggtttgctattcctggaaagccgattggtgcatgtcctataccttacatgaagtgggtacataatgcaaggggctgtgagcgttatatagtgaacttgggactttgttccgacagtgcatgctgtggggggacttactgattcatgattgtcagtggtggagccatatggcgcagacactgcatgaatgatctggtgaccctcgaataaaatatcatgatattaaaattttgcctgaggctcagatctgatccaaatgacctaatctggagaacggaagaaaacactagctgttgtagctttcaatgcgcaagccttagaatcctattcttcctaaatttcagaactctcgagatattgtcattgccatgaggtgcacaacacttaatactgggcagttggtggcattgaggattttagttagagctccaatgagaacgtctaaactgaagcttctacggaatgatcctaagaatgcactggaggcatcctcacgctgatttgagtcctaagcaatttgggggggctggttcttaaccgatatgggaaacgcaaatctggcccggaacgtaaattccgtactcactttggaatg

SEQ ID NO: 594677 - DNA, 527 bp, Homo sapiens
  misc_feature (57)..(57): n is a, c, g, or t
cctccctgccagaaatttttcagttttgggataccagagcagataatcggttcaacnctgtggtccccctcaggtaatgccccagacccatggcaaaggagactgttttgagtgccctcaaagagaaaaaaaaaaaaaggccagtggaggaagaagcccaaattttccttgatggccgggaaaataaaagaaggccccatgataccagtggcagtggacattaagcatttgagcccctggtggccagtggagtccccgttttttttgggcctaagccggggtttttaaaaaagggcctcaattttcagggctcaaatgcccccttgaataagagatcccgaagtttttccatgggctccttgacaggggtttacacaaggggcatccctagctccagccgcaatgccattaccagttcctaaagctcccctgggggcttttcccagctggggaaaaaaaagggccccagtttatcccccttttttagcccacccttatcccgttcccagaccccggaggggccagca

SEQ ID NO: 594678 - DNA, 269 bp, Homo sapiens
tcggtcacctcgggcccggttatagcggtctgacatgagaacaacacagttttagatttgaaagacttgatcttcttagagaaataaaagcgctaaaacacagggatcaaacgcactgaaagctaccgagctactgtagcagaagaacccgcatcatggtgtaaaggcaatcaagtcacgacccaatgagaacagcccgaaagcaggacgggagatgctgctgcagttgtaggtcactgcacctatagtggaagagaccgctattaccg

SEQ ID NO: 594679 - DNA, 165 bp, Homo sapiens
  misc_feature (70)..(70): n is a, c, g, or t
tatgaccgtcctgggagatgatggcttgaatatgcagacaacttgaatgtgcctactaaattatagcagnggactgtggcacccaaggagttctgactttctgggattataatagtaattcccagccatactctgaactttatttgggtagtctaaatgcaatca

SEQ ID NO: 594680 - DNA, 245 bp, Homo sapiens
ttttctctgccgcgtgtgcgttttacctcctcccccgccctcagggtccacggccaccatggcgtattcggggcagcagtccctgcggcagcaattggcctttgcagcggcggcagagcaccaaggctctgcagcggcaacccccagcggcttaggcatggcgcttctcacggcattcagcagccagcgtttctgttaacccacaaagacaccttcgaattaagcacatttctcgattcccagca

SEQ ID NO: 594681 - DNA, 114 bp, Homo sapiens
tatattatgatattaaacaaaaaacacatttcggtaataacttttgtagcaatattaagaaaaatatgtgatttgaccaaggagagtttttatttccgcaactggtacggcggg

SEQ ID NO: 594682 - DNA, 382 bp, Homo sapiens
tctgagttttacaaagagagagagagtggtcacggaggccgtgtctgtagtcccagctactaggaaggcagaggtacgagaatcccttgagctcaggagttcgagaccagcccaggcaacagagtgagaccccatctcatagaaagaataaaaataaaaggagaggccaggtgcggtggctcacacctgtaatcccagcactctgggaggccgaggtcggtggatcacgaggtcaggagttcaagaccagcctggccaagatggtgaaaccccatctctactaaaaatacaaaaattagctgggcatggtggcaggcacctgcaatcccagctacttgggaggctgaagcagagaattgcttgaactcaggatgcttcttga

SEQ ID NO: 594683 - DNA, 1546 bp, Homo sapiens
  misc_feature (1369)..(1369): n is a, c, g, or t
  misc_feature (1374)..(1375): n is a, c, g, or t
  misc_feature (1378)..(1378): n is a, c, g, or t
  misc_feature (1401)..(1401): n is a, c, g, or t
  misc_feature (1405)..(1406): n is a, c, g, or t
  misc_feature (1410)..(1410): n is a, c, g, or t
  misc_feature (1417)..(1417): n is a, c, g, or t
  misc_feature (1422)..(1423): n is a, c, g, or t
  misc_feature (1463)..(1463): n is a, c, g, or t
  misc_feature (1514)..(1514): n is a, c, g, or t
ccactgatcgggttactgttctggtgcttccttttgttttctgtcagactggtctctgtgactgagtggtcgtctgtctggtgtgttgatgtggggtggtgttctattgtggtttggagtgtggtgtgttgtgtgggtgtggtgtgggggttgtggtgttggtggttggttggtgtgtttgtggttggtgtggcgtgtgctggtggtggtttgttgtgtgcttgtttctggggggcttgtgggttgtcgtggtgtggccggactgctcccttggtgttgtgcctcggacctttgatcccatgcccctttgtgtgttcgacgagccacccatgcgctgttttgggggtcccccccaatgtgtcacttctgggaaggggttccccagcacgaggggtggagcaccaatacaagccacggccctttgtttatatccgccgcggcccgacggtatgcttttgttcttctgtgttcctatatgggttctccgtagtcctctttgtgtggtgggcggtattttcgtgcattcgatgggcggcccccactggggtatcgggatgccccgccgtgtgggtacagggaggtgaaactactgtgcctctttcattggggggttgtaccaccccgtgcgccccccacgcctgttgatgggtgcccaaggtttttcctgtggccaagtcaaccggcccgcgggctccctcttcagcgcccttctgtgtgtgcccccccacgaagtggggaaccccactggggggcctttgtccgttttgtcacggggcacacaagcatgtgacccccaaaggtgccgctgtctcttgcgctgtgccctcgtttgaccccggttttggctccctcgtgggataaaacatagagagggggcccctgattttaagacctcccacacgtcacgtggtggcacacaacagatgcacacacacgggtagcactattgtacacgtgcacccgcgggcttggtctgcgtttttcacagtccacggagagaaaggtcacgcgaagaaaggaagttttatatgaagtgttgaagtgttgtttgccacatgtgaaaatttggggcacactgggcgttcttgaactctcctcccccctcccaagaagaaggaaaggagccccctcatccaccccccacactggcgaagacacgtttaactttgccgaacttgccacagtgttttgcccaaaccccaagagattttgaaaggaaaatgaagtggccacgcgccacagggcccacaggccacatgttggcctgcccacaccctcacatgtcaacttggcgcgcgggcgtggggtgggggtggcccgccacgcactcccacgccttgagagtgcttcacctttcctttcttctgtnaaccnnganactttgagaaaattgttcgtttnatcnnggcntctgttncctcnnatggccttttgctacgtgcctcccgagaaatttgtctttntcgtataaatgaccaagtgttgaaaatgtatttcctgaaataaatgtttcnaatgccagaaaccccccaagaaaaaaaacaaa

SEQ ID NO: 594684 - DNA, 802 bp, Homo sapiens
  misc_feature (228)..(228): n is a, c, g, or t
  misc_feature (235)..(236): n is a, c, g, or t
  misc_feature (247)..(247): n is a, c, g, or t
  misc_feature (253)..(253): n is a, c, g, or t
  misc_feature (256)..(256): n is a, c, g, or t
  misc_feature (268)..(269): n is a, c, g, or t
  misc_feature (277)..(277): n is a, c, g, or t
  misc_feature (294)..(294): n is a, c, g, or t
  misc_feature (297)..(297): n is a, c, g, or t
  misc_feature (315)..(315): n is a, c, g, or t
  misc_feature (321)..(321): n is a, c, g, or t
  misc_feature (326)..(328): n is a, c, g, or t
  misc_feature (334)..(334): n is a, c, g, or t
  misc_feature (336)..(336): n is a, c, g, or t
  misc_feature (353)..(353): n is a, c, g, or t
  misc_feature (388)..(388): n is a, c, g, or t
  misc_feature (511)..(511): n is a, c, g, or t
  misc_feature (519)..(519): n is a, c, g, or t
  misc_feature (655)..(655): n is a, c, g, or t
  misc_feature (699)..(699): n is a, c, g, or t
gtgaatccggttcagacaattggcaggattcaattcgagggacacattcaagcaggttgtcgagaggttaaaacattacgaggttaacaacgaggaatgaacaacagaatcaaccggaacacctggaatgacaatgctcggagctcccctgtggtcatcgacgcctccactgccattgatgcaccatccaacctgcgtttcctggccaccacacccaattccttgctngtatcanngcagccgcccntgccangantaccggctacannatcaagtntgagaagcctgggtctnctnccagagaagtggtccctnggcccngcctnnngtcacngnggctactattactggcntggaaccgggaaccgaatatacaatttatgtcatngccctgaagaataatcagaagagcgagcccctgattggaaggaaaaagacagacgagcttccccaactggtaacccttccacaccccaatcttcatggaccagagatcttggatgtatccttncacagttnaaaagacccctttccgtcaccccacccctgggtatgacactgggaaatggtattcaagtttctggcacttctggtcagcaacccagtgttggggaaacaaaatgattcttttgagggaacatgggtttttagggcnggaccacaccggcccacaaacgggccacccccataaaggcatanggccaaagaccataccccgcccgaatgtaggtgaggaaatccaaattggtcacatccccagggaagatgtagactatcacctggtacccacacggtccgggac

SEQ ID NO: 594685 - DNA, 122 bp, Homo sapiens
cggattatctgatagcctccactctgccatgtgcgtaattgagatggagggactggcgagggacagaagttgttcaggcaaagagggcactgcagacaggagtggaggctgaaagagctgtg

SEQ ID NO: 594686 - DNA, 380 bp, Homo sapiens
agtcactcccccaggaagtaggtgatgagccctttactctgagaatgtctgcgcctggtggtggtgggaggacaaatgagccctgtgtcagtcctgctccctgaagcccacagtctggtggaggaggtgtcaccagggacctaaatagctatcaggaagcatgggggccacctccccgctccctgcacctccagagagactgccggctccaggaatgtcatccctccctacttgactctggcagagggaggctgtgccgttgcaaggccccaggtcaagatattggtggcctggaggatgtgatttcattaaaatcaacattgaggggaatgattgtactaacaacagcatgtgctgaaatacagtacttgcgcatgcca

SEQ ID NO: 594687 - DNA, 831 bp, Homo sapiens
  misc_feature (228)..(228): n is a, c, g, or t
  misc_feature (235)..(236): n is a, c, g, or t
  misc_feature (247)..(247): n is a, c, g, or t
  misc_feature (253)..(253): n is a, c, g, or t
  misc_feature (256)..(256): n is a, c, g, or t
  misc_feature (268)..(269): n is a, c, g, or t
  misc_feature (277)..(277): n is a, c, g, or t
  misc_feature (294)..(294): n is a, c, g, or t
  misc_feature (297)..(297): n is a, c, g, or t
  misc_feature (315)..(315): n is a, c, g, or t
  misc_feature (321)..(321): n is a, c, g, or t
  misc_feature (326)..(328): n is a, c, g, or t
  misc_feature (334)..(334): n is a, c, g, or t
  misc_feature (336)..(336): n is a, c, g, or t
  misc_feature (353)..(353): n is a, c, g, or t
  misc_feature (388)..(388): n is a, c, g, or t
  misc_feature (511)..(511): n is a, c, g, or t
gtgaatccggttcagacaattggcaggattcaattcgagggacacattcaagcaggttgtcgagaggttaaaacattacgaggttaacaacgaggaatgaacaacagaatcaaccggaacacctggaatgacaatgctcggagctcccctgtggtcatcgacgcctccactgccattgatgcaccatccaacctgcgtttcctggccaccacacccaattccttgctngtatcanngcagccgcccntgccangantaccggctacannatcaagtntgagaagcctgggtctnctnccagagaagtggtccctnggcccngcctnnngtcacngnggctactattactggcntggaaccgggaaccgaatatacaatttatgtcatngccctgaagaataatcagaagagcgagcccctgattggaaggaaaaagacagacgagcttccccaactggtaacccttccacaccccaatcttcatggaccagagatcttggatgtatccttncacagctcctcctggcacttctggtcagtaacccagtgctgggcaacaagtgatctttgaggaacatggatttaggcggaccacaccgcccacaccgctcaccccataaggcattggccaagccattcccccgaatgtaggacaagaaggtctttttcaaacgagcatatgatggccccattccaggacacttgtgagtacactaatttatgcagtgccgtggccactgatgaagaacctttccagttaggggtcctcgacttctacaagggcacttgacagggctaaccgaggtgccccctcaacaacacaatggaggg

SEQ ID NO: 594688 - DNA, 319 bp, Homo sapiens
  misc_feature (221)..(221): n is a, c, g, or t
  misc_feature (302)..(302): n is a, c, g, or t
  misc_feature (317)..(317): n is a, c, g, or t
ccaccaaaaaaaaaaaaaaaaaaaaagtaaccaggaacgtgtgacttggcaaaagcagttgaagacatggctcatgaagtcctgacccttggtcccaccacaacaaagtacaagtcaacagagatacaaaacctagactgagtaattcttaatagacttgaatttttatgacttaatccttctatcttttaaatatttgtcagatattttaacattgttcnctggagcttgtaagctgggcaatggtggcactcacctttaatcccagcacttggcaggcagaggcaggaggatttctgggntcaggggccagcctngg

SEQ ID NO: 594689 - DNA, 596 bp, Homo sapiens
  misc_feature (2)..(2): n is a, c, g, or t
  misc_feature (67)..(67): n is a, c, g, or t
  misc_feature (86)..(86): n is a, c, g, or t
  misc_feature (200)..(200): n is a, c, g, or t
  misc_feature (220)..(222): n is a, c, g, or t
  misc_feature (247)..(247): n is a, c, g, or t
  misc_feature (260)..(260): n is a, c, g, or t
  misc_feature (263)..(263): n is a, c, g, or t
  misc_feature (279)..(279): n is a, c, g, or t
  misc_feature (281)..(281): n is a, c, g, or t
  misc_feature (283)..(284): n is a, c, g, or t
  misc_feature (287)..(287): n is a, c, g, or t
  misc_feature (289)..(290): n is a, c, g, or t
  misc_feature (315)..(315): n is a, c, g, or t
  misc_feature (317)..(317): n is a, c, g, or t
  misc_feature (343)..(344): n is a, c, g, or t
  misc_feature (347)..(348): n is a, c, g, or t
  misc_feature (356)..(356): n is a, c, g, or t
  misc_feature (423)..(424): n is a, c, g, or t
  misc_feature (435)..(435): n is a, c, g, or t
  misc_feature (438)..(439): n is a, c, g, or t
  misc_feature (442)..(443): n is a, c, g, or t
  misc_feature (455)..(455): n is a, c, g, or t
  misc_feature (457)..(458): n is a, c, g, or t
  misc_feature (468)..(468): n is a, c, g, or t
  misc_feature (471)..(471): n is a, c, g, or t
  misc_feature (481)..(481): n is a, c, g, or t
  misc_feature (485)..(485): n is a, c, g, or t
  misc_feature (487)..(487): n is a, c, g, or t
  misc_feature (489)..(490): n is a, c, g, or t
  misc_feature (493)..(494): n is a, c, g, or t
  misc_feature (498)..(498): n is a, c, g, or t
  misc_feature (502)..(502): n is a, c, g, or t
  misc_feature (552)..(552): n is a, c, g, or t
gngtgctgctgagttgcatgggatgagatctgcttctgagatcctggggctgtatgccacccccaantcaccagagctcttccagnacacagcagcacccccaccccccagctggcttggagttgggcagagaagcttatgaggctgttatctctcaacagacagctgtgcagggctggaggcagcagctctcatcaggnggcctgcagtgattcacagnnnaagaaaaagattatatgctgaatantaatttccagcantgnatttgtgctcagtctntntnntcncnntttcccaagggtgtgctgtcctttntnagagagagggcagtgaaggggagatnntanncaaagagntgggggctttgtgccagccttctgggtaaggttcagtttattgtctggaggctgcagattcaggganntcagcagggtntgnnaanntttgcagtgaantnnaggagagttnatngatgatgtanttanantnnttnnttcncctnccagaaaaacaatgtgccgctccctttcccttagtggcgatgtacagggntacacgggcccccatttgcaacagcctctgaggccagggccagc

SEQ ID NO: 594690 - DNA, 172 bp, Homo sapiens
cgtcgaccgcggtcgcgtcgacgggagggagggtctcttgtttgttttacaatctctctacacagcagcagaaacgtaaaatacctggttggcatttcttttttctttgtaacaaataattcaatttagtatactctgtgtatatacaaagtttttgcatgtttgtcgacgc

SEQ ID NO: 594691 - DNA, 726 bp, Homo sapiens
tggctttccaggaaatagggatttatttctgggtcaggggagggtcttctgaaacctcacagggcagataaagctctacttttaaagttgttcttctgcaaatgccacatggagaaaaagcctgtatccttgacagtgatttgatcagtggactctggatttcctgaggactgagcttcacttttgaggccagagtgggcttatctagaacctcatactgcaagggtaaatgaaccataaagttcctcatgaagcgacaggcctgtggggaccaggtaagtgattgatagaaatgggtgaagcagacaaatacaagaaaaactgtagctgtgatgatgaactaaagcatgttccctgattatggaaacagctactttactagttaggatgatctctgttgaaagtgagagaaaatccaattcaaaatggcttaaacaacaaggaaaatgtatggctcatataataaggagtaccaagaaagtgtgaggtaactccagcagtcactgatctaccaattccatgacatcattgaaaggccaggttttattcttttcatctttctgctctatctatctatctatctttttcagccttcataatcaccgtgtggagcgcagcagtaccagctagagtattcagatgcccatatccagaaaaagagacgaggggaaattttccagaagtgttgtaacataattcctctgtcgtcttactagcaaaaaaaaa

SEQ ID NO: 594692 - DNA, 748 bp, Homo sapiens
gatctgtaccgagcaggagtgccggatgtgcgtgcacgcggaggaccgaaggagtgacaggctatgcaaataggaccttgtagtctctgcgaagagaagagaaggcctaatgatcatatgggtccagccatttcagacattgcaggcgccatgtccttggtgtaccagataagtgaatggaagcagtgctggtagcgtacactgggacacgagattggcagtggtgcgtggttcactctgcaccagcgccactgaatgtgtgccttacccagggccctctctacaatgggtgccaccagtactgacagagtcgttttaactggtgccttcgcctgatacctcgtagttagacactaagtgggttccacgactagttgcatgccttcctcataaagcatgtgatgcactgttgcttgagtgtgccagtgatgtgagtggacgcgtggctggaatcttcgggagagctgactgaggtgtctcgaatcgaatctcccaggaggctttccttcacagctccacacgtaattcgtgggtaagctacgcagtgtaggctttcctttccaggggccctcttattcgtggttaacatagccaaatgagtcccgtctggcgttgcaaaggtgtagcggggctagacgattgggaagcgattgcagacacgtgtgcccaggtggcccatggggaactatgaaaggcatgggtactcattggccacacaaacagggtttagagacataggaatgaacaa

SEQ ID NO: 594693 - DNA, 906 bp, Homo sapiens
catgcaatgatacagtatagctatgagatagcagtctagactgtcacactggaatgatagggtatatagagcgataggtttagatccgggaagtcactggttgcatggtatcgaagcccatcacagtgaacctttcttgagcctctggcagatgattaagaaaagcagtattattcagaattctaatatcatcattgaaataaggaagttgataatcgcattgtataaggtaggcgatactgtgtatgtccatattaggtgtgatcgtgtgtgaatgggtctgatgactgtagtgactgtttggtaggagagctttatacagtggaagatgcttggacatgaatcagattgtgcaggtgttcaacgtatagtggctaagacattgatgttttctactttgcagtgcctgcagtaagtggcacatgatcaaacgagattctggtaatggctgattgtttggtaaagtaggaggattaagagtcatacagcaaaatgtgggttaattcatatgtagatgaaaaataattaacactgtttagaatgaccgagttaaaaaaagatgctatcaatgtacacaaatgaacaagaatgtgagttagaaaaacagggtacttaagaagtatgacatttgtgaagtattgtatttaacgggcatgagttttaagttccctggagtttcaagaaatccctttaaaagaaacatcgaaacaagtaaaacttttttatagaaaacgagtgaccaaacagtacaaagttaaaagaaaaagaaacaatattggcaggggaaaacagagaacgagaaaaataggaagaaaagggggggggggagataaaaaaaaattaatcgagaggagggggagccgaggaaaatgggggcacacagacttattaggtgataaaagaggt

SEQ ID NO: 594694 - DNA, 107 bp, Homo sapiens
cggtatgtctacgtctggaactaaatcttaaaatgatgagattttctacttggaaaaggattttcaaatgaaacattgaattgctttgaactataatccctttcttt

SEQ ID NO: 594695 - DNA, 1270 bp, Homo sapiens
  misc_feature (657)..(657): n is a, c, g, or t
ttgtgcgtcgtgtgttcggtcacatcaacctcgtggtgtacaattgtgctcctgactcacagaacatcagtgtatctctgcttactgtagtgcggttttaatcgataagtgtggttaatttgtaaggtacgacggtggcagcttttagtgaagttagatattctttgttgagtatagaaattgttttttggtggcgtcgtcttctctgtctgtgttgcgaacaattttgccggtctggccttcagcaatgaaattgtggctgttgtattgtacttatctatgcaatctgttgggtgtcttcctttcacatcttctgtgttgggggtatgttttgttgtatatcgtccctccgacagaggtatgctgagtagtacgtattctgtattaagtcgtaatgttgttcgtagtgtgtgtgttatgctaagtttgtgtggtgatgggttttataacaggaaacatcatctggctaaggaataactgttgcccgttggtggctatccactattcgcttataatgtttggcctcagctcctgggttaacttctctcatgttgggttggacagcttacgcaaagaatcttttgaatgcatattgcctaacttctcgattcaaaactcactacacaggtgtgccatcggctagaacaggagggaagncgtgtgctatacaagagaggttaagtgcgcgtaacaaaaggcttgtaggactgtatgcgtcctttgaaatttacgccaagttttgtggttaatgcactagttaagagcatagtctagcgttgataggctgtacatatgtgtcaaaagaacatggagagctgatcggagaagctgtcgatggtttcgtgctgtcatgtcgtctcgtgaaaatagtaaggaaatatgtacttgatttctcgtagtactggtaatgtgatgttctatacctgtttcatatagtaatattcgggcaacatagaaatatgtgtggtagcaaggaagatatgctataagacctggtttatcccgtcaacaacatagtaatgaatagcttgcgtagctggaaaagtgttataagacattagactaggcttgtccaatgtatagagtcgttcatattcgtgttgcatggaagaaagttgggttcttggcatagagttgcatgatatgtaagatgtttgtgcattaataattagctataaaaactctgtgttccaaaaagtggacatagcatgtagcaggcagttttctgtcctgtgcacaaaaagttaaacaagttgttaaatatgttcga

SEQ ID NO: 594696 - DNA, 668 bp, Homo sapiens
tgtggggttaaaaatatggttgtccctttaaaaagggaaatattttcccccttggttggctaaatatatactgggggagtaatacaccctgtaagtgttgtccccaatatggtgtcatcattgaagggtgtaaaaaagcgaggtggccattgtatatcgctgggtggtgtaaagggccagggcctctaccaaccattgttggccactagacttgcttgttgtcgacccttgggcaatgtccactataactataagggtggcctcagttatcccttctgtaaaaatgggggataaataatatactgaccctacctacaaaggaggacagtattgagagggcatatagactaagtggctttttaacaaaggcttttgggagatccttcagcaccagagaatttctcaacagacctgaggttttttttaataaatagggaattgtcccccaatgaacttgatacgtccgtgttggcccccagttttgcttgactcctctaaaaaacaaaaaaaaaaaaaaaaaaaaaaaaaaaacaaatcgtccgcggcgccaattatcagggtggtgtcgcgacaagaatagttaaaaaaaatgacacgtggataaaactagtataattcacacaccacatttcttaataaacgaggtaataactcagcgactacacaag

SEQ ID NO: 594697 - DNA, 619 bp, Homo sapiens
gaatggtattcgaggtacacgtgaggccaacagaagctggctggttgagcccaaagggtccctcgaggtcgaactgcaggcaccaccctgtaaaccagcctgaagctggagtggtctggagaaccatctctagactacaagacttctgctggagatcgaaaacagagctcaagtggaaaccagttactatggatctcaaaaatcatcgtcccaatgacacggaatcctccaaatgactctccttcaactgctccgggaagcaggagtcatatgacattccacaacgtcacgcagtgtactcaagcactccaaagagcaaggtcagtcactgaacactagcaagaccgagattatgagatggcatgtgcgagctaacgctccttgtcacacagtttgaagtatgcagtaggtgcgccaaacgatgtaaggccccatgggaacatggcatcaaccacgttctttacatgtgaccagttgggcacaacggagaattactgcacgtagtgaaggaccgttccgcggaagtgcacgccccttgcatccggaatggacgggccgaaagaacacattcaaacaggcacgcgatgactgcaaggatgtgcaaccgcaattatattgc

SEQ ID NO: 594698 - DNA, 430 bp, Homo sapiens
  misc_feature (61)..(61): n is a, c, g, or t
gagactcacacttcttctttctcatcagggaaggaaagcccccctgtaagcgatactcagnatgagggcgatgagcccatgccgatccccgaggaccttcccaccacctcgggaggacagcaaagctccaagagtgacagagtcgtggataacctgaggaccatggatgctgatgagggtcaagacatgtcccaagtttcaggtgagaccttatgagatagctgtgtgggaagttcatgagaaaagcttccctggggccggaagtcacagtgcttggtatgctcatgggggaggaataggggctattctgcaaaagaaaagaccatgatggaatttgcctgagtgtttccttcacctgttacaaattatctcactttgagctgaacagaaagcctccaagatgaaattagttttactgttaaacttcagg

SEQ ID NO: 594699 - DNA, 207 bp, Homo sapiens
cacccaggcgcacttctcccaggaagcagactgacctcttgctcttcagtaatcgaggaaagcccaaagcactctccatcacctccctgatatcacgccttcagtctctacatcatcacatgatgggctctaactctgaaggcaggtgtgctcccacagggtcaagccctgaacattggacccagaagtgcgcctgggtgcggctat

SEQ ID NO: 594700 - DNA, 324 bp, Homo sapiens
ctgacttcgaggatttccaggcgcttgttgggtaggtacagagaagcttcaagctctgagggaaagggcctccttcctaaatttcctgtcctctttcagctcctgaccagttgcagtcccttctagtcaatgacatgaattttagcttttgtgggggactgtaaagtttgggcttgctaattcttgtccctaggtgttttgttcaccattataatgaattaagtgagcataggtgatcccatgtaactgcctagaaacaacactgtagtaaaataatgctttgaaatttgaacctttgtgccctatcacccaacaagcgcctgg

SEQ ID NO: 594701 - DNA, 739 bp, Homo sapiens
  misc_feature (236)..(236): n is a, c, g, or t
ccctgtagatcaagtctcgcacccccagggcgctagtactcgcgttggatccggtgctccatcctggcctcactggccccttcccacaagatgtggattagccaccggagttcagcgagtcgggcccctccctcgtccccccgccaatgctttttaaccgggactcctcccagatgcgtagcctttgctgcctgggtttattgaggatagaaatttgcccctggccaatgcaccanacctcatgctagcctccccgaaactggattagccttcctgtaaagaaattgtccctgaagcttgtatctgatatcagccactggattgtagaacattgttgctgattttgaccctgtattgaagttaactgttccccctggtattaacgtgtccgggctgagtgttctgggatttctctagaggctggccagaaccccttgtgtttgtcttgccgggtctgtccgggttggaaagtcccagccctaggaccccgtgttcccttcttagctgatgtctttggcccagcaccccctgggctgttacttgctttgagttgggagcggtttgcctttacccccgtaaatgtattcattcttcatttatgtaaggttttttttgtaccccattctcgattctttgaagagatgaccaccaattttggttttctactgttatctgaggaccttaggcccccgccacccgtccttgtgtaaggcaaaattaaagtgctgccgtaacccta

SEQ ID NO: 594702 - DNA, 907 bp, Homo sapiens
gcgtcgctcagcgtgaagggcctaccttctgggacaaggatggacgccaggatgcgcgagattcgagcgcttacagcttctgactgcaagccccgatactctgaggctggaatccgaggctgcggcgggtccgggagccatgcgagtcggcggcgtgagcgctgggtaggccgatccttgttccccagcagtcgtagctgtgcctggcgggctatcctaggcagacactaaccgacgatgaggacggggtagcttgagtttggcctatatccacgtgacagtagtgaaatgacagtgggcatgtcctatgtgaatgcgcatgacatcttccgaatctacgtgaatgggaaaaaagagtagccggcgggagtcgaccgcccaatccgtgtagctctatggaggcgtcccccgctaagtatgggtggcgtccccgaatgtggatctgcgatgggctggctatagggccttgttggtgagtgaaccctgttaccaagttgcacgctgtcctggccacgcattacgacctttgtgtgtgatgcgtactagccggaggcgtactaggggcttgactaccagggggcgtcgatcggaaggctcgcagttctgtagtcccattcggagcagcgtgtgtgaaggggcttctcggctcaagccgctggtctccgggaaggtgaccaagcgggaggacttcggtgtgggccagcgcatggtgaccttaggggtccactcacggaaacgttggacgcccgaccgtcctccctcttgttgccatggtgagggccccagcccatgtgggcgcagcgcgtgagaaattcagagtacttgggttccaatcggagggaatccggaggtggtgagtttcctgaaagacccgttgggcgagagttgtgccaggtgggcctttagc

SEQ ID NO: 594703 - DNA, 660 bp, Homo sapiens
gaactggtgtgctgttacctgtcgagggtactggcagatcagcgtggacagcatcaccatgagacggagaggccatctgctgtgcctgaggtgtgcaggcaatttgttgacacctggaacctctctgctgaccggcccaaccagccccattgccaacatccagagcgacatcggagccagcgagaactcagatggcgacatggtggtcaggctggtaacgcatcagcaggcgtgcctgacatcggtttcacacaatcaatggagtccagtacccccgttgccacccagtggctaacatcctgcagagggaaggggagctgcatcaggtggcttccagggcatgaacctccccaacggaattctgggggagccttgggaacctgggtgatgtctttcctccggccaagtgtggagaaaataggtcctaaaaaattgtatacagacaacccttttatttccaaccaaaggtgtgccgagagaagagagagagaaaatagttataagaaaaattgtatacagacaagcttttgtttccaaccaacgtgtatctagaaaagagttaggccgacttattttatacatagcatcagtgaatagtaatgaggggtcggacatttcaaaatcctgttgcctatattatgtgaatccagtgtgaagaga

SEQ ID NO: 594704 - DNA, 662 bp, Homo sapiens
cctgccagatacttagtatgatgaaaacgtgtgtcagcccggtgcgctttctattacatttgcctaccatcttaggacgatggcagaaccttacatatacagggagctacgatgagccagagtaatatacataaaccaccagaaatcatcctctcctttctaagacacaacaaaatcacacatatcatctttgtcaagggcgtaaatatatcattcattacccccattaaattttggtagaaaaattaccacattaaatatatgaagtaacgtagataggatatgctgaaatagaagtagggcatattagcaaaatattcttaatttgtggcctcgattctttattactacatattacccaagttatcttaagatgtctgtaacttaacctttaattaaagttttgtcaatctttgtagacatagtggttgtggaacaggaaaaaaccatatggggactatagtgcaacctatatgggtaaaaacaccatttgctcagtgaagaacgtaaataaataaaattaaaattacagaaacatgtaacaggccttacccatggaaagcggtcttccttgtcaacgataatactgttcaggggctcttctgatcccgaatactggaggaacctccaacatgttaaacgacagcaacggcttgcccgct

SEQ ID NO: 594705 - DNA, 280 bp, Homo sapiens
aaaagcagcacaagatccggccggggactctttcccctctttccggaacataactaggttttgtatgtgctctgagttcctagtttaactgtcttggctgagaacccacagacaaggactagacttttcataccatgcgagagcccactgagacctgcttgtttattttgggcataattgctagacaaaaaggtccgcaaaggaacctgccaggacccagggccgtgtgcccaaggtttccaggtcattctaggtttctcttcacaatttccaaaattgt

SEQ ID NO: 594706 - DNA, 129 bp, Homo sapiens
ttctatggtggtgagcagagcattctcttatacaactcaacatcttgtgtcagatttgaactcttcaatctcttgcactccaagcttgtaaatgatagtgaagcgtgcataagtatgcccgcaatcgaa

SEQ ID NO: 594707 - DNA, 718 bp, Homo sapiens
gcagggggtgggccgggggccctggtggccctgggatggggaaccgctggtggttccgctggaggtttcggcagtggcatcctggggccggggtctgcggcctgtggactgtgtggcctggggcctgatggccgtggagctcgcggaggcaatggcctgatggataaggagtggatgccctgtcaccaagttgggcctgcttggtcaaggacatgaagatcaagtcccgtggaggagatctatctcttctccctgcctattaaggaatcagagatcattgatttcttccttgggggcctctctcaaggatgcagggttgtgacagattatgccagttgcagaagcagaccctgtgccggacatggcaccaggttcaaggcattttgttgctatcggggactacaattggccacgtcggtcatgggtagtaagtgctccaatggaggtgtgcacctgcatcctgtgggggccatcatccgtgggccaagctctccatcgtccccgtgccgcagagggctactgggggggaaccaagatcgtgcaaagccccgaagtgtccctttgcaaggtgaacaggcctgtgggctctgtgctggtacgcctcatccctgaaacaggggcactgggcatcgtctccggactgtggctagaaggtgtcatgatggtggtatcgataatgtaacctcagccgggttgcttgcacctggaattcgcaggc

SEQ ID NO: 594708 - DNA, 910 bp, Homo sapiens
tgaggtgtatgtcccgctgcgtttgtggttgatgatcgctgttactgttggcggcttttttcgtatggtgacgggaatctgccatgtgaccgtcccgtggtggccgcggtgtatcattcatgggttgctccctgagttgtcggtcctattcctgggtggaacgcgcaatttctgttgcagtcttaaagtttccgagtccggtcccccaacttgccggcttttcccttccccggctgtttggtcgtctcggcccccctgcgccatagcactagtggtctgcacaggctgtcaggggcgccaattccacaggcgcgggcatgccgaaagtgttattggtgccgccacacggccccgggcgtttttgccggtgggtgtcccccacaaaccgcgccgcctcttttgtgcaacccccccctcgggggccttaaaaaggtcccccgccaccttgttggttcacggcaactcgaacacccaggtcatgttcccacagggctttctgccagccgtttctgcgcactcattgttccaggccacatacgcccttctacacatgtgtcagcccggccgttggcccctggacaatagtgcggtgtccctgctcgggcggatggcgcccctacagcgaccgtgggtgcccggtggcttccccgcgtacgccaggtgccccaccaccgggtgagggcggcgacggtttccatggtacacaggcttccgagggtgactctctccttaggcgcattccatctcccctggggtaaccccggacacccgtgttggcacgctttttgtaatctcgcctcacgccgtctccgtggggctcgtaccaccccggttggcctcgcaccgtcgtctcccgtccccaacccccttgccgggcccccccctacactcatttccaaaaaacataaca

SEQ ID NO: 594709 - DNA, 327 bp, Homo sapiens
cccttactagatcgatcacacccaggccttaatttaatcaatttgatttcgatggacaacaagcttggtcccaacattatgatacgatttctgctggtctatccctaacttatacggatgccgaagatggccaaaagcgacagatttctgctggtcaagctttgaacatgttagatggtgagcctaacaacgaaacacgtgccaacattatggcgagctacgaaaaatgtgggccagtgccggatatctcaccgctgatacgctcaatcatttagccggtttccgtttaacggaccaaaagctcatggttaccagtcacatcttgga

SEQ ID NO: 594710 - DNA, 760 bp, Homo sapiens
agcggagtctgaacgatgaccaatccaccacacgcacctacatgtgtaggacttccattttactctctattctggttctggggctgggcatagaactgttggagttgagtataaagatcagggcttacagctccgtagagtggagtatttatgggctgagacgatggggttttccagatataggatcatgtcatctgcaaagaaagacaacttgacgttcctctcctcccatatgactacactttatttctttctcttgcctgattgccctggcctgaatttccaatactatgttgaattcatgactcactatattgactataagagttcaacagtgaacaccaagtgataattcagcatcaggaaaatgatgtggcagtgatgctaaagtctaggaataggaatatagaaacgtctgtgagatacctaaacatcagatttgtagaaacagaatatgaatctgactacacagatctgtagtcttctccactccgtgttcctgcagctagagagcatgaactaagcatcctgatgaccactctcagggaccttgagtgactggccggtgcaccatggaacttaaagtatgggtggactggagttcacgcaggatggtgtgtggagtcactgaattccacatttgcgcagagttgtcataggcttaagctcaagcaataggtcgaactggaaggtacacccttatagagacatggcgagatactgcatgacacttagcaccgtcttgaagatctattatatc

SEQ ID NO: 594711 - DNA, 386 bp, Homo sapiens
gtgattcccatgcctgaacttgttgagtatctggattacaggtttggggcactacaccgggctaatacgtgtatttatagtacagacgggctttcatcatgtcggccagactgatctcaaactcctgacctcaaatgattcaccagcctcgatcttccgtgctgggattacatgtgtgaatcaccatgccatgtctgtatagatctaatttaataattaacacttactagaatacgttattcctatactgtgatctattatttacattctttattaactatgcaactgtcatccagtgtgctctatatttgaggtcccttccttctctattcttacttgacatgcatgtcatcttcatgcatgagtctatgcctttaccacatatt

SEQ ID NO: 594712 - DNA, 155 bp, Homo sapiens
atctttaactggctcattttcacactagtgacttccaagtccgttatggtcagcatcctcggtcttcccatctccacgggagcatttccaacctccggccaccaactcaacacattcagggagaagagggcgggtctgggaccacagaaattcct

SEQ ID NO: 594713 - DNA, 684 bp, Homo sapiens
agcgggatgactctaggtgtttgctgttgtgaatagtgctgcaatgaacatatgtgtgcatgctttttctgtgcagaagctctttaattaaaccccatttgtcagtttttgcttttgttgcagttgctttcggcatcttaatctttgctggttcctatgtccagaatggtattgcctaggttggcttcaggggtttttatagttttgggttttacatttattaatccatcctgagttaatttttgtatatggtgtaaggaaggggtccagtttcagtcttctccatatggttagccagttatcccagcaccgttgattgaatagggaatccttttctcattgcttgtttttgtcaggtttgttgaagatcagatagttgtaggtgtgcggcctcatttctgggctctctattctgttccattggtctatgtgtctgcttttgtaccggtaccatgctgttgtggttactgtatccctgtagtatagtttgaagtcaggtggcatgattcctccagctttgttctttttgcattttgcttaggatggccttggctatttgggctctttttaggttccataggattttaaaagttttattaaataaattatggtcctgtgaaaaatgtcctgggaaactaacggggaatagcatcgaatcttgaaatggcttggggacagaatgga

SEQ ID NO: 594714 - DNA, 548 bp, Homo sapiens
  misc_feature (51)..(51): n is a, c, g, or t
  misc_feature (171)..(171): n is a, c, g, or t
actctcatatgtgtgcagtactgcaacgacagacgggcaggcaagcctganacagtctccttgagcactttcccaggttagaaaccctcttcagcctgtgcttcgcacgtttccttcagcgtgccggcattcaagactgcgccacttacgtcccagtgccacgctgcgtgnatcaagtgtcaacgggaaagtatgagttaggcaagcgctttttttttaagctgtaaacgcttcacatgactggccccgtaagaaatggtgggagcttagatgagcctggagcttttcaggaactgaatgaggactctgtacacaaatgtgtactggcagagagtctgcaccagcatcattctctgttgcctcagcatgtccagcactctcgggatgtccagcacctcattgtgttccaggcaggcgatcatgatctccgacaaaatcaccacgccagtccttcctaccccagcactgcagtggaccaacaacggagggttggggctttggggatcacttgtgctatttgtatggcgtcgaacagactggatctcttc

SEQ ID NO: 594715 - DNA, 349 bp, Homo sapiens
ccgaacaggttatggctacgatcctgttacacgccagtgtgggcgatgtgatgagggccctgggtcagaacccgtaccaacgccgaggtgctcaaggtcctgggtaagaacaaccgtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggaca

SEQ ID NO: 594716 - DNA, 385 bp, Homo sapiens
gataaccgtctgaaggcagaggttctatccttattcactcttaaagacttagtacagatctggcacattctttttctctttttctttggagacagagtcttactctgtcacccaggtggctcactgcaacctccacctccctggttcaagcgattcccctgcctcagcctcccaactagctgagattataggtgcatgccaccacacctgactaattttcctgtatttttattagagacggggtttcactatgttggccagactggtctcaaactcctgacctcgggcaatccgcccgaatcggccttccaaagtgctgggattacaggcttaagccaccacgcccagcctgcccaagatcttacagcagataagtggtagaatc

SEQ ID NO: 594717 - DNA, 239 bp, Homo sapiens
gaacaatagtcagcagtggtattcacaggcgcgatccactatgatcagcacgggagttttgacctgctccgtttccagaactgggacggttcacccctccttaggcaactggtggtcccccgctcccgggaggtcaccatattgatagccgaacttcagtgcggacaaccgatacggcatagcgcactacagaccacaactcctggactcaagcgatcctccagcctcagccattctta

SEQ ID NO: 594718 - DNA, 149 bp, Homo sapiens
acgcaatgttggtgcttaggcatatacacgtcatgtggatatttgtgtattagatttaactctatcatcttgccatttgtatcggttttgtcctgtctgtaccttgttatctttttctcctttatctgtcttcttttggattagctgaa

SEQ ID NO: 594719 - DNA, 286 bp, Homo sapiens
ctttatatcattttttatatatttttataaaaatgtaaaaaagaaaaaccccgcttttgccttttccctgggttggagttttttggagtgagccctcccgccctaagcgcccattcatgtgggcatttcttgcgagcctcgcagcccccggaagctgtcgacttcatgacaagccttttgtgaactagggaagcccagggggggtactggcttttcttgagtccccctgctagcaaatggcagaacccaagctcaaataaaaataaaataattttccttccttcca

SEQ ID NO: 594720 - DNA, 412 bp, Homo sapiens
ccatgttataatgcacgtgtgggaagcacagggatcggctccttcgtaacgtccacaccagcaaagctcatgcctgtctctgaaatcccggccaagggcatggccagttgctctgaagataggtggtccagctccaggtacacgtgatctttctcagggccacagcttcttccttcgcgtatctccagagtcatccaccaagacaccacatctctagacgccaggtccttcgcatatgggggcgtatcgctccataaccctttcgccttgactgttaatgagaatgcctccctctccacgacatccttcggtaatgacacacacagcaccatatgtgcctgtgggtgtgaacctgcacaaactagaggtcctcacaagaaaggcctgccctggtgctcatgcccgtgctgtc

SEQ ID NO: 594721 - DNA, 163 bp, Homo sapiens
gcacgagggttaagtcactgatacattataaaaattaaaactttttaggtctggcagcggctcacacctgtagtctcattactttgggaggccaatgcgggcatatctcttgagcccagcatttagagaccatcctgggcaacatggccaacccctgtctcta

SEQ ID NO: 594722 - DNA, 116 bp, Homo sapiens
gatgcctctaaccttggattggcctgtgtgtgtgtttgtatggggaatatttatttttatacagttttcactttttgaaaatgccagaagtatgatcgcatcttacgtgattatta

SEQ ID NO: 594723 - DNA, 126 bp, Homo sapiens
atcgttcgcggtcccaggtcccggtctcggtccaggagtctcccccagtgtccaagagggaatccaaatccaggttcggcgatcgaagagttccccccaaagtctcctgaaagaggaaaggagcgg

SEQ ID NO: 594724 - DNA, 298 bp, Homo sapiens
ctgctatgggcttttcttctactttgatctgagcatgtgatcaaagtttcctcaatgtcagaaactggattagccagctacagatgcatgtcatttagtgaaaacccagaatatagtgctgtgtgtaaacaagagtgatctggaggaccacagactagtgaaagaggaggaagccatagctctctcctagtgtatatggaatcccctactttgaaactagtgctgccaatgggacaaacataagccaagcaattgagatgcttctggacctgataatgaagccagaagccacgtcgga

SEQ ID NO: 594725 - DNA, 418 bp, Homo sapiens
ctcaggattgactcatgtggacctgaagggtgacatcccaggaggggcctttgaaatttccaacacccaagcgcctgtgctgaggactccttccatgtggccccaggtgccaccaataaaaatcttacagaaaaaaaaaaaaaaaaaaaaaaaaaaaaaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttgggcccttttgccccaaggttttttaaatttggaaaatttttttattggggcccaatttggggtcaattgggcaaatcccccttaaggggggggatttaaaaataaaggggccgggttttaaaaacgttgggttggga

SEQ ID NO: 594726 - DNA, 1517 bp, Homo sapiens
attcggaagctgccgaagtagttggagtcttaccggactcgagaacaatctgtcgggggactcgcgttctgagagaaaaggggaaggatgtgcagctggcagttcattccgtcattctagagtgtcgcactatgcgctttacccatgcgtacgtctgtaacgccgtcgaggtaccaaacaataacgtgaaccgcattactcactcctctgagtgctactctaacaatcaacactacaccgatgcatgagtgagaggtagtgggccctgtgcagctggattggggccaattgaggtgccatggtacctcccaggcgatgaaagcggtttgtccttagcaggaacgctgcgataggttaaagggctatgagtgcctggaaaaaaagtgtaggaaccacatcatgacgtggtgcatgagggtctcgcgaagcgagcctatgaggtagtagttcttgcgtggcattaaccagaacctaccctatctaaatgctcttggcattgtgggcccgggctaagcgatcctgcactggggaattcgaagtcggggttcgcccgcacggtcctagtgggccctgacactgcgggggaacccgaccggatcgggaaactaacgggtcccgaaagagcaggctcggggagctaaacaagcttggcagagcccaaacaactatgcggtggggaacaacaacgccatgcacaaacgccaaaggcgagaggggggccgttgcttaacctcggcctttgagctaacacgggcgcatggacctccggggcattatcccattgacttcaaagatttacaccggaataaagcctagttatgccttggacatggcggaggcccactaggcaacttccctcgttagtagattgggattgaaggcgttcacacctcgcggctgattgtacgtacacgccgctaagacggcttccttggaacaccctgggttgatttaccacactccgagggcttggaaaccgaaaacatccaactgggaacccggagggcacccgcggtgcactcggggtttaggttgtgccacaccccatataaagcatatggccatatgatcccagccctgagaccccttcccgtaaatttttggttacacaaggcgtagcaccgagcgtctatgaagccagactacccaagtcctgacactctgagccacgtacccaacagccacgagccttcccctaaccgggcgacagacaatgctgcacacatcccttagagaaacatgggacagagcgaacgatccgggcgagcgataatcaccccccacaggcggagcttataaaccaactgaggcaccacaacgccacaccgagtcggccacaacagtaaagcgtggctatcagcctgcacacgacaccctcccgcgggagacccacacacgccagcaaacgacggggcgcgatagaacacacacccgcgcactcacagccgcgcacacccacgacacgcaacagagagcgtaccatggcacgcaaccaaagcgccacgcgacacgcgaac

SEQ ID NO: 594727 - DNA, 1043 bp, Homo sapiens
  misc_feature (186)..(186): n is a, c, g, or t
gagccatcgttgtaccagttgagatagcatataagaggggctatttcagctgaggaactcagttgagattctctcagatccaagtgatgataccaaaggattttaatgaccccatagcactgaatgaaaatcttacctatctgcaactaataagaacagatgcacttaaggatgaaggaaacagantcatctgtcttctgcctctgaacggataccgaagaacactaggtgctagactatcacaaaagaataccctcaggaagcgtagaggggtcatagtggatccagaaaccaataaacgaaatgtctagtacatggaggtgtgactatgaacgggtcctaattgagttatgaaaccttctacaagtatactggtgtcgcacgcgaggatatgtcgcaatggggggaagcaatatagacacatccacggggagtctagcatggcttccatcgagggatggatccatggtcagatcagcaacagcactggccagtccagtatgatcattccaatgaatagcgttattgactaagggctctatgtcttgatcaggacagttctcttgcatcaagtacgcgagtccgggggatgcatctagactcaacatcaattttgctggacattgtatcttcgctttgactccattcgggtgttcggcacactaggagtcgagtatggaggcagtgggttgtccggcgaatgatgtatttataagcacgttcccgatcatgaactcatgtaacgtaagatttccatacataatcgcagtcgtcagggaactttaaccataagggagcagctccttgattcagagtacccggggaaggaattctgagccccagttgcagcgatctttgagcatagaaaaccttggagaaatatttccctttaaagaagggtttacgccggggtggcattcgttgggaagcctcacggtccaacgggctcctggaaggctcaaagactgaaaggtggcataatccaaccaagataagggccaaaagctgcttacagaacgttacccaggcggttgtttgcccgg

SEQ ID NO: 594728 - DNA, 1348 bp, Homo sapiens
gaaaattaaaaaccacggggctgcgttcttgctctgttatatgtgtggaacaacttccgctgtctcaagatatttgtgttgtccctcttcggtggaatgggagccgctcctgcactctctctcacccacacacgccccgtcgttgtgctgttgtggaagcacgccgctccccccaccatttgttggaatggatagcacaccctctccgcgggggtgtaccgcaggatgattatccccagagcgctgctcttcgctgggggagactttctttattgcgctccttaatatgggtgccccgccgcgccgtggaggctcgctggatggtttgttataccccagctgttgttgtcatgcgaccaccccacctgcggggtgtactcctaccgcgctttatggtggtgctccgcccctcttattgggggccccctatcattctttattaggggtgcgtaacgcacacccccctcagtttattggggaaccccccacagcttcttgtggttacccaccacacaagagagcccacgccgctgctccgcgttgatgacaccccgctgtccccgcggagagtattttctcccctggggggagaaaatatctcgtgtgtgaagaccccccaacacagcgcgcgtctctgcacacacagcgagatagataaatagaggatactccccccgcggagaagagagagtttttgtgcgccacgcgggcctgtagtagtgagaggttgtgtctctccatagagagtcccccacacagagagttttccccctgtgctcacagcgggaggaggttctcccacactgtgtcgtcacacacagggggcacacacccgtgtgtcacacacacacgagaagctcttctctctctctgtgtgtgctctcacactctcctctgatgaccacaggggacacacacttctgtgtatacacaacgtgtcgcggtgtgtcccggtgtgcgacactctgagacacacagccgcacacgacacagagtgtctctctgagagggggtgtcacaccacagagatgtcacacggtgtcacaggggagcacactacaggagagcctttgacacagagagagagagcacaacacttttctctctccctctgcacgtatgaggagagctctcggcacagagagcacacacattttcactggccacccacccccttataccacactaagaaatatgtgtgttttagagagatatcctcgttttgtttagatcttcttagaaaatattctcttttggtggctcttttatagtttttcccgtttttctccctctttatttttttcattttaatattttaggagcaaactgagacaattttataaaccca

SEQ ID NO: 594729 - DNA, 479 bp, Homo sapiens
ccctgccaagaaaagagctacttcctcttgaagtaaatgaagatagtgatgctttctcttaaactttacttataaaaagcatcaaaggggggaatgaagcaggaaatataaaaggaaaaacaagtaaagggaaaacaagtcctttcctgaccagtctgactcactccaaagtcctgctggagctatgataattatctgcaaggccaggcaggggctccgaaggagtgggctccaggagcagggatgagaaaaacaagttctccttatcagtttccctgtttgaaattctctccccataacattattctttgttctgctctcacaactatttttgtaactatttctgcaagtctgtaaagattttgtaagttcttgtttttctttctgtagcatggcaaggtcacaagacatgtttaagtaaggataggctttattctgcaagcaatcaaataataaatctattctgctaagagatcaca

SEQ ID NO: 594730 - DNA, 121 bp, Homo sapiens
cgtctctccagactgtgtcacactggtctctctccacactggcgcagggagttatcttctggaatacattagctctttcaaaagataactccctttgccagtgtggagagagccagtgtgt

SEQ ID NO: 594731 - DNA, 274 bp, Homo sapiens
  misc_feature (44)..(44): n is a, c, g, or t
taatgacgatgatgatgagaaaaagaatctctgaagtctgccanaaatggttaccttgagacagaccctttctggcaaagaccagaggaccccaattgttcatccattaaaccagggccattggagccaccacattcacaggctggttcctggggctggggattccagcaaagtggtaaaattgctatttgtaaaaagcaaacaaacattacaaggcagttatctcattgctgttttgggagaggaacgggaaaagctttttgcttatttgtct

SEQ ID NO: 594732 - DNA, 905 bp, Homo sapiens
gacagcccatgggaggccgaggggcgcggcgtggggtggggagtccccggcaccccaggtccgcgccatggcgcgcaggagggcagcgcgcgggccgcggcggaaggcggccgccctcggacctcccgagcgctccctgaggccttcgcccgaggaggtcggcgccgcgctgaaggcttccggtggagccagggggggctgacgcgcgagtgtctggcccgggcccgggggggttgcccctgcacaggttgggcattgtgggaagtggggccaatttgtgaacccccgggcgtctgcccaggggcctgaatcgtgggccccggcatttgggggctgggttgcgactgttgtggggctgggggccaacaagaattgcgggcggggtcttggttggttgaagccccggtggtgggaatagccagtagtgggctttctccctggaagaaaagcataggtgtgtgtgggcgacagtctgggggttctgcgagcaatacgagactgggttctgtgggagacaagtgttttgggtcgaaagaaacacgctgtttggggaaacaattgggaaggggaagccatttggggcggcttggtttggcctataacttggtgtggggcgagcaaacccctgggtgaacttaatggggggggcccttaagagcaattttcctgggcgtgggaaacggttgtggtgcgacaacctttcgtgccatcggtaaggctttcaagaacgttggtgggaaattttgtgctggggggaaagttaaaggtgggggcagagggttttgtggaacctagacgggctagtctgttggacaagttaggcggctggggaacccggatggtgttgtggaagcagacaagatttttgggaattggcagtgagagccccagaggagagattgact

SEQ ID NO: 594733 - DNA, 347 bp, Homo sapiens
aggaatggacgtggtatctgaattaagttgcccagaatggtccatgttacatctgtagtcctgatctaataattaaggggggcactttcagtctcagaacagtaacagttaggataataaattacatggtgaccctgtctaagaaaccttgacctcagtgattagaatgtattaggcacccaaggcattcatcccgaagatcagagcatgatgcaatgcctgcaacaaagcacagtggagtatgagcagtggcaagcaacagaagccatgcaaacattacgtagcaacatgacgaagtcaagggcacataacataagcagttagggcaactcaacgtgctatcatgg

SEQ ID NO: 594734 - DNA, 848 bp, Homo sapiens
gggccgagacgatggctgaccacaagcactgacagtcgactccacgcgcggcacgctgctgcgacgcgtgctggatacatgcggacccgcgcaccccgcggcgaccccggaagtgctcgggctggagcccggagagccctgcttgaaacggcttcccccaggaagttgagtggccaaacaaggactgatagccagagggcgttcccatggagccagtgtctgtttggcagtatcggtccatattcgaggccagtgggcgacttggaggaacagactacctcggacgcgtgctgaagaacatcctactaacgtgccccagaatcttccatcctgatgcctgagtcgggtagtgaaggccagtgccagcaagcgcgcaggcggtccaactcctccaggacgagagagagcagttgcggcagccgtggagctgcgaagcttcctgagctcgagcgcccgctcagaaccctggactccaggtctgctgtgcccctggcaggaggaaacagaggctgagactgtcagtgtttcagcagggagtggaccagtgggctgtctctctcccaagagcctcaggggaatgctgatgcctcttccctcaccagatccctcaagctgaaccttttgccaacacctcttcagccagcagtcagtgcagaggcctggcttggcccggagacctccagaccgaccgagctgtagacgtggggtgcctgtttgcggggatctgcgagatacttccgcgtgctccttccaaacattgtgttggaggaaacccaagccgattctctcagtccattggttgggtcccccgaaggtgtatcacatccctgccttgacgactcaaactg

SEQ ID NO: 594735 - DNA, 120 bp, Homo sapiens
cgacagcatttaagtttgagtctgtattggacaaataagcaccatgcttttcaaataaaagtaatttttaaatcatttgaaaagcatggtgcttatttgtcaatacagactcaacttaaa

SEQ ID NO: 594736 - DNA, 145 bp, Homo sapiens
aacctaattacgcagctgcaacctacgccaagtgcaactatgctgcagctgcagcagtgcagatcttttcacgcagtgcgccaggccaggatctaggccacacctccacagtaacccaagccaccggtcagattctaaacccact

SEQ ID NO: 594737 - DNA, 1064 bp, Homo sapiens
  misc_feature (1064)..(1064): n is a, c, g, or t
ggtggattagattttgaatgatattggataattatggtacttttatgagctgtgagaagggtgtgtagttgataacaagacgtgtcttaatttgcatacttaagcatttaggaatgaactgttatagtgtcttacaatgtctcaaatggtttagcaaaatgtatgtgaggcgtatgtggccaaaatgttacatgaatctacctggttggacatggttgtgcattgtactgttttgtgctatcttctatatgtttgaaaatgtatacttaagtaaacaatattgtcaatttggttgttttgaatgaaagattacataaagagggtgtaaccgggagtggcttgagtgagggcgggggggcaaggaataaggattgtcgacattgggtaatagtgacctatgagagatctttgggccatcatttgttttgtccaagtgggtaaaaagctgggggtgtctgcccgagaagagtggtcggctcatgtcctatgaaagcatggcttttcccccttcctaagaagaccgtgcacagcacggaagagcaacaggggcagtaatccattatacgcgatgatggagaccatgtattgtggagtctcaaacagggcaccgcagtccaccgtacggttctcaaacacagtgttctacggcttgacgaaagactgtggtcacttgccccacggtgttcatgcacagagttcaagaaagagcacacacctatcaagagccaaaagtctctccaacacaggggaaacctccctgtaggccgaaggacacaagaagccggggtgggtggcacctgggtataacccttgggtgtaccctgtctacaaatggcagggtcttgaaaacacataccggacaacggtcccgaaaaccgcaaccactaaggggtaggcatttacacgatgggggaaacagataccggtgtgacgccgcaagtggacagagagacccggcgggtacgcctggaaggagaggaaggtgaagcatatgaccaagctggcagtgtgatatggaacgtgaacacaaaaacgcagagggtctcctatgaggactaatgtgn

SEQ ID NO: 594738 - DNA, 624 bp, Homo sapiens
  misc_feature (624)..(624): n is a, c, g, or t
atggtgctacattggtctggttagaatagatgaagaagggaagaagactagatggtaagagaaagggtaacttgatatttataacccaatgtatatgttaagattagcgagttattggaatacttaggttggtgtagataggctcaattgataaggtgatggaagaacagaatggaaggtcatggtttattgccaaagaactatatatgttagttttggattcgtatctcttgcgaagcacaaggatatctaggcgacaacatgtggataaccagaactattaaggcactgggtagtgttcgtctaataatgacccactatttgagacattgctagtttaggactggacaccactgatgtcaacatgtgtagacgagtgggtagtggtacatccgctatgtccactagcaatggtgatcaagtctcgagctgcattgaatctggggctgcaacgtgaataattactcggcacaagggataacacactcttctgcattattgtccttgggtccactaggttttggagcctatatttcaagacctcttcttttggttcgttgtttacagaccctatttattccatattagttccccgtttatattcctattttattatgatatctn

SEQ ID NO: 594739 - DNA, 1530 bp, Homo sapiens
  misc_feature (819)..(819): n is a, c, g, or t
ctgtgggttgtggtcgttgtgctgcttgtggtcgacccctgggtggtcaggcgcgctgtggtgtggttgcgtccctctcgtatggttgtgttcctgtggggttgcccccgctccctggggggtggctcgccgtccatcgggcgggaagtctgcttctaccgacgggttttgttctcctggccggggtgccgcggtccaccagtgatgttttggggggggtgtccacgatggtgtaagagccgctggttaccgcaggcgccgctccccgtgggttgttcgcgccaatagtcggtgccggtgtaacgatcccaggcggtcctctcagaccagtgtgcccccggagggccccccgggtcccagtgatgtaggagggtgttcacccccccctgttgggttcccgatatgctattgtcgcttgcgtggcccatatggccccgtctccggatggtgtaccccccatggcggtattccgtgatggagagccagtttctgcccactgcgccgacttcgcgggggacggcaaaatcatttgggggggcacacaagagaatgtgttgcgcgccatacgcccagaaaaggtgggacccccaccgagtttttatggcaagggggactctgtctcccagtgtgactgcctgccgcgccccaagatgtgcccctgtttccgcctcgtttagtggcgcgccagcttatggcatataaatagggcgcgcacacccgccgaactgtatccccaccataggagccgctcttcctcgcacagcacggctgaacaggtggttttttctgagtgtaagtacacacgcacgcacgcgcccncacggcttgtgcacagaccacttccgccacggctgctctcctcgagagcgttgtagcacacccgacctcactggcgctcgctggagacccacagctcggctggggctgtctctctcggagacctcttcaccacgagtgcctcgggagtagtgttcaccggagtgtccacaggctctgtcttggtgtctctgtcacagagcagcactcagggagtggaggaagacacgcactctgcgcttgtgtggagaccacgcccgcgtgattcttccacgcccctccggaatggtggacaatgttcacagctcacgcctccacgaaggctctgagacttgtctcccacgttgaataaaggcagcactgagatgccaccacttcgccggagacacccaaagggtctcccccgcgccgcttattggggagattttttcacataccgtcacgagtccaccacaaattcgagggaggcttatactcgagacaccctcgagagagaagaatgggaccacgagaccctctgagtgaatagtcaccaccaccacttcacgggacacccgctctttgaatgtattaataggccacggaaatgttttttgctaccctgagaacccttacctagagtcagccctcaagcccgtccaactccgtttaaccagttaaggagcccaaagtgtttccaatggagttctccgttaaggatctttggagaccccg

SEQ ID NO: 594740 - DNA, 149 bp, Homo sapiens
aacgatctcaggctcttccaacatctgcatgccaccgttccaacatctcatagcgccttccaacatctcatgccccttccaacatctcatctctccttccaacatctcatctctccttccaacctctcgatccctcctctccaacatct

SEQ ID NO: 594741 - DNA, 1079 bp, Homo sapiens
  misc_feature (1)..(1): n is a, c, g, or t
  misc_feature (64)..(64): n is a, c, g, or t
  misc_feature (66)..(66): n is a, c, g, or t
  misc_feature (68)..(68): n is a, c, g, or t
  misc_feature (71)..(71): n is a, c, g, or t
  misc_feature (76)..(76): n is a, c, g, or t
  misc_feature (80)..(81): n is a, c, g, or t
  misc_feature (90)..(90): n is a, c, g, or t
  misc_feature (103)..(103): n is a, c, g, or t
  misc_feature (105)..(105): n is a, c, g, or t
  misc_feature (114)..(114): n is a, c, g, or t
  misc_feature (119)..(119): n is a, c, g, or t
  misc_feature (122)..(122): n is a, c, g, or t
  misc_feature (125)..(125): n is a, c, g, or t
  misc_feature (127)..(127): n is a, c, g, or t
  misc_feature (146)..(146): n is a, c, g, or t
  misc_feature (149)..(152): n is a, c, g, or t
  misc_feature (155)..(155): n is a, c, g, or t
  misc_feature (165)..(165): n is a, c, g, or t
  misc_feature (174)..(174): n is a, c, g, or t
  misc_feature (178)..(178): n is a, c, g, or t
  misc_feature (192)..(192): n is a, c, g, or t
  misc_feature (198)..(198): n is a, c, g, or t
  misc_feature (201)..(201): n is a, c, g, or t
  misc_feature (207)..(207): n is a, c, g, or t
  misc_feature (227)..(228): n is a, c, g, or t
  misc_feature (231)..(231): n is a, c, g, or t
  misc_feature (235)..(235): n is a, c, g, or t
  misc_feature (266)..(266): n is a, c, g, or t
  misc_feature (271)..(272): n is a, c, g, or t
  misc_feature (309)..(309): n is a, c, g, or t
  misc_feature (469)..(469): n is a, c, g, or t
  misc_feature (575)..(575): n is a, c, g, or t
  misc_feature (579)..(579): n is a, c, g, or t
nggcgggaacaggccgcgctggacctgtacccctacgacgccgggacggacagcgggcggcacngncnccnccccncaanncgccaccancccgcaggacacngngaccgaganaacgnccnccncncccagccacccggccaacnccnnnnacnacccgcggcngaaggcccngccncccatcgccagggngacacngcngcggcngcgacagagccccagggccnncancccncccgcccccaggccggcccagcagggacaangaganngtagacagcgcctcagttccagaaacgccgctggacngcgaggtctccctgtggtcgtcctggggactgtgcggaggccactgtgggaggctcgggaccaagagcagaactcgctacgtccgggtccagcccgccaacaacgggagcccctgccccgagctcgaagaagaggcgtgagtgcggtccctgataactgncggtcgtaaaaccagaagccccgcagcccctggggccccccggagccatggggtgtcgggggctcctgtgcaggctcatgctgcaggcggccgagggcacaggggnttangcgctgctcctgaccgcggtgaggccgccccgaccatctctgcactgaagggccctctggtggccggcacgggcattgggaaacagcctcctcctttcccaaccttgcttcttaggggcccccgtgtcccgtctgctctcagcctcctcctcctgcaggatacaagtcataccccaaggtctcccagctacgtctaacatcatgtctccttataagttattgctgctccaggagattgtccttcatcgtccaggggccttggttcccacgtggttgcaagatacctcagacctggttgctctaggctgtgctgagcccactctcccgagggacgcatccaagcggtgggccacttgagaatgtgaatacactggggcggcattcggaaagcgtcaagtgtatcccatggtaatggatctctcagccgtactgaatacagacctatcttctgtggctcacaacaataacacacacaaccacaacaccaacaacaacacacc

SEQ ID NO: 594742 - DNA, 724 bp, Homo sapiens
tccgacccggggaaggtcgctgtggacaggtcagagttgggaagagcggtcagccccgcgcacgcaccgcagcagagcccattactcctccatttctcccacgtcctatctgcctctcgctggaggccaggccgtgaagcatcgaagacaggaggaactggagcctcattggccggcccggggacgccggacctcgggcttcaaataggagctccgtggctctggctgggacccgcaccgctgccggccgtgccagaccatctctgcactgaagggccctctggtggccggcacgggcattgggaaacagcctcctcctttcccaaccttgcttcttaggggcccccgtgtcccgtctgctctcagcctcctcctcctgcaggatacaagtcataccccaaggtctcccagctacgtctaacatcatgtctccttataagttattgctgctccaggagattgtccttcatcgtccaggggccttggttcccacgtggttgcaagatacctcagacctggttgctctaggctgtgctgagcccactctcccgagggacgcatccaagcggtgggccacttgagaatgtgaatacactggggcggcattcggaaagcgtcaagtgtatcccatggtaatggatctctcagccgtactgaatacagacctatcttctgtggctcacaacaataacacacacaaccacaacaccaacaacaacacacc

SEQ ID NO: 594743 - DNA, 395 bp, Homo sapiens
  misc_feature (10)..(10): n is a, c, g, or t
  misc_feature (22)..(22): n is a, c, g, or t
  misc_feature (57)..(57): n is a, c, g, or t
  misc_feature (72)..(72): n is a, c, g, or t
  misc_feature (91)..(91): n is a, c, g, or t
  misc_feature (122)..(122): n is a, c, g, or t
  misc_feature (366)..(367): n is a, c, g, or t
agaaatagcnagaaatgttggnccccttaattaaaaccccgggtggtttcccttaanacctattcctgtttnactttgccatatgttaagnaaatagttcctggcctgggtgtggtgccccnatgcttgtaatccccagcactttgggaggccgaagcaggtggatcatgaggtcaggagatcaagaccatccctggcccaacatggtgaaaccctgtgtctactaaaaatacaaaagttagctgggcgtggtggcatgtgcctgtaatcccagctactcaggaggctgaggcgggagaatcgcttgaagctgggaggcggaggttgcagtgagccgagatcacaccactgcactccagcctgggnnacagagcgagactgtctcaaaaaaaaaa

SEQ ID NO: 594744 - DNA, 194 bp, Homo sapiens
  misc_feature (36)..(36): n is a, c, g, or t
  misc_feature (113)..(113): n is a, c, g, or t
tgagtcttacccccgctggccaatggcaggacaatngcgagactacaccaagggttggatgggctgtctgagcgctgtgcccagtacaagaaggacggagctgacttcgccangtggcggttgtgtgctgaagattggggaacacacccctcaggcctcgcgatcatggaaaatgccaatgttctggcccgtta

SEQ ID NO: 594745 - DNA, 124 bp, Homo sapiens
  misc_feature (5)..(5): n is a, c, g, or t
  misc_feature (67)..(67): n is a, c, g, or t
agctngacagatcgcggtttgttaaaaaatggggacaaaccatacatgggggaaatcggcaggttcnataagggcaaggtgaaagaacgggacgcaggagaagaacaccctgcgcgaccaaagg

SEQ ID NO: 594746 - DNA, 188 bp, Homo sapiens
tccagatggcctgaagtaactgaagatccacaaaagaagtaaaaacagccttaactgatgacattccaccattgtgatttgttcctgccccaccctaactgatcaatgtactttgtaacctccccacacccctgctccccactgccgctgctgcctcaataaatctgctgataagctgccaaaaaaaa

SEQ ID NO: 594747 - DNA, 352 bp, Homo sapiens
  misc_feature (290)..(290): n is a, c, g, or t
ttttagagacagggtctttctctgttgcccaggttggagtgcagtgggttcaccagtttgcccaggttggtcttgaactcctggcctcaagcaatcctcccaccttggcctcccaaagtgctgggattacaggcatgagccaccgtgccaagccacgcctggctaattttttaaaattattttttgcagagacagagtttcactatgttgcccaggctggtcttgaactccttggcctcaagtgatcctcccacctcagcctcccaaagcattggggttacaggcgtganacctgcacctggccctgttttcatggcttttatttcctttcatcccacacatttgtcttgca

SEQ ID NO: 594748 - DNA, 275 bp, Homo sapiens
cccgaatacggactttcgagaaagccttacctgttagctaaggaggaggcctactcgggattggggtgatgtcgagccctggagtaaaggcctcccctgcgaacacaggacaggcctgctgacagggctgagtctagcttggcagagaccaagatatttgttcccgcgccactggggaatctgaggggtgatggaagagaagaaacctggagtgaaaggagcagagttgcaaattaacaactcgcaaatgaggcgcaaataaaatgcagatgagt

SEQ ID NO: 594749 - DNA, 268 bp, Homo sapiens
gtagttttctgactaagtaatagttatagtatgtgaggagaatatagttaaatggttaattttaatgagtataagtgattttatctttaattacacacagaatcccctctgttctgccccaaatagcacaattaacaggtatatatgtttagcttcaggtcagtgaacagaggttcttctctgggaggttattaccactagtttatgtcccccggtcgacgcggccgcgaatttaatagtagtagtcgtagtagtagtaggcggccgc

SEQ ID NO: 594750 - DNA, 955 bp, Homo sapiens
agcggacttcagattctcggagagaagaggcgggagtggacctggtcagccctaccccactgaccccaccggacccaggcgcgtgctccgccacagccatcagcccctgcaccctgcatgcggcgcggcgaggcgaggcgatggccaaggtgtcaggtgctgaacgtggcggtcctggagaacccgagccctttccacagctcccttccggttcgacgatcatgcttcgagtgcagtgaagccctggctggacgacctggacgtggaagatcatctactgttcggctcggctgacactgacgcgcctctgatcagatcctagactcggctgctggtgggccctgtgccagacagggagacacactgtctgatctttcaggccgacgcccccaagcgatccctcatcccagagacctgatgccgtgggtgtgactgtggtcctcatcacactgcacctacgcatggaccaggagttcatccgagtgggctacatacgtcaagaaccgagtacctcaaccctgagctgcgtgagaacccgcccatgaagcccgacttgctcccagcgtccagcggaaacatcattggactcggaaccccacgggtgaccccgcattcgatattccacactggccgacatacccaccaatgagacacgggactcgacacggcccatacgacgactccagagacaaccactccactgaggcctgacggcacttcccaaaagttccaaaacagtagcaacatcccgcaaatgcaaacggggcgctctgacgtgtgcataactcgttggagcactcggactcaccacttggaggccagtcgcgtgacccgtatgagcaatcacttagcacatggggacacactacgaattcttagaacttagcgaagggtgacatctcccacgaacgattggaccccaatacgcgactgcgcctgtgagaagatacgaagg

SEQ ID NO: 594751 - DNA, 996 bp, Homo sapiens
taccataaatagcaaatctttccattcaggagcacatggcagactcactgaaaagtgcatgacaataaatgctgatttatcgcatctgttctatattgaaattttattatttgggtttagtattttacagggtatttaaaaatgtatattgtctcttttgattcctttaagctccttgtgagaagctggatgaaagcacataaaaggataacaacacataaaaaattacagtgttttaaaaaatgaaaaatataatatgtatactgtcttagaaattctagaaagctcagaacttttgaggaaatgtgaattaattatggagattaagcagctctattttttcctgcagaacattttactatgggaagttagttgattatttataagacacttgtaaattgtcttatttgattaaaatttaatatgtttatcgtagagattttagaaattgtacaattataaataataaaatgcattccacgtttaatctgattatcaaaaataccattactaatatcagaaacattactattagtcttcctttggtacaaaaacttaaagttatgatgtgtcttgacatgtgctttgacatttgatactaaactatggacaggggaacatagggaggagaatcataagcccgaccgtcgcggccccaatattcagggaacccggtcccactacatgtaacgcgcccggaacaattcaacaaagagaggcccagggcgcacaccctgcacaaacccccgtgattggtacaagagcaaaccagagagcgaaccatacccacacaccaccaccgggcggcatcacagagcacacccacgcaggaacgatatagttagaccttcctgtctctctccgccgaacctgtcttaatgcctgccaccagccacagacggaccaaggctcaaacatccaccacgacaaacgacgacaacgacgcacgcagaacgcccgccacagccacacaaccccgccgaaccaccagcaaca

SEQ ID NO: 594752 - DNA, 1298 bp, Homo sapiens
ggtgacgggcgggcgcgggcgtcgcgagctgagggagtaaggaggctcccaggaaccggagctggtgacccggccgaggtccatccagatcccagagtagccagagtgaccccatcgaccgtgtcagtgcatgggggagatggagcaatcgtgtcgtctgggaagctggagctagcttcgaagaaagcaagattgctacgatgccaggaagagcctgtagctgactgtgactactggacagaggtaggtgtcttggccttacaggtgtgtgggacgacgtccactatgctgggacgtcggagcggaacagttcaaggtgcgaacacactgtgggcactaagaatttgactgctcaatggtcgcttggggtccaccttgaattcctacagcctgtcttgcgctaatgttgctctcggacaatgcatcggggcaacgcctgaatgcggtcgttggtgaatcaaggctaagagcgcatctcaagatcgaaacgagttggcatcgccgcataccgctagaattgttggcattcccttctcttagtgtgttccatttggacggcattgttggcccatattgccacgccaattttcagaggtggcaaactctatgtgcgagtgggtactgggttggaggcgacagagcgcttcaggcaactcagagcgattagtttggtttccactattgtcaactagaggcctgcaaatagttcgccccggtttgaagggggtcgaaaacttaggattcaacacaggggtccacaggagccagaggagaagaccccatatagacattggacattgcaaagagaaccaacgttggactaaatttccatcatttcgacattggctttgaccctggcgtgttacacgttgcgaatttggacccaggcccaacgtagttaagggttggacccccaatgagataccgaggagagagagaaatccagcccgaatcagggatgatttgccccctaagatttcggtagaaaccacaacttttgcagcgaacccgttgggtgcggtccaatggtcaacgagtaaaacaggcaaccgttgtggcgaaacttacactgagcgttggcgtcggaaccaatcaacgagggagtgttagacactttgtcacattggcacggcccacggtgtaggtctggattgtattcattccccattgtagcatttccccaaatatctttgcattctccgaatttatctaccgagtgtgcggaccccatggattagcacgatgagcacaaggttggacacaataagtgtatcgaatgcgacggaaccatgcttagg

SEQ ID NO: 594753 - DNA, 195 bp, Homo sapiens
tctaaaccagtcacttgtacccctgataagtggtgattgacaggcgcccccatggtgagatcttgtggcctggacaggcgaccagtggtcctcagtgcagctgtcagtatgttctaacttgtgcagcattgtgctttttacgatagccggacaggagtcatattctggggccttggcactcgatcctggattgtt

SEQ ID NO: 594754 - DNA, 2175 bp, Homo sapiens
acagtctccactgaaaggctaaatgggaggatcttcccccgtgacctcaaaagctattgtggatgctgatggaagaatttatattcggaactggcagggtggcatcctgtctgggggctttgagaagaacccgaaaccaattttcactgagggcaagaaccagctggagattcagaatctacaggaagactgggatcactttgagcctctgttgagttcccttctgaggaggatgccagaattagagactctggagatcatgaagttggtgaactgcccagagaccttcacaccagacatgaggtgcatcatgggcgagtctcctgcagtgcagggctactttgtcctggcaggaatgaactctgctggcctttcatttggtggaggagccggaaagtaccttgccgaatggatggtacatggttatccctcagaaaacgtttgggaattggacctgaaacgttttggagccctccagagcagccgcacctttctgcgccaccgggccatagaagtcatgcctttgatgtatgatctgaaggttccccgctgggacttccagaccggtaggcagttacgcacctctcctctctacgaccggctggatgcacagggagccaggtggatggagaaacatggatttgagaggccaaagtactttgttccccccgacaaggacctcctggcattggagcagagcaagactttctataagccagattggtttgacatcgtggagtctgaagtcaagtgctgtaaggaagctgtgtgtgtcattgacatgtcctctttcacaaagtttgagataacatccactggggatcaggcattagaagttctacagtacctcttctccagtgacctggatgtgcctgtgggccacattgtgcatactggcatgctcaacgagggtggagggtatgaaaatgactgcagcatagcacgactgaacaagcgcagtttcttcatgatctctccaaccgaccagcaggtccactgttgggcctggcttaagaaacacatgccgaaagacagcaacctgctcctggaggacgtcacctggaagtacacagccctcaatctgattggccctcgagctgtggatgtgctgtctgagttgtcctatgcccctatgactccagaccacttcccaagcctcttttgcaaggagatgagcgtgggctatgcaaaggggatccgggtgatgagcatgacgcacacaggagagccaggattcatgctctacatccccatagagggcatggatttcattggtcgcgatgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttccttgcccttccacctcctcctcctaatattcactctgggctcttcttcccttcccacccctcactcagctgctcgtggtggcaggaggtatgtctgacaggacagaagcaagctccccatcatcttgtcctagagtgggcgtcaccttggagcttctcttccttccgcctctgttcctcttctggagcctttgcctcccatctcttatctccttgatataattttgaacttgacctactttaaacttttttgctctgctgtgctgtgggctggcactcgatacctctggcaagaggatgatcatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaagg

SEQ ID NO: 594755 - DNA, 777 bp, Homo sapiens
  misc_feature (503)..(503): n is a, c, g, or t
  misc_feature (510)..(510): n is a, c, g, or t
  misc_feature (566)..(566): n is a, c, g, or t
  misc_feature (589)..(589): n is a, c, g, or t
  misc_feature (618)..(618): n is a, c, g, or t
  misc_feature (636)..(636): n is a, c, g, or t
  misc_feature (659)..(659): n is a, c, g, or t
  misc_feature (684)..(684): n is a, c, g, or t
  misc_feature (686)..(686): n is a, c, g, or t
  misc_feature (689)..(689): n is a, c, g, or t
  misc_feature (702)..(702): n is a, c, g, or t
agcgggatgccccgcaggcctggactgatccaccaggagaacttcagtgcatcatgggtcctgctattgctcatcctcttccctggaaatgtgcggtttcacaggatggtaaacatctttccctggaacagagccttgaggatgctatggtgcagtatgatgaccaccatcccagtctgccaaggaatgagtaacttcctgcaatttaggactttcggccctaaaaccagtacagtcctggacacactaagattgttggtcaccctagaagaatggagatctggcggctaccactcacatatactcgtagaacattgattgcaaggtaacttactggctgaagcaggtgatgcattgcttcggtggggctgatgtcgaaaaccttcagcttcccaagacaacactgatcaggcctccaggagcatttctcctgctcagtgtcacagtgccactgcagagcgcaattcctggggcacgtcggacattcagtaaatacgtttatngaatgantaaaacataacacagtaagtaattcatcttaaagtcaaccatttacattacttttnatccctgaatacccttcctctanctgtcaattcagcagtccaagggaaaaancagcttggtcaacattanatctggagctcccacatcatatnttcatagaactaaactaagacatantntanagagaaaatgttncactcctcacgtgacatgttctcttggactggctttccccttcattccatatctctaagtcagttatcctttgag

SEQ ID NO: 594756 - DNA, 212 bp, Homo sapiens
  misc_feature (205)..(205): n is a, c, g, or t
aaagtatggggaaatcacagttttcagacatgagtaatcaaaaacttgacatttttcttgatatccaaatctagatgtctgtatcaaaccagaggtgatggccttggggatggcagtgaagactgttaggaccattagatcagattgttctgaaatagaaatacaggagtggggccctggggcaccgcttaggccagaaggtcanattatta

SEQ ID NO: 594757 - DNA, 490 bp, Homo sapiens
  misc_feature (427)..(427): n is a, c, g, or t
cacgaggcctcgtgccgacgacttcttcaccggcacgcgcgcggccatctgcggcggcacgacaacggtgatcccgtttgcggcgcaggagaagggcggctcgctgaaagcggcggtggccgactaccaccgccgtgccgagggccgggcggtagccgactatggcttccatctgatcgtggccgaccccactcccgaggtgctcaagcacgaactgccggagctgatccaccagggctacacctcgttcaaggtctacatgacgtatgacgacctgaagctgtccgaccgcgaaatgctggacgtgcttgacgtggccaagcaaaacaacgcgctggtgatggtgcatgcggaaaacgccgactgcatttcgtggctgacggagaagctggtgggcgaaggccgcatctcgccgcgcttccacggnctctcgcgcccggctgctgtcgagcgtgaagccacgcaccgcgccatcacctttgccgagctg

SEQ ID NO: 594758 - DNA, 530 bp, Homo sapiens
tgctcgccactgaaccaccaagtgactgctggtttgagtggcctaacccattacggctcaggccctgacagggtgtgtgtgcaccacttcggggtgtgaaagcatgaacagctgcagaacgcgtgagttttctgatgctggctgccgctgccttccggattagggcctgtaacggggagccagacacacaggaccacatgtgcttctgggtaagctggcccatcatagtgggggacataaggtatgggggggcacatacacacttggtatgaacactttggttgtaccgcaatcttacagcacggctgagaggagtggggctttctgtccttgaccgctggattcacataagcaccagtagaggacctggggacttacacactcactgcaggggccttccacttgtgggatctcatggacaaaagggactggttctatatccacggctctatggttctcacccccccaggagtacaaagtgggcccccccagactctgggtacgaactcagcatgcgcaagcacttggag

SEQ ID NO: 594759 - DNA, 946 bp, Homo sapiens
aagcagtggtatcaatgcagagtgcccattacagtcgggtgcctcatcgttcaggtgtcagcagtgacctggagacagtgaatcgacaatgccgtcttctgtctcgtggggcttcctcctgctgtgaggcctgtgtctgacctggtctcctgtactcccctggtctgagagatcctcgcgaggaaatgatggctgtcgccagaatgacagatatctatacctcactcagtgatacatggatgcaaccaataaccttcaaacaagattcaaccttgaaacgctggtctgagattacgactcttcagtccttataccgtcatacatgaactacacacaagggttctcgagaacaaagtcgaccaaagtaaattcttttcttattctacgctccgagatggatgtcggggtcggacattaactagcctcgtgtatgcaagatggcttcgtacctctggggtgacccaaagggccttgaccacttccactcggagtgagcctcccgtgggagggggtcttgtacatcttacaaggacctgcaccggacgcagttcccgtggaggggactccagagaaattccatgaacagggcttattcgaggggagagcatcctgtccggataaaccccatcagaatcaaggtcatgaacatggccagggttcacagacgtgatgccaacccggcgtggaattagagccttgataactcgtcgtacatgacgtgagcacttgaacgcctcagtttgggaatgacatgtttatatcgggacgagaatgctgattagaacgttgtgtaccaaaccttccgaggaatggccgttgcgacggtgactaatctttcggaggggcactagccggataagatgggccaaatgaaaacaagaatcagacggattaatcgttggagaaatggttactcaagggggaatagattggggaattgggccag

SEQ ID NO: 594760 - DNA, 1360 bp, Homo sapiens
tctgaaatggattctcgctctgtcaccaggctggagttgcagtgggcgcgactctcggcacaccttccgcctctcccgggttttaagcgattcttcgtgcttcagcctcccgagttaaaaggcagtgcattcaccacacctgtggtttaatttgtgtaggtttaagataagagagtggggctctcaccagtgtttggccaaactgtggctcttcagaacctcctgtgaccctcaggtgtgatctccgcctgtgtctctcaggcctctctccaagttgcgtgggatttacagggcatttcagccactatattcgcccggctgtggggactcaatatgtgtttccaccacatgtgtgtttgtgttctcacatatatacgcccatgtgtgtaactgtgtcgaaaccccaccgctatatccatgtgacatatattctacaatgagctctctctctccctgttgtatacgcccgtgtggtgtggacaaatatgctgtatatgtggtttatacggcccagaacgctcttctttctccacgccatatataaggctcttcctgttgtcgcccaccaaagaacccccccctctcagctgtgggtctcccctatgaaaagaggtgtctcctggtgtgctctgatgtgtgtgttctataaacacccccatgagaggggacggtgtctcctctattctcccacagagagttccgttgtccggtgagaaatgtgtgtcgtataaccccttttgcccgaggtgctgttgttgtacacaacccccatgttatagacgacaaaggacaaaacatcttcacaagagttgtgtctctccccttttgtggcccacacaaatgttgtgcccaaaccagaccagagcataaaacccaacacgagcacacgacacaaacaaacatcccctgcgggagaggaggacacatcctctgatgatatgagctgtagagcggtggtggtcgctgccggcggaaaacacaccaccgaggctgaggctgagctacatacagacacgaaccaagtgtgggcgccacacacaccagttggttgtggcttactaactgatcgacgagctggttgagttcttccacagctggttgcagcagcacccaccagacgttaggttagttacgctccttttgtgtgtatgtacacaccacagacatgaggtgtggtgtgcaagaacaacatctcatttcttagggcccgtggggtattcctcactccccccatatctataatgaggagcgcgacggacctgcagatataatctactaagtcttcttagtggagtacaattatacaagccccgaatgggtttttacacgcccctgtcggagactttatataatgagcacg

SEQ ID NO: 594761 - DNA, 139 bp, Homo sapiens
ccggcgcaggagcgagcgccgctttccaagtttggagactagactgaaacttttttgggggagggggcaaaggagctggagatccaagaagttggggtgcgggtctggggactctggaaagcttggtttggggtcagga

SEQ ID NO: 594762 - DNA, 267 bp, Homo sapiens
  misc_feature (29)..(29): n is a, c, g, or t
  misc_feature (94)..(94): n is a, c, g, or t
  misc_feature (159)..(159): n is a, c, g, or t
ggtgggggacgtgtcgcgcggccgggtgnttcgggtcggtaccctgggcgcggaagcttgcctcattagtattcgtacccacgaggcggcgcangggccctcggggacagcgagcgtcgggccatggcttatcactcgggctacggagcccacggtcanaggcacagggcccgggcagccccggattccccctcccctctttcgatgacacaagcggtggtttttttccagccagcccgggggataaccagccacagggagcagact

SEQ ID NO: 594763 - DNA, 540 bp, Homo sapiens
  misc_feature (17)..(17): n is a, c, g, or t
  misc_feature (113)..(113): n is a, c, g, or t
  misc_feature (260)..(260): n is a, c, g, or t
taatgttgatagcagantagggtggactatagttaaccatgtattgtctatttcagaatagctggaagacttaaaatgttccttaccacatagaaatgataaatactcaaggngatggataccctaaataccctcacttgaacattacattccgtgcaggtaacaaaatatcacatgtacccacgtaaatatgtacaaatattatgtatctaaaaaaattttttaggccaggcacagtgtcacgcctgtagtcccagcantttggggggccgaggcgggcagattgcgaggtcaggagttggagaccagcctggccagcatggtgaagccctgtctctactggaagtacagaaaaattagccgggcgtggtggcgcacgcctgtaatcctagctactcgggaggctgaggcaggggaattgcttgagcctcccgagtagctaggattaacagcgtgcgccctggaggcggaggttgcagtgagctgagatcggacaactatactccagcctgggcaatagagtgggactccatctcagga

SEQ ID NO: 594764 - DNA, 515 bp, Homo sapiens
agaggaagattttgccaatcagctgaaacaatacaggcaagctaaagaaacctcaaatattgctttagggtcatcattttctaaagaatcaggaaaaaaacagagaatgaaaggagttcagcaaggtattgaacagagagttaaaagttttaatgttggtcgtggacgtggcttgccgaagaaaatcaaacgaaaagaacgtgggggaagaaccaataaagggcctaatgtgttttcagtatcggatgactttcaagagggacctaagaatttatgtataaggaggggaggagctttttcatcttttaatttatttgatggcaaagaaagcattgtgattttaatgatacttctctagtaaatgaaaaattaccagctcagataaaatgagtatcaataacctccaaaaaatagttgttaattagttgtgaaactaatttacagattttgctgactttgaaataaaattgttatgtttgaaagaacctcaaaataaaattgctaagtttaaaagc

SEQ ID NO: 594765 - DNA, 943 bp, Homo sapiens
gcacggggagttatgcatccgctcagtgccatccctagtatgctgtaactagctgccatttcccctcctccttctctactcgaatgacacatacggagtgcctgatgtacctgtactcgccctcgctgtctcccccaccaccctacttgacatcgtgggcatcttcaggcacagtcttgggagtgcctggtgtgctctgacaatcaatgaccatcacaattcataaactcactccaaatcccgaaacctccgcgtttccgcagagacacataaacgccagcatcaggtaccatgaaggcaacgtatgtcctctcgttctaagcagccctctctgcactgttaccgccgctcccatcggggacacagacgggtaggaaatggttggcgttcgacatccactaggtgttatcaggcagaggggttgtcgactagtgacagtctctctcagtggcagtatagcgccccgaatgttacagagtgttagagagcatgggagactccttgtggtctccgccagttgaacttttgggctctttgggccggagataactcgtagttgtgcccaggttctggagcgcaaatggtgcgagttgggagcgctgatgcagactctctgcctccgtgagtacagggtgagatcgtcttcctctgcagacatcccgctctttgggagtgtcacgggtgtggtgccagcgcaatcgtgggttcgttggggcgtccttgggagcctacagattgtgcgggtttcaccgatgtcgttctcgtaaaattctgcatggtctttatcggtcgggtgatccaaccggtccctgtggcactgcaggaccgctggggattgcggcttgcatgcccttgtgctccccctggttcccgttgcgattttttgcgctttcaaagaccccccgttgcgcctactgcgggagggggggcggcccccccctac

SEQ ID NO: 594766 - DNA, 246 bp, Homo sapiens
gcagtcccccatgagaaccctgaccaggtcccactgtgctgtcaaggactttctgggactaatactgggggttttgttatagttttatgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccacggtgctataacg

SEQ ID NO: 594767 - DNA, 219 bp, Homo sapiens
ggtcgaccttgcccattaagagaggtctatctacatccctctttcccagatgtcttggttaccaattttccagtcatgtaccttccaattccctgaccatccagccaaaccattggctacagcccatgaatcagtatataatcacgtgtctggctatttctccttccaaccaaagtgcacaaccatatgctctgtccagacttctgcccatggggaaga

SEQ ID NO: 594768 - DNA, 365 bp, Homo sapiens
agtgttattggaacctttcgcgctattggtgataagtctcgctcttattcttatctctatactttgtggaacagcatgtagacaaggaggcttgattcagctgccacatattttactatatatggcataatagctatagatatactatatggacatctgatgctttatatacagtttatatatgcatatgattctgaggtcaccatgaatgctggcatgaatacaatagagatgtttcatggatatgatactgtgtatgaagctcgtgacgataatggggatttgcacatattatggacttgtgaacctaatcattgagttactgatagcctcgtaattattgtcgtttggagagatattgattc

SEQ ID NO: 594769 - DNA, 307 bp, Homo sapiens
  misc_feature (147)..(147): n is a, c, g, or t
cacgatgacatgagcaggagaacatcccttctttccatcctctgcccaacttagcaagcagtccctctctccgaccagccactctgcgagtgtggtctcttactgatccccacatccctcgcacagcctgaaaggctgatttccatntttctatcagccaaccttaaaatccaggttgaaaatttccccctttaaagaacagtggggccctgtgtaacccttgggggattccttcttagccggggatcctcttagaagttcaaaccttgcagggcattgcaaagctttgggcacctgcccgtcgttt

SEQ ID NO: 594770 - DNA, 204 bp, Homo sapiens
agagtagcgatctcacctaaaatagagaatatacatgggagtacagcatagcaaacattctacctactgtgtcagatacgatctagttcgggtacgatagtgtcatccagggtataacagttacacagattttggttttgttaggagcacaaaatagtgtaaattattacactgtagctatctctatgcacatcatgtgaccac

SEQ ID NO: 594771 - DNA, 721 bp, Homo sapiens
gcttccccactggtgcggcaccctcgactggtggtctaccctaccctcatggatgccctgtcttgctgcccaattgaggccccccgtggtcgccctggccagagctggccccgatgcatgacacctggccatgccttcctcgccaatgcccccagccctgctcctgtgtgctggagccctgcctcctcccccagcaatggtgctcgtgagccccggcccctagtgcctcctgtctctgtgccactgccaccatctgccctgcacccctgcgaagaacctcgcacctcaccacgccagcccgggaccctgcctggctgccacctgcctctgtgcctcggacccagcacctggtgaaaagactcaaagtaaaccctttaccatccagtgaactggaactcctgttctactgggttaccacggcagcagctacatgccccagaatggggttggagccctgtcaagccctgttgatgctcacccagtctagacccactgacaaagtgtggctccccaatgcacctggaaagtgctcgacaatgatgccacctaggtggggggtgcttgcggcccaatgcagccatgggccccgtgaatgctttggcgggatgtgccgaccacctcccacatcctgcggtctgttgcctgagagcctgtcctctgtacagcccgctgctccagaccgcccaggagtcaatggtaccagcgggttgtccctggccca

SEQ ID NO: 594772 - DNA, 578 bp, Homo sapiens
ggatcggctcacgcagcttcagtgacgctgtgaattcgcttgcaggctcagtatttgtaatgccattggagtattgcagcaatgtggtcctcctgcctctttcaataatattcagacagcaattaacaaagaccagccagctaaccctacagaaagagtatgcccagctattttggcagcactgattgcacgaacagcaaaagacattgatagtaaggatagattccttaacccagttgaaggacatctaacaagcttgcctattacagggcctgcctagctttgctataagctagcacagaagaaaaccatgaacagctgctaccattgtctgaacggaactgtagattaactcagaaggaacggacccattgccttacttgggacgacagattacaaaagcgcactttgcctgactacttgcacagtacacagctgaaagacaagaagtggtaacccatagccagtctcttccagactcatagcatcagtggataccatgtggctgagaaaaagacctgtttgagtgccattaagaattctgcatcagacttagatacaagccttaccaacaattc

SEQ ID NO: 594773 - DNA, 110 bp, Homo sapiens
  misc_feature (82)..(82): n is a, c, g, or t
ccgcgggacacttacccttgttgttgccctagaccaccggcaggtaccgtgccggcttttctgccttaattaaaaaaggccnttaatctgttggttacttacccctgtgg

SEQ ID NO: 594774 - DNA, 897 bp, Homo sapiens
cgcctcctctcgccgctgcgccaggccccacccccgggacgggtcgcgctctccgtccggccgctccccctcgcgggcagctcgcgaccgctgaatgagcccgttgttctctggagactcgcaggcgttttatcaagtgacgaggacgccggccccgcccctccccaccctctcgcccctccttgacgcgccctgcgagccggagcaccgcccgcaccattacccgccggctctggacgtaatccagctgcccggtacctgcccggaagccacgacgtgggagccccggaggcgagctcgcggcgaagcagcccactgcgccgccctcctgtggacagaattgtggttgccgagtagcacagagcgagggagactttactacccgttataaagagaagtgcaggtgatagcaccggggcctcatggactgagcaagcttgttacttgcaagatggtgggaccaagtggcagactgcatacggtacatttacagttcatattactacaggtgttaaaatggagacgcttaaagggcgtgcacacaaaaattgaggggaactacaaggattgtgactaagactagttactgagtacattcaaaggacctaaaagacgtcaaaaaaatgaatcacaagtggcacacagactttgaataggtgagtgatataactggtacaacataccacagaaccaatttacagttcaaagttcgactcctataaagacgatgcgtagtgaagtgtaagggaggttgagagatgaatatagaagagatcaaaaaaaacggaaaagtttacaggggttggatgcccgaggattagagctagggagtatgtggcccaaggttgacagagggagaagcatgtgggcagaacagttcaagacgtgtcaagggat

SEQ ID NO: 594775 - DNA, 901 bp, Homo sapiens
  misc_feature (857)..(857): n is a, c, g, or t
gcgcttgctgtccagactatggaaatgatgttagacaaaaagcaaattcgagcaattttcttattcaagttcacaatgggtcataaagcagcggagacaactcacaacatcagcaacacatttggcccaggaactgctaatgaacgcacagtgcagtggtggttcaagaagtttcacaaaaggagaggagagccttgaagatgaggacgcatagtggccagccatcggaagttgacagtgaccaattgagagcaatcatcgaaggctgatcctcttataactacacctgaagttgctgaagaactcaacattgaccattctacagtcgtctcggcatttgaagcaacattggacacaggtgacaaagcttggtaagtgggtgccttggtgaactaagcgaaaaacaaaaaaatcgtcgtcttgaagtgtcatcttctcttattctacgcaacaacagtgaaccatttctcgatcagattgtgatgtgccatgacaagtggttttatacgacagccagtgacagccagctcaagtggtttggcccagtgacggccccaaagctttcccagagccaaatcttgccccaaatacggccctggtcactggttggggggtctgctgtggtctgtccctacatgttttgatcctgggaacccttctcttggaattggtccgtatctcgttggatgcccaaactacaatctggcgtggcttgcacagaaaggccactcctttcccgaggtgcccccacttgcaccgcctgggaattgcatgggtcgagttgccccccatccggctctccgcattctctctgtattctgacccccgggactctctgcccgtgttgggctttgcanaaagcgctcggtgtgtatgtgcacatctgttctagcttctcttg

SEQ ID NO: 594776 - DNA, 102 bp, Homo sapiens
  misc_feature (9)..(9): n is a, c, g, or t
  misc_feature (54)..(54): n is a, c, g, or t
aattcaagncttctaacgaatgtacggggacaatgggatttgggcctttttganttaaattcctggctcccctgcaaataaagcctttttacacaaaaaaaa

SEQ ID NO: 594777 - DNA, 720 bp, Homo sapiens
  misc_feature (243)..(243): n is a, c, g, or t
  misc_feature (295)..(295): n is a, c, g, or t
gagtttttttttgttttttatttcaaagtgaaaaatctttattaacaacgggtttcaacgaaaaagcaaatgaatacccctaaaaactatggacagctatctcccccagcagcaggcagggaaagggaggcaggaggggtataaccctatagggtgtgtttccctataggaaaagggccgaggtttccctctcttatctccagcctgtgggggccaccgagaagcgcgcctctcattctcagnggaaagtctccaggagtggcagcgtgagaggacagcgagtgttttagacagncacaaagccccgaggcgctatagtgtggatatagaacggggtctccaaatatgtgtgtgtacccttctcataggctgtggttattcaccatgtggggggcgttacagtgggcgtgaggattctcgtgcaaatataggaacattcaccagcggacaaaagagtggaccagctttgaaaggcttacttcattcatttgtggctttcggtgttcctctcgcgagcctccgaagaagtttggcaaaggctttgatttgaaaggagaggcaggttaaacaggcgagcccccaaggcaacaccacactttacagctttaagcacattgagggcgcgcaaatggctgtgaaaatttcagtgccacaggaagaggttctcatgtgtggctcgcgaggcgctcgggggtcgctccaagggggccggggttaact

SEQ ID NO: 594778 - DNA, 263 bp, Homo sapiens
  misc_feature (194)..(194): n is a, c, g, or t
tgggaacatcgcttgagctcaggattttagaccagcctgggcaacatagtgagacctcatctctacaaaaaatttaaaaattagctgggcatggttggcacacacttgttgtcccagctactcagtaagctgaggtgggagaatcgcttgagcccagaaggtcgaggctgcagtgagcttgtcatcactccagnctgggtgatagtgggagaccctgtctcaaaaaataagacacggaaagaatttgggttcctctgggttta

SEQ ID NO: 594779 - DNA, 139 bp, Homo sapiens
agacgatgaagtcgggtattcacaccctagatataaagataccccgtggtcctcccccatcaaggtgaaggtatggggatgtgtactgcagggcccctaagggaggatactacaaaacagccctgggaccaggtcgaca

SEQ ID NO: 594780 - DNA, 108 bp, Homo sapiens
  misc_feature (37)..(37): n is a, c, g, or t
  misc_feature (83)..(83): n is a, c, g, or t
tttacaatataacaacatgtattttcattagatattnattataaaccaataatgcatgtaaactgaatacaatacttcaaatnattctgcacaaagatattacagatc

SEQ ID NO: 594781 - DNA, 414 bp, Homo sapiens
ggtggggggccattgggcggcccaaacttggttggaactcgggcgcttggtttggtttttcttcggaacccatgtccgacaaacccgatatggttgaaatcgagaaattcgataggtcgaacctgagaaggccggagccgcaggagaaaaatccatggctttccaaggaaccgatggaccaggaaaggcaggcagccgaatcgaatggaggcgtgcgcggccattatgcacggaccattcaacaggcatggccttctaatttaacttctttaagcggttaaactttgaaggaggcaagggggttgaaccaggttgcttgcctttccaatcggccaatcaatctgcttgccaggaaaggaaggacctggcttgttgttgaaggaagaagtgggttgaaagaagtgggttggacca

SEQ ID NO: 594782 - DNA, 127 bp, Homo sapiens
caccccggacagagacgtgaagcactgaataaatagatcagaatgactgaaaaagccccagagccacatgtggaggaggatgacgatgatgagctggacagcaagctcaattataagcctccaccac

SEQ ID NO: 594783 - DNA, 290 bp, Homo sapiens
ggcgcccgtgtagcgcgcgtccttctcccggtagagcaggttgtaggcgcagccgggcatcaggcgaccgtcgggcatcgcgtagtgcgtgcagcacttcttgatgcggtcgacctcgaacgtgttcacgtccatgaacgcgtggatgaacacggtcttcaccaggctctcgccgatgtggaggcgctcctcgagcgcgagcgccttgtcctccggatacatgaggaagatcgccttgcgcagcgccgcggggatcttcttcgcatcgggcacctgccccgcgctcgtcc

SEQ ID NO: 594784 - DNA, 777 bp, Homo sapiens
  misc_feature (32)..(32): n is a, c, g, or t
tatatgattcaggtaaaaaatcagtctagttntgcaggtcacaatgttgctgcaattggagtagggaaaggtaactgcgtcgctagtagaatgataggaatggtggtttatagaacagtcactagtctagatgacaaaagaacttcagttctccttagagaagttaggggtaaagaatatctctggtattgaggaggtgaattatttgtacaagatccagggaacagtgatccacttttataagcctaaagttcaggcatctctggcagtcgaagactttcatcattacaggccatgctgagacatcgcagctgagcagacaatgctgacccccagtcatcttgaaatccaggcttggtgacggatagtctgatctagtttaatggagacatggtacgtggtctcgtgcacaaaacaatctgtggatggaaaagcagcaattgctataggagaggatgatgatgatgaagttccatgatcttgtggacgaattttgatgaggcttccaagaatgaggcaaactgaattgagtcaacttctgaagataaacctgaagaagttactgggagctgctattttatattatgactgctttttaagaaattttgtttatggatctgataaaatctagatctctaatatttttaagcccaagccccttggacactgcagctcttttcagtttttgcttatacacaattcattctttgcagctcatttaagccgaagaagcctgggaatcaagtttgacacaaaagattaactaaagttctttgc

SEQ ID NO: 594785 - DNA, 268 bp, Homo sapiens
atcccgagtcacggcttagtacaacctccgacgtcccagcgtcaagtgattctcctacctcagcctcctgagtagctgggattacaagcacctgccaccacacccggctaattttttgtatttttagtagagatggggtttcatcatgttggccaggctggtctcgaactcctgacctcaggcgatccacccacttcccaaagtgcagggattacaggtgtgagccaccacgcccggcctctcaacctatcaacctggtcgacagtct

SEQ ID NO: 594786 - DNA, 942 bp, Homo sapiens
agcgggagctcgtttgcttgaggaaaagaaaaagcttgaaggaagaagtcagtaagttgcgtagtagcagtttggtatccttcaccatatgtagctacagcccccagaactttagtggatgcttgtgcagcctgaactcccaggtgaatcagatagatccgctgtggaaagagcagatgaaggaagagtggattcagacaagtggagacaagcatgatgtctagtacaagaaaatattcatatgttgtctgaagaagaacagcggataatggctggttagaacgaacatgcgaattgaatagaacgaagaaatataacagcggttaaagtacaaggactgagttgtctcagagcatgtctgcagtatcttgaaggcattctgaagaagatagctatcagagattttcaggtgggagattcaggtgctcagtcactcctagaggaagcgccatgacaattatgtgttatgatactgtatagtcgctacgttctatattttctacattcagagtcgtctacctgtccggtggatctcaaaccaggttcaggtgcatcgtagaagaccctgggtacttggagaagtcgtggaagagaatgctgtcacagtccaaatatgaacatgatagatctcaaacgttcccttgggcgaccacaggttgacaggagtgacagccgggaatgatgcaagtaaggaaagtgttaccgtgtgggcgccaattcactgcctgccagtgcgattttggcccgaattggccgcacgtggtaattgagtactgccagagaaaagacaggcccttttttggtgcacaaagctagggggagaataactaaccgcgcccgcgtctttacagcgacagtgggagaataaataccccaaccgcgcggataaagggcaggtcggggttcccgcacccaaatccacatatgtctacggaccgcggg

SEQ ID NO: 594787 - DNA, 630 bp, Homo sapiens
  misc_feature (217)..(217): n is a, c, g, or t
atattaagtctcagtacacttcctgtgccatgttattcagctcactggtttacaaatataggttgtcttgtggttctaggagcccactgtaacaatattgggcagcctttttttttttttttataatggcaacaatggcaaaagccaagaaagtataaggggtccacaagtcctaaacaatggaattcttcaacagggaaaacgagctagctggaanaactggtctgaaaaacacaactggtggtctatgggcatttagtaccttcaaataatgggcttggcagatatgggataccccagttaaattctggcacagtctcaaatttttcatctcttcaatcactagtcaagaaaatattatcaaaaacaacaaatacttccatatgggacgcattttctcaggagtttcctaaacccagtcttattttcctagtcagtaaactattcggtgaacaatatcacggtttccactaaatcacttcacggtgtcacctggtcttggcagcagcacaagcgaacaatattctgcacgagacctcatgcgttcggggcgcaagtccaagtggacctcttccaatatatctattactaaacttcttccactttgtccaaaacattggaaatcattca

SEQ ID NO: 594788 - DNA, 215 bp, Homo sapiens
gaggagcacggctactgctgctctatgcacagcagtcggaccaatgctgtgcagcgcattccggcttggcgccatgctcatgcagagcttccatgacatcattatggactctttcggatgcaacatgcaagggactcatgaaatcagtatttagattcattagacatgagctagttcgataagtaacagatctgacacttgcatacagtcgggat

SEQ ID NO: 594789 - DNA, 343 bp, Homo sapiens
  misc_feature (253)..(253): n is a, c, g, or t
ttcccagccatgctttgcaagatgggctttgcggtacatactagtgaactatcgtgaatccacgggctttggccaggacagcatcctcaccctcccaggcaatgtgggacaccaggatgagaaggatgtccagtttgcagtggaacaaggagcaccaggaggaacacattgatgcaagccatgtggaccttatgggtggatcccatggtggcatcaataccagccacatgattggtcagtaaccagagacctncagggcctgagtggcacgagaacccgtgataaacatagccaccatgtagggcaccactgacatccctgactggtaagaggtggaggctgg

SEQ ID NO: 594790 - DNA, 724 bp, Homo sapiens
gagggtctgggacctcagtgacattgacaaggatgggcacttggatcgagatgagttcgctgtggccatgcacttggtgtaccgagccctggagaaggagcccgggccctcgctgcccgtctcatcacctccagagaagagagtgtgtcctgggccgtcccgtctgctgcagcctccacaaagaagctcgtcagccgtcccacggaggtcagagctcaaagaaggagctgtccccaagaagctcaagcgaaaagcaaagtgaactgggtggtgccgtggagacagatgcgatttgatgagatatcctgaagactgactggactggatggctacgtgagtggccaggaggtgaaggagatcttcatgcactcgggcctcagccagaaccttctagcacacatatgggccctggccgatacgaggcaaacggggaagttaagcaaagaccaattcgcgtagctatgtatttcattcagaagaaggtcagtaaaggcatcgacctcctcaagtcctctcgccggacatggtcccgcttcggagagaggcacgcccggccggacagttcaggctctctcggctccgggagagttacatggcgtgaaggagcttgatgacatcagtcaacgagattgcccagtacaaagagagaactatcactggaaaaagcattcgagaaaaggaagaggatccaacagaaaacaggaggtgaggaattacacaatga

SEQ ID NO: 594791 - DNA, 386 bp, Homo sapiens
tttatagcctcccatggccctctgtagtctcttctaggggtgggatttccttataggggtgcagagccacttgtaccaacagctgtatggcaagaattaagactcaggctggtgcggtggctcacgcctgtaatcccagcactttgggaggttgaggcaggtggatcacctgaggtcaggagttcgacaccagcctggccaatatagtgaaaccctgtctctagtaaaaatacaattagctgggcgtggtggcgggtgcctgtaatccagctactccggaggctgaggcaggagaatcgcttgaacctgggagacagaggttatggtgagtcgagattgcaacattgcactccatcctgggggcaacaagagtgaaactccatctc

SEQ ID NO: 594792 - DNA, 144 bp, Homo sapiens
tgctgcacttcctaatccccattccagggcaatccacatgccatgatgtccagaggcattaacaagggagacacacaggggctcctcacgtttgctttccgcggttttgatgaaaatctcactttcctcatctcatacaatgtg

SEQ ID NO: 594793 - DNA, 283 bp, Homo sapiens
tccaagccaaaagaaaaaagagggaaaaaaggccaaaaattttgtgaaaaaaaaaaaaccactttatatattttgggttaaaatttgggattttttttaaaggattttttgggctgtgaacattttttgccaaagaccatgatgtatgtttgtatgttttaggtattgtaaaaatttaaaaagtaaacaagggtgttttgttatgcccccctggaccaggaatgctgccgcatttccctggggataacagtatttttatttaaaaaaaataatttaaagtgga

SEQ ID NO: 594794 - DNA, 849 bp, Homo sapiens
  misc_feature (765)..(765): n is a, c, g, or t
ataaagttagtactgcatgttagattttagtttgcaagcatgttgtttatctatacttgatatattctgaacaaacaagcatgcttgccaatatatcacagtatagtaacataaggtacataacagtttaagcaaggacaggcaatcatcttattcttctgtagttctaagacaaaccacttgttgagtgcctgctatgtgacacggcatgggcccatatgtgtgaggagcttgcttctaagtccatgtaggaagctaattgagatctcggatcagttacagtattgggcagtatacttaccgttcttgaatgaaagaacattcatcgagtacactctacaagtactcagagctgaattatcctcagggtgagccttctgtgagaatttgcaggtttctgggcaaactagcacgataggaggcatttgagttataaaataaagacctcctgtcttgcagtaaccttgctgatttcctcttcacttggaaacccccttcctgaaaacgtaccaaccccttcaccaaggtttaactcaatatggggacttaatctttctcgtaggttcatctcgcgctaatctcttgttctgactttccatctggctccggggatctgacacatttcgtggcaaactaagctctattgctactatttcataatcattcagaacactcttgccctttaagctatgttaaattcaatactattcctgctatgcctgtcatgtccatagacatttatctgtttcacaatcatgtttatcngatcgatgcggtcccacgggaatccacttaattaaaaccaggagataccagcttggtacccacacaacttacgtttctgactca

SEQ ID NO: 594795 - DNA, 468 bp, Homo sapiens
aacggtggcagatccatttcactgggcgtaaccagctgtacacctgggaccggagttccatctcgagcaccccatttcccgggcgtaaaggtcatgtgtgcgtgggatgcttaaactatctgatacctttcaattctgcaaatatccaaataccacgttggtacggtgtccttctgatgctttttattcttgcccaaattttgatcttgtaaagagctataacagtttccacaaatccttatgtttagctcctacaaagggccataccatttgaggttgaggtgccactacaccgccatggttccagataataggaacccttgccgtatttcttatcatttctaccatctgacaattttgttcagaccagctgaacatagtgtggccgtggcacgcagacagagaggtgcaattcaagctaaacatccccttaggagatcaatcaataatgattccataggaatcgtt

SEQ ID NO: 594796 - DNA, 654 bp, Homo sapiens
catgatacatagtgtctgtttccccatagaatatacaccagatgaacatgtctgccatctccccagagaggacaaacagttgcttggtttgctgtcagaatgcaacgcaaagggtgaagccacgcacctcctcattcaacagcatgcaaggtgatggagaaaacctgcaactgggaccccccagtcttctcttccttgaacagcctacatctccttgggtgttactgctcatcctgtcaaaacccaaactttgctctcctctgacggagctgagtttccatacagacagagcaatcaggtccccatggaaaccccaggcttgctgacccccagaggaaaacgctattactcacagtgctggaggcagattaatgtagaataaccctaatgaaaggcgttatcctcaaaattgtagggcctttgggtttaaatttcctttttttttctgcctaaactcccataatttgcacatttgcattctttgaaagggtgccttcactggagatgctgattacccacagctgaatcttgttgcccttttggcatcagataggtgtgcactgcagagaccatcacccacccttaatggggctggatgaatatttattctctattttcatgagagccaagtggggccttctaactccttgggcg

SEQ ID NO: 594797 - DNA, 1341 bp, Homo sapiens
  misc_feature (1314)..(1314): n is a, c, g, or t
tggaaaagtgggggtaagggctttgtgactgtggatctcaaaacagaatgtgcggggcctctctataaatataaaggggactcatcgtgaaatttaattaaaaaagtgatttagcttcttggccttaattttaacaggtgctataggtggtgaataaacttttatagctcagtgttcccttatactccaagagaagacccacagttaatatatattatgttcactataaacaccacacaagaaatatgattgttatacaccacacactatattttcaaatattatactctgtttcccatacactttaacatatttgggtgtaacgctttaaaaacacattcttagaggcactatcttgtgtgaaaaacgcgggtgtgtaacatatttaatatacaagggtgtccgtggtataattttttgtgtggtacacacgcgggggacatatagatgttcttacacacatgtgtgcgaatataaacatatattccaagcgttaaatataagaaatatatcggtgtaaatataatatgtggatatatctgtggtagtgaggaaatatctgtgggtgtctggggtgtataaatattctctgtgggtgcaatatatacctcactgtggggtcgctttgagaaaacaaaggtgtgtgtgatgtgcggcgcttaatattatattgttgaaaactccgcttttaatcccctggggggatttctcttgacacaacacacgtgcgcgccctatatgggggtgtacacacactcctatattagaactatttcccctatttttcccccagatgtggcgccaaagtcgagatggtacccccttttttttacaaaacactctctaagatgttgcggccgcaccaaacacaacgcgcccgacaatgtggggccacctcttttcactgaggaggacggaacaaccctcctaaaccggcggttcgggaccatcatacaaggtgtcgtgttcccccccatcaaagatgtgtgtgagaaaaccccccgcctgtgtggtggggaatcactcatatgttgcaaataatcaaacaacgtgtctgtggacacaactggttggtgacaacatcatttaaccggcggggacacaaccaccatgtttctggctgtggtgttccaacatcttccaacacaaccccgttcgttctcgtgtctttacaccacaagcaacggcacacagacgcagacacaacaacagggcgggcggcggcgccgcccatctaaaaaaaagagtatccaccccccgagtaggggcggccaccacacgcaatatagtacccagcgtcacacaccgccgacngtatatcctggtgcgaccaccacgagg

SEQ ID NO: 594798 - DNA, 168 bp, Homo sapiens
aatgggcttgcgctctaagataatccctagcccatttcgttactcacaaaggggacaccgtacaccttatctatctagttattatcgaaaccatcagcctactcagttcaagtcaatagccctggtccgtacgcctaaccgctaacattactgcaggccattcagacg

SEQ ID NO: 594799 - DNA, 521 bp, Homo sapiens
accaggcgcactcgatctctattcattagcacactatgccctggtgcggtctgcggactaatgctagtaatcccagcactctgtgaggcccagggccctggagcaccaccgtgcctaccgtatgtccacgatgtgagtccgaatctacagtcagaccggaccatctgtccaccatgcccccagaatgtgcacaagggctccctcggctacactagaaggattagattcctccctactattcccacactggcacagtctgactggtgtgaagctccggcggttttgtgtgtatagtactaccaaggtccgcttgataaggcggagctttcattacatactggaagtctgtgcaccggtacacactcaggcgtgctaccttccgcaaatatgatctaaatctctctctgtctgctgaagctggcctcggctaagacgattagagcattggctcaaagggaccaagacaggcggacagcccgatgttgtgagacccagggccacgatggccactacggggcgct

SEQ ID NO: 594800 - DNA, 130 bp, Homo sapiens
cagttaagcctggttcccaaccctggtgcccaccgccccccagctcatcgtgaatgagggggaacaaagagaggagaaggagcaggagtatgggggtcgaccgtccaccgaggccccacctcggcggccg

SEQ ID NO: 594801 - DNA, 388 bp, Homo sapiens
gagagagagagagagagagagagagagagagagagtgagagagagttttccatattatcgttctccctctttgatcttctgctcgccctctttccccggctcctcctcctgtccccctccttctcttccctctcgtgcccctccctttttcgccctgctctgccttctcttctttttctttactcttaccactgtctctttctctcatctccccactatttctctcctctccccccttcttccctcttttccgctccttctcttcttcctcccttccttccttccttccttcccttcttctctcctcctctttttcccccctctctctctttctttcttctccctctcctctccctctcctctctctctctctctttttccttcctcc

SEQ ID NO: 594802 - DNA, 1002 bp, Homo sapiens
  misc_feature (379)..(379): n is a, c, g, or t
ctctcctgttgcgtttagctgttctaccactgtgttccattgcgtctatgtttcggctcgtttttgtgtcgccacatcgggtgtcggattaaactagtgatcgtagatgcacccggggcgtgttagtgtgcgcctccaggtcatctgttgtgtttcgaccacgctgttttggcatcaaccacgtgagcggtggtggggggcacacccacctgtagtgggtgtttacaaaaacctggggcgccagctgacgcgtacgcgcgcagaaacgtttgtgtggcccgccgcccggacaccgttgttcgtgttcgtaattttctttggggcctaaaaattgtggaacaacgtgcccgcctacttataataaattttctggggccanttcccgtcaaagctggtggtgacgacgagatgttaaaaagtcgggtcggcgccaccaacaatttgggttgattctaatgccgggaacacgttttgttttctgcagaccgatgaattcctcgccccccaggagacctctctgtacggcagaaatagacgggtgctcccgcaaccattgtttccgtgaggctggcgaattattcaacaaaaaatttgttactgttctcccggggaggcaccgaattgataaagtttgtgtacacacgctggtgtggggcggaaaaacacataggccgccccgcttggtactactgctgtcggaacccctgtaaacgaagaaccggcttatatgtgccccgtcggctgggccccgcttatggctgaaaaatagttatgaaaagtggtcaccttttactggccaccaagtatgtgcagaaaaccttgagtgaaaatagcacagccagaatcaaataggaacagccattggttgctgacactgtaggtattatcatgccacatccagtgacgcacagttgcaaagtgtgttctgggcaatcaattctgtggtgcctttcacttcccccaataaacccaaaaatgaaatgggttcccccccaacatgac

SEQ ID NO: 594803 - DNA, 105 bp, Homo sapiens
gtcaagaaaggtggtgttgcaggttgcggactgtaagtactaatagtagatgccagcagctaggactgggagagataggagaagtaggactggctgggtaccggc

SEQ ID NO: 594804 - DNA, 313 bp, Homo sapiens
ttcaaacatgaccccattattgccaccgtctgaacaggtagaacacgtgagtcaattcttccagattcatccaaaaaacccccaggcgcgcctgatcaaacaggccgtggagatcatccgtgccggtggcgtggtgatctaccccacggattcctcctacgctatcggttgccagatcggtgacaagaatgcagtcgagcgagtaagacgcctgcgtgacctggacaagaaccacaacttcgcactgatttgcagcgacctgtctcagctggggcgtcgacgcggccgcgaatttagtagtagtaggggccgc

SEQ ID NO: 594805 - DNA, 1190 bp, Homo sapiens
  misc_feature (751)..(751): n is a, c, g, or t
tataaaagtttttccctctttaataaagtccgctatactaactaaaaggagaatctggggtttctcgccggatagaaccacgagggccaattcaccacgagcttctggtgtagaagaacagtggagaggtgccaagaatcaccatcgagggtgccgtttcctttccgtggtggctttccatcttccagttcagccgtggtctttggccttgagagggccccaaaacaacgagcccggggcatatacatcttcactcccaaaaggcggagaaaaagtgggcaggcaaaaacagcgggaggggtggtcacagaaggagggttcccatcgaggtgtccacgagggtgcgcccccgcggtgatacctctcgtgtgagaagattgctcacgcttctcaatctcagagcttctcagtgaaaagctctcctgtgtggagtcatatctctcacagagatacgacaggggctcccaggctatataaggcgctcacagagacgccggccttgggcacctctcacacagtggggctctcactctggggtgggcgttctctgggagacccctctaacaacgtctctctatatctctgtacaaaaagcgcccagcgacaagtcgtgggggagaatctgggcgtatacaaagctttctagtggcgtgggggaggagatatctcaccagagtcaacatctcccagtgtccccaccatataaacctctgtgtggggtgaggaggcggccagagagtatcactataanaaacccaggggtggtgtgtgcgccaaggcttagaaacagattctgggggtaaaaggtcctttggcgccaaattcgcgaagaattctcttccacagggacaatgttgggatgcaccctatggtgttgtaaaaccccattgtctttacttcctgttgggggttcttggcggctcgccttggccaacgaggattcgggtcttgggaggggccccaaaggtctgagagcacaactgggaggtctcccacacaacggaacagaggggaacaatttcttgggccctcctcatacaaaattacaaaagttccccacgtgggggctaccctactgagggcggctcaacagacaaggacatctccaagagggtcccccaataaggaggctcccatcaacaaggggagaacttgggataccaccagggggcgtcacacaagagtggatc

SEQ ID NO: 594806 - DNA, 523 bp, Homo sapiens
  misc_feature (381)..(381): n is a, c, g, or t
  misc_feature (411)..(411): n is a, c, g, or t
  misc_feature (451)..(451): n is a, c, g, or t
  misc_feature (503)..(503): n is a, c, g, or t
aatgggcttgtgtcaccaggagactactggatcaggacatgtgtggcatagggcagctgtgccgtctgggccattgcccatggaagtactgtgccagccagaacactggtctggcccgagagacctcttttcaggcttaggataccactttcaggccatgaatctgggagcagtgtcagatgaacaagggagcacaagccctgtgacatgtacattccctctcttggctgcatcacagtgttcgcatggagattacaactgaggtgatacaagacttgatctgctctgagtgtcgatgtgcaggctgctgaatgctccacgtgatagccatcatatacgtcaacagctgctgctggagacgtacactcactgtgaaggcanggctctgtgtcattgcttgtgtgtgcctgngtgtgcacaagtgtctgtgtgtgagccagtaggtgagcangagatcgagatcgacagattgatggctttgctatacatagcacactagagtntttcgacagggatagtcttt

SEQ ID NO: 594807 - DNA, 1285 bp, Homo sapiens
  misc_feature (12)..(12): n is a, c, g, or t
  misc_feature (14)..(14): n is a, c, g, or t
  misc_feature (16)..(16): n is a, c, g, or t
  misc_feature (18)..(20): n is a, c, g, or t
ggctggtacggncngnannntaggatcgcccctcgccctctagccccctcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacaccatcggggccgccttcgtggccaaggtgatgtcggtcggagaccggactgtgacattaggtatttgggacacagcaggctctgagcgctatgaggccatgagtagaatctactatcggggtgccaaggctgccatcgtctgctatgacctcacagacagcagcagctttgagcgagcaaagttctgggtgaaggaactgcgcagcctagaggagggctgccaaatctacttatgtggcaccaagagtgacctgctggaagaagaccggaggcgtcgacgtgtggacttccacgacgtccaggactatgcagacaatatcaaagctcagctctttgaaacatccagcaagacaggccagagtgtggacgagctcttccagaaagtggcagaggattacgtcagtgtggctgccttccaggtgatgacagaggacaagggcgtggatctgggccagaagccaaacccctacttctacagctgttgtcatcactgagtcagcactcacctggcctgggggaattaaaggaattccccgtaagggctggacccagctcctttctgggcttgggtagtcaaatgtctgagctaccccaggtcctcatgtcagcagagtggcgcctgcctgtgctggcccatggaacggagacagcattgggctgactgtgggcatgaggagggataaggctgatttggaccccaggcttctgccctggacagcacttgtgtctgcagattatttaagtggcttttgatctgtaaataaaatcagtgcactgtgaatcac

SEQ ID NO: 594808 - DNA, 1683 bp, Homo sapiens
  misc_feature (12)..(12): n is a, c, g, or t
  misc_feature (14)..(14): n is a, c, g, or t
  misc_feature (16)..(16): n is a, c, g, or t
  misc_feature (18)..(20): n is a, c, g, or t
ggctggtacggncngnannntaggatcgcccctcgccctctagccccctcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggttggcgccgtttggggtcggggtctgaggcttgggcgctgcctgggccgagcggagatcggggtttgcctcccgtccccgctcaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacgtgagtgcatccggaggggccaggcacggtgggcgggggagtggggggccggtaatctgcacctatggccccgatctcttccctctcgttgcagaccatcggggccgccttcgtggccaaggtgatgtcggtcggagaccggactgtgacattaggtatttgggacacagcaggctctgagcgctatgaggccatgagtagaatctactatcggggtgccaaggctgccatcgtctgctatgacctcacagacagcagcagctttgagcgagcaaagttctgggtgaaggaactgcgcagcctagaggagggctgccaaatctacttatgtggcaccaagagtgacctgctggaagaagaccggaggcgtcgacgtgtggacttccacgacgtccaggactatgcagacagtagctgctcctcagccctttggggggtgggggtgtgtggctgtctgggtggatcaaagaaaatagggactgccttggctgccagggcaaggtgctctaggaggtcttcctggcctccttgaactgtggggtccaggagactccctgaactgctagccctcccttttgtctgtttatctaattctcaggtatgaggctttagtcacttctctttacagatatcaaagctcagctctttgaaacatccagcaagacaggccagagtgtggacgagctcttccagaaagtggcagaggattacgtcagtgtggctgccttccaggtgatgacagaggacaagggcgtggatctgggccagaagccaaacccctacttctacagctgttgtcatcactgagtcagcactcacctggcctgggggaattaaaggaattccccgtaagggctggacccagctcctttctgggcttgggtagtcaaatgtctgagctaccccaggtcctcatgtcagcagagtggcgcctgcctgtgctggcccatggaacggagacagcattgggctgactgtgggcatgaggagggataaggctgatttggaccccaggcttctgccctggacagcacttgtgtctgcagattatttaagtggcttttgatctgtaaataaaatcagtgcactgtgaatcac

SEQ ID NO: 594809 - DNA, 895 bp, Homo sapiens
  misc_feature (12)..(12): n is a, c, g, or t
  misc_feature (14)..(14): n is a, c, g, or t
  misc_feature (16)..(16): n is a, c, g, or t
  misc_feature (18)..(20): n is a, c, g, or t
  misc_feature (840)..(840): n is a, c, g, or t
ggctggtacggncngnannntaggatcgcccctcgccctctagccccctcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacaccatcggggccgccttcgtggccaaggtgatgtcggtcggagaccggactgtgacattaggtatttgggacacagcaggctctgagcgctatgaggccatgagtagaatctactatcggggtgccaaggctgccatcgtctgctatgacctcacagacagcagcagctttgagcgagcaaagttctgggtgaaggaactgcgcagcctagaggagggctgccaaatctacttatgtggcaccaagagtgacctgctggaagaagaccggaggcgtcgacgtgtggacttccacgacgtccaggactatgcagacagtagctgtcctcagccttggggggngggggtgttttcttttcttgtttttttctcttccctgtttgccttttatatttgg

SEQ ID NO: 594810 - DNA, 1371 bp, Homo sapiens
  misc_feature (12)..(12): n is a, c, g, or t
  misc_feature (14)..(14): n is a, c, g, or t
  misc_feature (16)..(16): n is a, c, g, or t
  misc_feature (18)..(20): n is a, c, g, or t
ggctggtacggncngnannntaggatcgcccctcgccctctagccccctcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggttggcgccgtttggggtcggggtctgaggcttgggcgctgcctgggccgagcggagatcggggtttgcctcccgtccccgctcaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacaccatcggggccgccttcgtggccaaggtgatgtcggtcggagaccggactgtgacattaggtatttgggacacagcaggctctgagcgctatgaggccatgagtagaatctactatcggggtgccaaggctgccatcgtctgctatgacctcacagacagcagcagctttgagcgagcaaagttctgggtgaaggaactgcgcagcctagaggagggctgccaaatctacttatgtggcaccaagagtgacctgctggaagaagaccggaggcgtcgacgtgtggacttccacgacgtccaggactatgcagacaatatcaaagctcagctctttgaaacatccagcaagacaggccagagtgtggacgagctcttccagaaagtggcagaggattacgtcagtgtggctgccttccaggtgatgacagaggacaagggcgtggatctgggccagaagccaaacccctacttctacagctgttgtcatcactgagtcagcactcacctggcctgggggaattaaaggaattccccgtaagggctggacccagctcctttctgggcttgggtagtcaaatgtctgagctaccccaggtcctcatgtcagcagagtggcgcctgcctgtgctggcccatggaacggagacagcattgggctgactgtgggcatgaggagggataaggctgatttggaccccaggcttctgccctggacagcacttgtgtctgcagattatttaagtggcttttgatctgtaaataaaatcagtgcactgtgaatcac

SEQ ID NO: 594811 - DNA, 1589 bp, Homo sapiens
  misc_feature (12)..(12): n is a, c, g, or t
  misc_feature (14)..(14): n is a, c, g, or t
  misc_feature (16)..(16): n is a, c, g, or t
  misc_feature (18)..(20): n is a, c, g, or t
ggctggtacggncngnannntaggatcgcccctcgccctctagccccctcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggttggcgccgtttggggtcggggtctgaggcttgggcgctgcctgggccgagcggagatcggggtttgcctcccgtccccgctcaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacaccatcggggccgccttcgtggccaaggtgatgtcggtcggagaccggactgtgacattaggtatttgggacacagcaggctctgagcgctatgaggccatgagtagaatctactatcggggtgccaaggctgccatcgtctgctatgacctcacagacagcagcagctttgagcgagcaaagttctgggtgaaggaactgcgcagcctagaggagggctgccaaatctacttatgtggcaccaagagtgacctgctggaagaagaccggaggcgtcgacgtgtggacttccacgacgtccaggactatgcagacagtagctgctcctcagccctttggggggtgggggtgtgtggctgtctgggtggatcaaagaaaatagggactgccttggctgccagggcaaggtgctctaggaggtcttcctggcctccttgaactgtggggtccaggagactccctgaactgctagccctcccttttgtctgtttatctaattctcaggtatgaggctttagtcacttctctttacagatatcaaagctcagctctttgaaacatccagcaagacaggccagagtgtggacgagctcttccagaaagtggcagaggattacgtcagtgtggctgccttccaggtgatgacagaggacaagggcgtggatctgggccagaagccaaacccctacttctacagctgttgtcatcactgagtcagcactcacctggcctgggggaattaaaggaattccccgtaagggctggacccagctcctttctgggcttgggtagtcaaatgtctgagctaccccaggtcctcatgtcagcagagtggcgcctgcctgtgctggcccatggaacggagacagcattgggctgactgtgggcatgaggagggataaggctgatttggaccccaggcttctgccctggacagcacttgtgtctgcagattatttaagtggcttttgatctgtaaataaaatcagtgcactgtgaatcac

SEQ ID NO: 594812 - DNA, 1644 bp, Homo sapiens
  misc_feature (12)..(12): n is a, c, g, or t
  misc_feature (14)..(14): n is a, c, g, or t
  misc_feature (16)..(16): n is a, c, g, or t
  misc_feature (18)..(20): n is a, c, g, or t
ggctggtacggncngnannntaggatcgcccctcgccctctagccccctcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggttggcgccgtttggggtcggggtctgaggcttgggcgctgcctgggccgagcggagatcggggtttgcctcccgtccccgctcaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacaccatcggggccgccttcgtggccaaggtgatgtcggtcggagaccggactgtgacattaggtatttgggacacagcaggctctgagcgctatgaggccatgagtagaatctactatcggggtgccaaggctgccatcgtctgctatgacctcacagacagcagcagctttgagcgagcaaagttctgggtgaaggaactgcgcagcctagaggagggctgccaaatctacttatgtggcaccaagagtgacctgctggaagaagaccggaggcgtcgacgtgtggacttccacgacgtccaggactatgcagacaatatcaaagctcagctctttgaaacatccagcaagacaggccagagtgtggacgagctcttccagaaagtggcagaggattacgtcagtgtggctgccttccaggtgatgacagaggacaagggcgtggatctgggccagaagccaaacccctacttctacagctgttgtcatcactgagtcagcactcacctggcctgggggaattaaaggaattccccgtaagggctggacccagctcctttctgggcttgggtagtcaaatgtctgagctaccccaggtcctcatgtcagcagagtggcgcctgcctgtgctggcccatggaacggagacagcattgggctgactgtgggcatgaggagggataaggctgatttggaccccaggcttctgccctggacagcacttgtgtctgcagattatttaagtggcttttgatctgtaaataaaatcagtgcactgtgaatcacacccagcccctttccctgctgtgtggattaggtgtcaagacacctagttcttcctggggccacccggctggcctcactgcttatattaaggctcctcccaactctcattttcctttggaaaacaagacttttttccccatggttaccgctgagatactggggctgtagtagtataaaagctcacagttccttctgagtgctgaaaagagtgcatgagttgcttcgaaataaaagggtcaagcattcctacctgagacaggttaaaaaaaaaaa

SEQ ID NO: 594813 - DNA, 1862 bp, Homo sapiens
  misc_feature (12)..(12): n is a, c, g, or t
  misc_feature (14)..(14): n is a, c, g, or t
  misc_feature (16)..(16): n is a, c, g, or t
  misc_feature (18)..(20): n is a, c, g, or t
ggctggtacggncngnannntaggatcgcccctcgccctctagccccctcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggttggcgccgtttggggtcggggtctgaggcttgggcgctgcctgggccgagcggagatcggggtttgcctcccgtccccgctcaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacaccatcggggccgccttcgtggccaaggtgatgtcggtcggagaccggactgtgacattaggtatttgggacacagcaggctctgagcgctatgaggccatgagtagaatctactatcggggtgccaaggctgccatcgtctgctatgacctcacagacagcagcagctttgagcgagcaaagttctgggtgaaggaactgcgcagcctagaggagggctgccaaatctacttatgtggcaccaagagtgacctgctggaagaagaccggaggcgtcgacgtgtggacttccacgacgtccaggactatgcagacagtagctgctcctcagccctttggggggtgggggtgtgtggctgtctgggtggatcaaagaaaatagggactgccttggctgccagggcaaggtgctctaggaggtcttcctggcctccttgaactgtggggtccaggagactccctgaactgctagccctcccttttgtctgtttatctaattctcaggtatgaggctttagtcacttctctttacagatatcaaagctcagctctttgaaacatccagcaagacaggccagagtgtggacgagctcttccagaaagtggcagaggattacgtcagtgtggctgccttccaggtgatgacagaggacaagggcgtggatctgggccagaagccaaacccctacttctacagctgttgtcatcactgagtcagcactcacctggcctgggggaattaaaggaattccccgtaagggctggacccagctcctttctgggcttgggtagtcaaatgtctgagctaccccaggtcctcatgtcagcagagtggcgcctgcctgtgctggcccatggaacggagacagcattgggctgactgtgggcatgaggagggataaggctgatttggaccccaggcttctgccctggacagcacttgtgtctgcagattatttaagtggcttttgatctgtaaataaaatcagtgcactgtgaatcacacccagcccctttccctgctgtgtggattaggtgtcaagacacctagttcttcctggggccacccggctggcctcactgcttatattaaggctcctcccaactctcattttcctttggaaaacaagacttttttccccatggttaccgctgagatactggggctgtagtagtataaaagctcacagttccttctgagtgctgaaaagagtgcatgagttgcttcgaaataaaagggtcaagcattcctacctgagacaggttaaaaaaaaaaa

SEQ ID NO: 594814 - DNA, 286 bp, Homo sapiens
gatgttgatgcactggaggtcttttagcctgtccttgcatggcgcctgctggaggaagagagagctctgctggcgtgagccacaatttcttgactggaggccatccaccctcttggttgaggccttgttctgaaccctgacataggcttgggcactcatgggcctgggcttttaaggtggcctcctgccctgaacaaggaccctccccgcttttctggggctctcaattgaacaaagcaaccaaacaaaggccgttttatataaaagattataaacctggaataat

SEQ ID NO: 594815 - DNA, 291 bp, Homo sapiens
  misc_feature (40)..(40): n is a, c, g, or t
ggcttgagcgtccaaaaatggtgctccccatgtttcccgntcacgggtttaaaaaacccgcttgggaataccagtccccggggccctccctgtggggggggcgttagccttccccccccccccttttttgttgcctaagccttgccgggccttcctgtttagtttttcctgtaagccaaaaaaatgacccttcccaggggttggaagtgaggttttttttgtgaacccctttcccccctggggtctgggtcttaacccgatgaataacctgattttgttcttttgaaccca

SEQ ID NO: 594816 - DNA, 1729 bp, Homo sapiens
  misc_feature (12)..(12): n is a, c, g, or t
  misc_feature (14)..(14): n is a, c, g, or t
  misc_feature (16)..(16): n is a, c, g, or t
  misc_feature (18)..(20): n is a, c, g, or t
ggctggtacggncngnannntaggatcgcccctcgccctctagccccctcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggttggcgccgtttggggtcggggtctgaggcttgggcgctgcctgggccgagcggagatcggggtttgcctcccgtccccgctcaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacaccatcggggccgccttcgtggccaaggtgatgtcggtcggagaccggactgtgacattaggtatttgggacacagcaggctctgagcgctatgaggccatgagtagaatctactatcggggtgccaaggctgccatcgtctgctatgacctcacagacagcagcagctttgagcgagcaaagttctgggtgaaggaactgcgcagcctagaggagggctgccaaatctacttatgtggcaccaagagtgacctgctggaagaagaccggaggcgtcgacgtgtggacttccacgacgtccaggactatgcagacagtagctgctcctcagccctttggggggtgggggtgtgtggctgtctgggtggatcaaagaaaatagggactgccttggctgccagggcaaggtgctctaggaggtcttcctggcctccttgaactgtggggtccaggagactccctgaactgctagccctcccttttgtctgtttatctaattctcaggtatgaggctttagtcacttctctttacagatatcaaagctcagctctttgaaacatccagcaagacaggccagagtgtgggtgagtgctgtgctggagcctcacagcaggaacatgcaggggcaccagaggaagctgaatagggcacagagggctgggtcactgggagatcccagggctactggcattgggccctcgctgatcatcatttttcctgccagacgagctcttccagaaagtggcagaggattacgtcagtgtggctgccttccaggtgatgacagaggacaagggcgtggatctgggccagaagccaaacccctacttctacagctgttgtcatcactgagtcagcactcacctggcctgggggaattaaaggaattccccgtaagggctggacccagctcctttctgggcttgggtagtcaaatgtctgagctaccccaggtcctcatgtcagcagagtggcgcctgcctgtgctggcccatggaacggagacagcattgggctgactgtgggcatgaggagggataaggctgatttggaccccaggcttctgccctggacagcacttgtgtctgcagattatttaagtggcttttgatctgtaaataaaatcagtgcactgtgaatcac

SEQ ID NO: 594817 - DNA, 161 bp, Homo sapiens
tgatcgctcgtgccatcttgaggaagctctggtttggacacgctgcaggagctccttgcaggtttcccaatattttgcagagtaaggcagatttacctatcacattctcattagcgcaaggccaggatagttgatgtctgtccggagcggaccgtggtgac

SEQ ID NO: 594818 - DNA, 1465 bp, Homo sapiens
  misc_feature (12)..(12): n is a, c, g, or t
  misc_feature (14)..(14): n is a, c, g, or t
  misc_feature (16)..(16): n is a, c, g, or t
  misc_feature (18)..(20): n is a, c, g, or t
ggctggtacggncngnannntaggatcgcccctcgccctctagccccctcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggttggcgccgtttggggtcggggtctgaggcttgggcgctgcctgggccgagcggagatcggggtttgcctcccgtccccgctcaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacgtgagtgcatccggaggggccaggcacggtgggcgggggagtggggggccggtaatctgcacctatggccccgatctcttccctctcgttgcagaccatcggggccgccttcgtggccaaggtgatgtcggtcggagaccggactgtgacattaggtatttgggacacagcaggctctgagcgctatgaggccatgagtagaatctactatcggggtgccaaggctgccatcgtctgctatgacctcacagacagcagcagctttgagcgagcaaagttctgggtgaaggaactgcgcagcctagaggagggctgccaaatctacttatgtggcaccaagagtgacctgctggaagaagaccggaggcgtcgacgtgtggacttccacgacgtccaggactatgcagacaatatcaaagctcagctctttgaaacatccagcaagacaggccagagtgtggacgagctcttccagaaagtggcagaggattacgtcagtgtggctgccttccaggtgatgacagaggacaagggcgtggatctgggccagaagccaaacccctacttctacagctgttgtcatcactgagtcagcactcacctggcctgggggaattaaaggaattccccgtaagggctggacccagctcctttctgggcttgggtagtcaaatgtctgagctaccccaggtcctcatgtcagcagagtggcgcctgcctgtgctggcccatggaacggagacagcattgggctgactgtgggcatgaggagggataaggctgatttggaccccaggcttctgccctggacagcacttgtgtctgcagattatttaagtggcttttgatctgtaaataaaatcagtgcactgtgaatcac

SEQ ID NO: 594819 - DNA, 1141 bp, Homo sapiens
  misc_feature (12)..(12): n is a, c, g, or t
  misc_feature (14)..(14): n is a, c, g, or t
  misc_feature (16)..(16): n is a, c, g, or t
  misc_feature (18)..(20): n is a, c, g, or t
ggctggtacggncngnannntaggatcgcccctcgccctctagccccctcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggttggcgccgtttggggtcggggtctgaggcttgggcgctgcctgggccgagcggagatcggggtttgcctcccgtccccgctcaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacaccatcggggccgccttcgtggccaaggtgatgtcggtcggagaccggactgtgacattaggtatttgggacacagcaggctctgagcgctatgaggccatgagtagaatctactatcggggtgccaaggctgccatcgtctgctatgacctcacagacagcagcagctttgagcgagcaaagttctgggtgaaggaactgcgcagcctagaggagggctgccaaatctacttatgtggcaccaagagtgacctgctggaagaagaccggaggcgtcgacgtgtggacttccacgacgtccaggactatgcagacaatatcaaagctcagctctttgaaacatccagcaagacaggccagagtgtggacgagctcttccagaaagtggcagaggattacgtcagtgtggctgccttccaggtgatgacagaggacaagggcgtggatctgggccagaagccaagatttactcatcgaccaagatttactcatcgcccaagatttactcatcagccaagatttactcatcagccagaggattcctctctccaacagt

SEQ ID NO: 594820 - DNA, 907 bp, Homo sapiens
gttgtgctgcggcgccgcgcggcctgcagtcccgggcccgcgccccgcttgccgcccgcccgccctgcatggagcccggccccgacggccccgccgcctccggccaccgccgccatccgcgagggctggtatccgctgaagacactgcagccctagtggacccggaccagagccctgatcagcatagacaagtgtaggagcacgaatagcataccagcaaacggccgctacgcgctaactcaggacatacctacgtctttccgcagtaacgacctattggcaacgtgctaggtagtaggaccggtgtcatccagctgcaacggacagagagaccgagtactccgtaccaggacgactgatctgccaaacctgcctctctgccagaccaccagccaaaacaccagcgaaagggtgctgagtcatccggggagcgggcagatggaggtgtccatgacgaggacggctagagagaagacaagcccataccagaaggcagtcagaggatacactgtagaaggatcgaccgaagggactagacagtaccaaagctcttccacaggaaacgtacaccttgccacgagcaatgtgcccatatagcgataactcgatagacctatcgaaagcgttgacccctaacaatgtaagcgggtagacagggaatatgcggttcaatggacaccaggaaatcaagcgacatgcccatatccagaacggatgacttccttacacctagcgacttcacatcgagtaacccaccacaagtggtgcacccacggccggaaagcagttaatcgttcacaagggaggttccgtaattaacaacagaattcaatgaaggaacggagtactcaacgggaccaacttgcttatccatactgtctgccaagcgcaaaagtagccaattgcg

SEQ ID NO: 594821 - DNA, 202 bp, Homo sapiens
agaggattatctataaattttaatgtgtgttaatcttacctgtcttgaaagaaatagttcttgtgtgtcggtatgtatattaatgccctagttagcagaactgtactagaataaaggatacaaggattattgcaatgttactgcactgaaaaacgtgtgtgtattagtgtgctaaattatttagcagaatattcacaagtat

SEQ ID NO: 594822 - DNA, 248 bp, Homo sapiens
  misc_feature (50)..(50): n is a, c, g, or t
  misc_feature (174)..(174): n is a, c, g, or t
  misc_feature (191)..(191): n is a, c, g, or t
  misc_feature (211)..(211): n is a, c, g, or t
  misc_feature (233)..(233): n is a, c, g, or t
ggacatgtaccatgccagcaagagtgccaagcgggccctgagctgcgctntttccagactgaggagaagatcgagcgaacccagcggaccatcaggagcatccaggaggctctcgcccgcaacgctggccggcatagcgtggcgttcaccagctgcaggagaagctggcaggancccagcgccagtcaagncttccgggctcaggaagccngcctgcagcaggagcagagganggcagacacccacaa

SEQ ID NO: 594823 - DNA, 888 bp, Homo sapiens
gtggacgtacatgagatatcaggtgacagctcctcgagtcaattcccttcgagtccatctggagcgcctgctttgtcttcggagttcgcgattgcagctcttcgtcccctactccatagcctaagaggccggactccagcgcacagcccagacccacagcagcctgccagaagcacacccaagcacagccgcgatggcctggtctcagaccctggtacgaaaccccaggcctaaaccttccatatggcaatgtccacgtagccaatgaacaacctgacagtgtatcctaggaccccacatgagttggtggcaggtcgtacctaagctgataactaattgctccatctccattcttctcttctctgctttgtcaggggatgctggtctatccgttcaaagatgagtacacaccaggtgcctccgagcacacctatgtggtggctggccatacgtaggcaatgaacgcactcggattctggcccaatggacatcgtggtgaaagcatatccagtcttgaatgttgatgcgtgttgtcatgaaaacggagggctggaagtacttcctgccctgtcgtctccgagtgccagtcacaggggcgtcaggggactgcaagcatagccgaatcttagagcagtgaaaaacgaaagttgaacagtagaaaacgcgcatggggtccccctgctggtagtcgtggttgtgactagagttgttcaccttgcgtgtgtcctggcctgcattgagccaatttcccggaatctcggcaacagagtgccccggagcgcccccgtggtggtgctcctgggagtaagcgctgtctgggcctcacgggtgggccccaccccccataacttgtctaaccgaagttctactcactctggtgtggatcca

SEQ ID NO: 594824 - DNA, 289 bp, Homo sapiens
atgtagaactctgtcgacatgcaccatgaagcttggagtgaatgctcttccttggggacaagtgtgggcttcaatgtcaatgaatgtgtctgtcagggatgtacgtcgtgacaagggaaaatagtgacagcacagatgacccaccaatggaagcagctggcttcactgctcaggtgattatcctgaaccatccaggccaaataagcgccggatatgcccctgtaatgggattgccacacggttacacattgcatgcaaagtatagctgagctgaaggaaaaagaattga

SEQ ID NO: 594825 - DNA, 306 bp, Homo sapiens
aggattgcttgagcctaggagttcaaggctgtagcgagctatgatcatgccactacattccagcctgtgtgacagagcaagactccatttcttaaaagacaaagaaacaagaggggaggtgctctgaagatcacacacctatctccctcccctagtttgaaaccatggtattatattttcctgaaagaacaattttttaaattaataaggcatgttaccactgactctatgtagagatcagtgatcaatgttttgcacatgtattacttgggagtaacagtagtacacataattcatatataaaag

SEQ ID NO: 594826 - DNA, 495 bp, Homo sapiens
agtccaccatccggtggttgattcctgtttggctatggtgagtagtgctggcaaggaacatatgcatacacgtatctttgggtagaattatttattttccttgggatatatacccagtagtgggatggcggggtcgaatggtatctcaactcttagttcttggagcctgctcttcacaggggcggggataatcatacactcccactgacagggtgtgagcttggctcggtagccttgacagcattggtggttattggacttttaaaaaaaccatcgagtgggtatctcatggtgcatgagagggtatgtcatgggggtttggattggcatttccctgatgatgagtgatgtccagcattttttcatatgtgggtgggcggctggtatgtcttctttggagacatgtcggttcatatgcttggtccactttgtaaggtggttattggctttgggctgtgtaatttcaaattccttgtagattgtggatatcagacc

SEQ ID NO: 594827 - DNA, 598 bp, Homo sapiens
  misc_feature (386)..(386): n is a, c, g, or t
caggtgggttcaaatggccatttttgtgtgtccctctctctcatcttatgcttcccttcctttttttattttattttttggagacggagtctgctgtgtcgcccaggtggagtgcagggcgtgatcttagctcactgcaagctctgccttccaggttcacgccattcttctgcctcagccccctgagtagctgggactacaggcgcccgccacacgcccggctaatttttttttttttttttgggtatttaagaagaggcggggttccccgttgttagccaggagggtctcgatctcttgtgacctggtgattccacccacttggaattcccaaggtgtttgggttcacggggggtggaggccaccaggccggggctctttttttntaaggtggcaatctttggaggggaatattttaacctctatttggccccttcttagggctcttaaattaaatttggcattggctcttgggtaaaagtcccttccggtaagcgtctaaatttattttaatcccacggttaattccacagccctattactgaagcttctgcgagttgcgactctcggagaaacccctattttaaaaggatttatc

SEQ ID NO: 594828 - DNA, 107 bp, Homo sapiens
cactgatacctaccatggcttgaaatggcctaagtcacttctgtgtcttagcctttcctttcacaattgccacctccccctcccatgtctcatgggcctcacagtca

SEQ ID NO: 594829 - DNA, 235 bp, Homo sapiens
ttgacgcatccgtgtttattgtttttccccacagggagaccctcccccacctgggaatccttactcagactccccttttcccctctgacagaacaacaatgacaagtctttggcactagggcagtggtcttatcctccaactacttcctgctggccttgggtgtagagctgaccctaactatggctgttggtctgtcgggagatcctgtgggtcattgtcctggactgtgggact

SEQ ID NO: 594830 - DNA, 698 bp, Homo sapiens
ggcacagtcagtgctgtgtttgaggtaaatgcagtaacggttagttttctacttggtcttatagaaggtagaaaccattgtgtatgttatgttgtctataaaagaaaaaatactaatattaaataatttcttacgactctgagtcactcacttatttttccaataattgatattgtacattcctagtgccattaggtatgtatgtatgtaacttttacagtttttcagctgaaaggtgtaagtatttttttggagggggtcttaaatctcatttaaattccttggttggaacggtagtatatttaatttattccttattttaaccattttaaaccaatggtattgacttgtacattaatacagaatggaacatttggtagttgtgggcagtgaacccagtggtgggtgaattaaagcttaaaatatgggaatgattggggctatattccttggagagagaaggggaagaattagacctaatagtgatcatgattaagggaaagtaccggaagaaccatggggtcccctctgtttcttgtggtggaatgaggcaaggtaatcattttgataccgagtgaagacctgtgtctctaaggggggagagggatttaagagtttagcaaatgtggaaagttgttgttgcgctgtttgggaattggttggtactataattaccattaaactctaatttaaagatg

SEQ ID NO: 594831 - DNA, 203 bp, Homo sapiens
tggcatgcactgtcttcccactcatcgttgggcaagccctgcattgcagcttctggtttctttctttctcttttttttttttaacgacagagtctggctcctgtcgccaggctggagtgcaggggcccgatgtcggctcacggcaacctctgactcccgtggttcaattgattctcctgaccaaagctggggtccggagctcg

SEQ ID NO: 594832 - DNA, 977 bp, Homo sapiens
gtctcgagtgtctgacgggtgtctgtgttcttccggtcggagctgccgttgctgcgccgcggtttgttgccaccattgcggttccccgcttgtgtactgctgcagtctgtgcggacgcgtgcggaaccttgtgttggcccgctctattcgagtttcccgtcgcggggtccccagaaaattccccggtattgcgccattcgcgccggatgtgtgccccgtgtcgagcgccccttcttggacgcgcgccttcgaatggaggagcctgcgccagcgtgtgtggcgctacgcccacgtttggaggggcttgtccatgtacggactgtcgttatcaggcccgccaagatagctggcgcgattcttcccgccaagcagcagagggttccccggttttgttgccacgcggcgggatgaagcgcagtgccccgttggccccggggtggagttttttgctaggtggcgccgcgcgccggtttgttcttgccgacggccgggtgttccgccaatgaggtgggtgcccgccccgttggtggtggcccgaggggccttcttactgtgtgtgcccgaatggggcccgcgtacatgttatgccgcggttctctgtaacgggtcgtagcattggcccccccaggaggaggctccttgctatttgttggcccctgtcgacgggttgtccccacttctcgcttggggggaagccctgtcgccccgctggccccctttgagtcaaaggtgcaacaggttggggccccggagtgaccccctgcgccctctatgcactgttctcgtattaccctgctctgtcggttgcccactggcactcgttcagaactaccacctgttttttggtcctgcatttctgcggttgccctgttagtttccctcgggggccgcggccctctttttgtggtcatcatttttcaattccccaagcccccccggcccggccccgcccccaaaaaaccccttctaaaaagaca

SEQ ID NO: 594833 - DNA, 579 bp, Homo sapiens
ccctgattctaatagtcattctagagtatccccgctctcatctcgaatcctctctaggctcgtcgatcgttctctgattgatttaggttgtgatttatcttctccttctttctcctcttctctttttttctccctacatctttcatatttcttttgttactcctctggcagataagcagacagttatgcctacaagtactatttggcctagtttagttgacttgaagcacagagtgaactgctcatagtagaaagtgaaccaggatgtagtggttgaacttgaatttgatactggcctctaacgcttgtaagtctcatcatacgttctggagtcacttttgtttatattcatcttctctacatttttctgactccttcttttcttcttgtttctctttatcttgtttctctttttcctctttttctttttcttcattttcttgttctctggttcgggtagaacgacttcttcctattgttttctcagcttcttgaagatcagttaatgtcgctccctgtgttgatcttctagattgtcttgcttgtctagatcttgcttttctttgggattcagaagat

SEQ ID NO: 594834 - DNA, 164 bp, Homo sapiens
tgatgatgaagaggatgatgatgaagatgatgaggaagatgatgatgatgatgatgatgtgatcatacaagactgagtggggagctgggggaggggaggtctgttactgaaaaatgaaccaacttagtaactgtttaaacaaaaaaaccccatttttaaaatta

SEQ ID NO: 594835 - DNA, 182 bp, Homo sapiens
aaggaggaaaagataggtgccgaccatacagctaatgttcacaaatcaggcaagactgcgtcagggagcagaagcacctgaccccaatcctaggtacagttcctgtgtgtgttctttttgcgtcacatagggtggtccactctgctctatcatgttgaactcacaggtttggcccttatgag

SEQ ID NO: 594836 - DNA, 169 bp, Homo sapiens
tgaatgatgggaggaatgcaatggatcattgcaagagactctgtaaaagactaccaaccgttctgcggctactttaggtccgtttgaaagttctgcatacaatttcttttatcctgctaatgttccacaaaatgaccgcatgagtgccttcgggtagtgatgcaagcat

SEQ ID NO: 594837 - DNA, 558 bp, Homo sapiens
  misc_feature (184)..(184): n is a, c, g, or t
  misc_feature (300)..(300): n is a, c, g, or t
  misc_feature (307)..(307): n is a, c, g, or t
  misc_feature (333)..(335): n is a, c, g, or t
  misc_feature (368)..(368): n is a, c, g, or t
  misc_feature (395)..(395): n is a, c, g, or t
cgtagttcaggaggtacaattctatgcagaatggtctccagtgtctagcctgacaggccagaaatacaggtagctgactcattggggaagttctaccatttaaaagaaactatccttttcctaattataaatgtatattttgtagtagaattggattcctgaaactttaatgaacttgtggatncctggggggcctcgtgaggtggcagtatctgacttgggagggctgtggtggggttgggatgccgcatttctaacaagctctctggtggtgctgagatcactggcagacaaaccacnctggggnctatcaaagacttagcaaacaaacannnaatagctaggattacaaaagccagctgtaaatntgccttctcaaaagggacactgctttncattcctctctccacgccggactaggtcaggcctccgggcttccctctccgaacgtcacccacagcatcgagagagggaacagatggagatgaggatgtagagttgctggggaggccagaggtttggaatgagtgaatatagggtggggggttaggcccgaag

SEQ ID NO: 594838 - DNA, 1181 bp, Homo sapiens
accgttacagaccacaaccaaagtcccgtgagatcctgtgatgtaacaaggatatgagcgaatcgggtgcccactcccacatccggggtactggtggctggactgatgccttggagcctcgtgcaggcttcgcaaggcatggtgggtcagctggcggcactggcagggcgtgctggctgtggtgctggagatgatcctgggaatgtggaagattgcctggtcgtggcagtccttatttgctggccagcctgggcactggtggaatgactgtgccatctgccatgtgtgcatgtgatgcagtgcccatgggccctgacaacagccaattcacatgccatctgcctggaagtgaaatcttctccctggatgatgagcaatgacctgaggctgctgactgcaggccttcctgtgctggtccatcaggctgttctgcatcaaggaggagacagtgagatcatcgaatgtgtggaggatggtggagatccaggatttgatctgaccatgccaacagtggacgggctccaaggtgggcaaacgtgacccatcaagaccacagagatggagaccaatctacgacctgggcaccaagatgattgagtcactgacccaaggacgaagggacgtgatcaccatcgaacaaagggagacagggcaagatctccaaaggtggagcagatcacttcacacagacgcacgcgaactacgagctatggggctcaccaagaacaagtcagatgcaagatgccagatggggaagcccaagaaaagcaaggaggtggggcacaccgtgatcccagcaacgagaatcgacggtcaatcaaacatcatcgaacccaggggcatcagggcgcctcaccaggtgacccaggggagacaagtcaaagtcaggaacagacaaaggcaagtgactgaatgagcacgagcgaagggaaacaaccggacggagcacagaggcaatagcgaaatacgaaagtaacgtaaccagcagggccgaacgtggacgggctgcaggatagtgcacacaagagaacagacgagtgccgaaagagcctcaggacgaaacaggacaagtaagacaccaccggcacatcagccaccacagacgcataaagcacaggaaaagaatacactatacagaatatagcatagatgcgagtatcatactctaactaaaaagaaag

SEQ ID NO: 594839 - DNA, 116 bp, Homo sapiens
ctgtagaggcctgggcgggcagaccacttgagatcaggagtttgagtcgtttgacacacatgtcgaaaccctgactccaccagacatacaaaaacgtagctaggcatggtgacacg

SEQ ID NO: 594840 - DNA, 186 bp, Homo sapiens
ttagatctaagctaaggaaggactggtgcccgcaacaatgggtcaagatgttccagtttaacaaaaggtgcctaggttgggaccaccgggaccgggaagacctttacgagtcctctgacatctgactacccttggtacctgactggacactgtgctgggtaccgacacaggcacgtgacacgtcct

SEQ ID NO: 594841 - DNA, 755 bp, Homo sapiens
  misc_feature (443)..(443): n is a, c, g, or t
  misc_feature (480)..(480): n is a, c, g, or t
  misc_feature (571)..(571): n is a, c, g, or t
  misc_feature (755)..(755): n is a, c, g, or t
tccggaggatgtcgtgcaggctgaggctgggggcatgcgcaccgtgtagtctaagcaaaagtggccaggtctattccttcggcatgcaagtgatgaggtgtgccctgtggcacagggcatcacatctagtgagcatgcggctactgcggtgaatgcgtcctctgtgggaaaatgttgagacgcgtgcaacgacgatatggttgtgtacacgcgttgtcgagcaggggagatcatgtcacacgaggcaggcccttcaaccgagtgattggccggtgtacttacctcgtggggtgctaccgtttctcgtggcgagcaattcaaacgggatgtgaatttgggaccttgtgtgtgcagcgccaatttgtaaggaacgaagccactgggggtgcccttgggtagcaaaggtgattgctacggcttatgtgaaattggttggccgtagntggggtttcaaaaagcggttgtgggcgcttcgagtgnacaaactgaatccaaaccggttctgtcgttgggaacttcggcttgtgagaccatgccctctagaataggagattagaacagcttacataancaaggcccttatagtggactccttggcgggaggcgcggaacacccactggggggcgcaaggtctttaagggggccccttggtaggtaggccctctgtcggaccgcgttttgacttaattggggcgcaaaaaccaccggtttggggtttgggtgtcgcctggggcaaaaatgcgtggcccatacn

SEQ ID NO: 594842 - DNA, 343 bp, Homo sapiens
tgccaaagtgtgagtaacaagcatgtactggttcttgggcgtacctactctgggtgggtggagcctatccaacacgaactgagaaagctggtgaagtaatccctgtgcttcttcgagatgtgattcctagatttcgaccgcccttatggatcggctcagacaacgggcctgcgtttttggctgccttggtacagaaaacggcaaaggtattggggatcgcacggaaactacatgcacgtcccggcctcagagttccggaaaggtggagaggatgaatcggactatcaaaaatagtactactgtcttccccgctggatatttaaaacaacagcacaaggggcat

SEQ ID NO: 594843 - DNA, 394 bp, Homo sapiens
aaagggaataagggggggggggacaaaccagaagatgaggaaagaggaggagagagagagagggaggaggaaaacagagaagagagagagaagaaactataaaagccaaatagatttataaaagaccaggcgaataataagtaaataacccaataaggaaacatcaaaataaagtagatgaataagaaggcacacacgaaaaatgtgagcgcagaaaggacagttatttaggcaagtgaaggtttctgacagagagagtagagagcaatggcttctctctatctctcgctctcgctctctctctctctctctctctctctctctctctctctctctctctctctctctctctctctctctctctctctctctctcgcgtgcagaattcgtacag

SEQ ID NO: 594844 - DNA, 140 bp, Homo sapiens
cgctctctaccaataagtatctattgtctggcccacctctttctgcataatcatatggtccagctctgaggcagcttgccttagtggtggggtaggctccttcattcagcccaggcttactggcacacatactatgtgcc

SEQ ID NO: 594845 - DNA, 825 bp, Homo sapiens
gaccctttgtaactctcttctcctccctagatgctgaggttaaaatcttacagaccccccgtggctgtattgacaaactctgcctgtagcctgagtgtcctaaaaagctctagagaccgtcactcccgggtgtagctcaagcatgtccacatgtctggtcactggaaaaccacaggctttgggctggtgaagacatctcttgacatatggatcaggacataacatagtctatattgtaagacgaactgtcaaaacaaattatggtgccaatatcgacatgatctttctcacgtcgaaagaaagaagttggtgcatttgagccagagtattgccggcttatttgacggtagaatgatgtcaaaccgtgaaccaacaattcgcaacatcatagagcgtatctcagtgtgagacagaagacgtattgcagtactgaacttgtttcacgcccatttggagatataacggttagcctgccatgcgtcatgacaaaacatcatccaatgatcttgaagtgcgtgaccatctggtgccacggtccatgagctttcacgagattagaagaatagcactacaggggcctggttcccaagaatgctaggttcaagtagctggacagcattttgcccatgttctagcattctctacgtttattgagcagcgtgaacatggatgctggagtcgggccatggttttcaaagatcctgtgtaccgtggcaagacggaaagcaagttttgctgacaattgtcttagaaactaccgcaatgggcaaaggcaatccctcgaggttggacataccgttggaggaagtagcagaaagaccattg

SEQ ID NO: 594846 - DNA, 893 bp, Homo sapiens
gaaagggccgcacaggccccccctttgggtcgcccaaggggccccccgctggtgcgacaacggggaatggtatccccgcgtcgccccgccctattaagagcccccgctcgtgaaaatccgagggctgcgcccactcccgtagagggctccgcgccccccacaaggggtggtccccacggtcggaaacgcaccagacaaacaggagtgcgcggacaagtttcggaagcaagcgagtcatcggcacgagaggataattccacagcattgtcgccagtgtggcgccgacagtctgtcgaatggaacagacgcgggatgaaccaccacgtgattgtccttggggcgatgcctcaagagcagttgtagcccgccgggcgacaggagccgtccctggtgtgacagaaaaggatccgttgaacttaggcgcgtgtataaaactttgggtaggagagaatagcacgcggtcaggtttctctgtgtaaggaggcgcccccccgcccccgccggggtgggtcattataagacgcaccctcccgtggctgggtaatccacaacaaggggcgttccacccttcctcgtggagcaacaatatttagggggtagctaataggacgttggagctaaaatacaaaccgggttcttcttgggaccgcgccccccacgacaagtatgataaaacggggggagtgcatattgatgatcacttcacaccttcttctgggctttagcccacgataatacacgacaagaaacaatgtggtatgttagtttattcgtcaagcgaccccgcatgagtcgcccaagaaacaacataacaggctctccaccttggttgcggcacaccgttcttacaaatggattcaaaaaaaaacacaatgttttacaaaaacaaaaca

SEQ ID NO: 594847 - DNA, 155 bp, Homo sapiens
aatatacgaccagtagataagactgatactagcagatgcacagaaagttaaatctcgcactccatatgtatgccaggtatgtctctgagtgtcaggatatctgggtagctgcggctggtcttatcggaagaagtccaggctggtgagatgttcaa

SEQ ID NO: 594848 - DNA, 716 bp, Homo sapiens
taacataagtgctaagtaccaggccggtgttaatcaggcagaggccatggctgctggtaactgtacacgtatcctgaacactggagggccttacaaggctctcatcgctgctcagtacagcgagggctcagagtccgcgtgctctccgcaacaccccacttaccatatttagaacaacaccaacgcggaccccgtgcaatttcatccgcaaaatttcctgcctggccaggtcccagcatttgagggtgatgatggcttctgtgtgtttgagagcaacgccattgcctactatgtgagcaatgaggagctgcggggaagtactccagaggcagcaagcccagtgtggtgcagtgggtgagctatagctgattaccgatatagtagcccccagccagtacctgggtgttaccccaccttgggcatcatgcaccacaacaaacaggccactgagaatgcaaaggaggaagtagaggcgaattctggggctgctggatgctatactatgaagacagaggactataatctaggtgggcgaacgagtgacattggctgacatcacagttgtactgcaccctgttagtggactctataagcaggttctagagcctatactttaccgaaaggactttcccaataacaaaccgctggttcctcacctgaattaaccaagcccagatacgggctaggcaagggggaagtgaaactgtgtgacaaca

SEQ ID NO: 594849 - DNA, 120 bp, Homo sapiens
ggatttgctggtgcagtacaactaggcttaatagggacatgattgcaccactgcaccccagcctgtgcaatgaagtgagacccttcacgcttcacacacacaggaagttacaaacaagca

SEQ ID NO: 594850 - DNA, 211 bp, Homo sapiens
agatactgggccggatggccagcttcctctccaggattgtcatgatgccccagccagcacgtagtgtagctaccgcaattcccccaggcgaatgcgttcagcctccagcgtcttctccagctccaggacacgcacctgcgatctccatctcctgcttctacagcatgatgagggacaggccgtagaaatccatggtgtctctgtcctcatt

SEQ ID NO: 594851 - DNA, 250 bp, Homo sapiens
tgtcttgctgcctgctagactctgggatcttggggataggacgctgttgagattctcactatatgtcctttagttctagggcctccttcagactctcgcactcacttgtgtgtttgtgtatgttgctgtgccgatttgtctggttggcactatcatccagtgtgcgttcgaatcactgttgtgatgctgtctgttgcgcgtccatgactggggtcatcaggtggcgggcgagactgcgtaacgttctgga

SEQ ID NO: 594852 - DNA, 507 bp, Homo sapiens
  misc_feature (497)..(497): n is a, c, g, or t
cacttatgaaactaatgagaaacacccgcatgctgttggagagagtgagtgcattttcaggcccagcatttgggagcttcagtcttccgtaattcaatgcatgacaatagatttattattgaagaaatgaagaaagaggtcaggcaaaaaaaccagcaattaatcatttgaagacactgagtcatctactattttatgtcagaaatcttgtagccatgtttacataataataaaacagctataagagggcagatgttttaggcctagacattcgctagtcagtaacatgtaaatgtgagagtcctcgtggttacggtttcacacctttccatggcggttgccagtcagtttttccttgctgttcataagctaccaagtaatacacatttgtcttcactctggtctgtggtcccagctactcgggaggctgaggcaggagaatcgcttgaaccagggaggcagaggtcgcgttgagctgagaacgcaccattgcattncaacctaggg

SEQ ID NO: 594853 - DNA, 358 bp, Homo sapiens
  misc_feature (15)..(15): n is a, c, g, or t
acctcatttatcccngcaacaaaaatttggcccaaatatttattgagccctttaccatatgcccagacagtgttctggatagtaagaatatatccagtgaacaaaagacaaaaaatttcctaattttatggagcattttggtagcatttttcctaatttatttttagtttttaagttttaacttttattatagattaaagggtacatgtgtaggtttattattacatgggtaaattgtgtgatgctgaggcttggggtcccaatgatctcatcacccaggcaataagcacagtacccaacaggtactatgatcggcatcactgcactccatctgggcaacataacgagactgtatcta

SEQ ID NO: 594854 - DNA, 249 bp, Homo sapiens
cctgtcagtctgtctgggcgcaggtagagcgtggttccgtcgccgcgcaaccaggaccggcccagtctcctcaagaagttccgagaagccagctggagattcacatttagcatctctcatctcgcattgggcaaaggaactcttcgagacttggccacagtggccataaggatcacctgcagaatggactctctcaaagcagatcccaggggcaggtttagcaccgggtccccaagagcgacggacagg

SEQ ID NO: 594855 - DNA, 461 bp, Homo sapiens
  misc_feature (404)..(404): n is a, c, g, or t
cacttatgaaactaatgagaaacacccgcatgctgttggagagagtgagtgcattttcaggcccagcatttgggagcttcagtcttccgtaattcaatgcatgacaatagatttattattgaagaaatgaagaaagaggtcaggcaaaaaaaccagcaattaatcatttgaagacactgagtcatctactattttatgtcagaaatcttgtagccatgtttacataataataaaacagctataagagggcagatgttttaggcctagacattcgctagtcagtaacatgtaaatgtgagagtcctcgtggttacggtttcacacctttccatggcggttgccagtcagtttttccttgctgttcataagctaccaagtaatacacattttattcatctttgttntcaacggcggcgtcacccccttcatccaccacaccatcatgcattcctatcagctat

SEQ ID NO: 594856 - DNA, 1837 bp, Homo sapiens
agcgggtcgaggccccgcgcccgcagcccagaccggaagggccggcggacgctcgactagagtcggctcgcatggccggggctccagcggctcccgatggattgccatgtgcgtgcgtgttgtctgctggcgaacgaggttggtggcagctgattgctgtgtgctcagctgcctgcggggatgtggggccatcggtgctgcccagacagcaccacccaagcatcctggctccatggcctcactgggacgaacgaaagtcacgtcccgtgccaaccctcgaggcccagcccgggggtaccccacccggccatggggggcatcgcagatactttacccatggaactgggcctgggttcatcctggttccctcatgggacagaaatggcatgtacgccggaccaggtgaaccgtgggcgtatatcaccaagaaagccccacggccgttcatccccaatgccgcccccaagtggcgattcccggctggattcccgtggcacccaggccacgccttcagcccccgggggacccggttttatccatccgtttggcaacccttggaagatggagacaaatccgtcgcagcagttccccttcacaacggcaactaaacagtggtgtgggcccattatgtgccaggtgcaataacttttatttaggagtttccgcgttagtgaggtgaaaagcagtatttagtgtggggaaaaagggatttttctcacgctttcatatgggggtggatacacccgaaaggtatttgggataaagcggcaaatttaaccgtttgtgtaggggggtgtatagttgccacaagagaaaaccgactttattgatgagcatttatatgcagatttagtggattattaaaacgaaacgttgatgggggccatgggattttaagcaagagagtttgcagccggttatattcacaatggggagatgggtactccgacatagaggaggacgacatatttatacggaacgtatgttgatacgggaccctatgggtgggtatagactttggctaaaagggccccattgtgggagtggtgcactacttcgcatgttggtgtgcaaaaaggtggtgacatttatgtacaatacaagttggacagcacgagttacccgcatcgcgcttttgtggagtaatcataagcagtgtgaagttcatgtagacctctgtttggggcagcgattttagtgattagttacaagccctgatgttgtgagacaactcgatgctgagttaaatacactttgcccaacatgtgctacgacgatggggcaacgcgcaacatggggcaacaccagtgggagggaggagaatttgtgtacacgcgaggtggtcccatgtagtagatggtgtgagcaaacagggggatgagattctacaaactgatgtgtggtacaccgacagtttttatacacaactgttattgaattagtgagattgataaccgtgttcggggatttacgtgggacacaacatgagcaaaacctcgttatatgtggtgtagttcactgctacaagtaagaaataatttcaacccaccctatacaactttagtaatcatatcgggagggtggctatatcacgactgatgcggggtaataaatgacggagcggacgattgtacttaccgaccagacaggctttcacacaccaataaacacttattacataattatatcgaccacagcagctggatgatactacaacaacgggtgattcccactgctgtgtgttacatacataacgtcacatctaacacacaacaagcaacgtatcagtacagaagagcgacgcacgagccagacgacaccagacgcagccactcgg

SEQ ID NO: 594857 - DNA, 303 bp, Homo sapiens
  misc_feature (102)..(102): n is a, c, g, or t
  misc_feature (106)..(106): n is a, c, g, or t
  misc_feature (108)..(108): n is a, c, g, or t
  misc_feature (110)..(110): n is a, c, g, or t
  misc_feature (115)..(116): n is a, c, g, or t
  misc_feature (119)..(119): n is a, c, g, or t
  misc_feature (123)..(123): n is a, c, g, or t
  misc_feature (128)..(128): n is a, c, g, or t
  misc_feature (152)..(152): n is a, c, g, or t
  misc_feature (154)..(154): n is a, c, g, or t
  misc_feature (177)..(178): n is a, c, g, or t
gttgcaagcactcgaaacagtaaatggggtagcatggaaatggacaggtaaggagggccttcagtggagctcacagacaggcaacagggactttttcccctngtcnancnacccnnggntggnagccnccctccccacacccgcccctgtgntntgctgtctggaggccacgtggannttcatgagatgcattctcttctgtctttggtggatgggatggtgcaaagcccaggatctggctttgccagaggttgcaacatgttgagagaacccggtcaataaagtgtactacctcttacccct

SEQ ID NO: 594858 - DNA, 488 bp, Homo sapiens
cacttatgaaactaatgagaaacacccgcatgctgttggagagagtgagtgcattttcaggcccagcatttgggagcttcagtcttccgtaattcaatgcatgacaatagatttattattgaagaaatgaagaaagaggtcaggcaaaaaaaccagcaattaatcatttgaagacactgagtcatctactattttatgtcagaaatcttgtagccatgtttacataataataaaacagctataagagggcagatgttttaggcctagacattcgctagtcagtaacatgtaaatgtgagagtcctcgtggttacggtttcacacctttccatggcggttgccagtcagtttttccttgctgttcataagctaccaagtaatacacatttgtcttcactctggtctgcagtgaaaataaaatgagaagagaaagaagaagatatgaagtggaacaatgtggttgggaaattcccatatctttacaaaaa

SEQ ID NO: 594859 - DNA, 243 bp, Homo sapiens
  misc_feature (39)..(40): n is a, c, g, or t
  misc_feature (74)..(74): n is a, c, g, or t
  misc_feature (103)..(103): n is a, c, g, or t
  misc_feature (116)..(116): n is a, c, g, or t
  misc_feature (118)..(118): n is a, c, g, or t
  misc_feature (192)..(192): n is a, c, g, or t
  misc_feature (198)..(198): n is a, c, g, or t
  misc_feature (204)..(204): n is a, c, g, or t
gacgccgagactggcaaaaccactgccgcatcccggtanncgagcaaccatcactgtgagcactacaaggatcnccatcacgatgcgaagcacaccccgctcngcactccggtggncnagaagtacagtcgaatatctcccacgagctttcgttgcgcgagtaccgtaataattcgcaggctggccgcggcnagcccnacagangccacacagaacagggcgagcaggatcccgatagcgcgg

SEQ ID NO: 594860 - DNA, 448 bp, Homo sapiens
  misc_feature (85)..(85): n is a, c, g, or t
gctgacctagaggatccctccacgtcgaatattgaaagtgctgaggtgatacatagctttggatgcaagagccaaacctggaaantggtcagcctttgaatgcctgtaaactttgtttcctaaatttttttttttttattggagacaggtgttccctaattttggccgaggttgctctatgaactacttgggctcagtgtgatcttccgtgcctcagcctccccgagtagctgggactaacagtgtgcccactaccattgctgggcttatttttcctagggttggcaaacaattaaaataatacattatttaagggttaaggattttcctcctaattttgtaatccattttgtttgaaattcatccacttttttcaaataaagctattgttaaggatattctttccagcggaactaaattcaccatttttatatttgtatacataagg

SEQ ID NO: 594861 - DNA, 295 bp, Homo sapiens
  misc_feature (74)..(74): n is a, c, g, or t
  misc_feature (94)..(94): n is a, c, g, or t
  misc_feature (98)..(98): n is a, c, g, or t
  misc_feature (100)..(100): n is a, c, g, or t
  misc_feature (102)..(102): n is a, c, g, or t
  misc_feature (107)..(108): n is a, c, g, or t
  misc_feature (111)..(111): n is a, c, g, or t
  misc_feature (115)..(115): n is a, c, g, or t
  misc_feature (120)..(120): n is a, c, g, or t
  misc_feature (144)..(144): n is a, c, g, or t
  misc_feature (146)..(146): n is a, c, g, or t
  misc_feature (169)..(170): n is a, c, g, or t
atactaaaccgtaagttggggagtgagggcttggccagtcttgaattggccgttaggggtgcccatagctcggnacccagtgctttcgtccctngtcnancnacccnnggntggnagccnccctccccacacccgcccctgtgntntgctgtctggaggccacgtggannttcatgagatgcattctcttctgtctttggtggatgggatggtgcaaagcccaggatctggctttgccagaggttgcaacatgttgagagaacccggtcaataaagtgtactacctcttacccct

SEQ ID NO: 594862 - DNA, 482 bp, Homo sapiens
gaggatccctggcatcactgtcagtgtatgcagatgaggaaaaagactgttagttttcaaggtgaacagtgcatcccaggtgtagtatgtatatatccaaggattctggttatttacacccaataatggaaattcaatattaccaccttgacattccattgcacaccatgcttctatggtagaaaactcatacattctatttggtttcagtaacttggttacccaacccaagttctagagtcattatggcatgcaaacagtcttctaaaggcatctgaaccatatgaaataaaaactaggtcctctcttgaactcccaaagggaatatctctctggctaactccaggaatttggtcagggatatatggagccaagattgtagaagctgaatcggtatataaagttactctgacactctgggaggaaatttaggccaatccgtaatagtgagtagcaatctcatacactgacagtgatgggca

SEQ ID NO: 594863 - DNA, 184 bp, Homo sapiens
tctcccttagtaggaatccttcttaatacaaggagtgagaatgcagaagagcgaaccacaaaggaattccagctctaaccccatagtacctgggagagctgctaacagccatggagataaaagaggcgggtaggtaacacagtgactgagtctgacagactgcaaagcacctctccagcgaaag

SEQ ID NO: 594864 - DNA, 384 bp, Homo sapiens
  misc_feature (69)..(69): n is a, c, g, or t
aagaatataaactttataagtatgattataatagtggagaagaattacaagcgtgcaagttcgctttgntcctattcactgtgccccatttagtcctgatggagaactctatgccagtggttcagaagatggaacattgagactatgtcaaacgtgtggaggaaaaacgtatggtctttggaaatgtgtgcttcctgaagaagatagctgagagcttgcaaagccaaagatttgttttccagagacaacagaagaggggctagaagaaattgcttcagagaattcagattgcatctttccttcagctcctgatgttaagccctgagcgtcaatcatatgttgcagttagtatacaactgactaaaacaagcaagcagagaaaag

SEQ ID NO: 594865 - DNA, 112 bp, Homo sapiens
  misc_feature (49)..(49): n is a, c, g, or t
gtattcgtctatctactgtaatatatgtgtgtcacgataacctatgagncattgatatcatagctcagacattactatgtatcgcatggtctttttcggagtagtaagtaca

SEQ ID NO: 594866 - DNA, 87 bp, Homo sapiens
acggccgtgtattactgtgcaagagcccctatatggttcggggatcatccggactactggggccagggaaccctggtcaccgtctcc

SEQ ID NO: 594867 - DNA, 805 bp, Homo sapiens
gagaccaaggggtcaggaggtgggcgccctccatccttcgagaagcttcccaggctcctctgcttctctgtctcatgctcccaggctgcacagcaggcagggagggaggcaaggcaggggagtggggcctgagctgagcactgccccctcaccacccccacgacccttcccatttcatcggtgtgggacgtgacgaggtgtggggcgtgagcctggggaggttgggagggtcgcatcactagccacccatgctgtgctatggagaacccgcccacgtcaacgcaatcccccagatactcgaacatcctggttggtctgtccgcagtggggttggcagtgcatgtgtacattatgtattcgtgactgaaacgttatgcgatcagtaacgtgataataaagtctgactaagtccttgagaacatgtttgaggctagacgcgggacggggggccaggaccccagacccacgatgactccctggcgggcgactgacgggtcccgtggattaactaaacggccccagatagcattttcaacaggccgggggtcagacgtctttccccaacgaatttccacgtgggcagaaggacatactataccacacaaacacatcctcggtcatgggcgatgggcacgcagcacgggaacaccacctaccaaaatggtaggcagcccctaggtgcaacagggaggggttgccaggggtatgacaaccgttgagaagatcgatgcaaattcacaccagggtgggtccacgacggtcatacacatcgaagaccaaaggtttttcataaaatacgaacaca

SEQ ID NO: 594868 - DNA, 244 bp, Homo sapiens
gacgttctgtagtccgagaaacaactcaatgagctgaacatcatgacacagcaccgggccaagctgctcacggacgcgagctgctgctggactggtggactggcagtgaggaggctgaagagggcgccgagagcagccaggagccagtggcacacacagtgtcggaacccaaggtggacatcccgcgcgactcaggctgctttgagggctcggagagcgggcgcgatgactcaggcgcggtcgg

SEQ ID NO: 594869 - DNA, 784 bp, Homo sapiens
  misc_feature (9)..(9): n is a, c, g, or t
  misc_feature (85)..(85): n is a, c, g, or t
  misc_feature (90)..(91): n is a, c, g, or t
  misc_feature (167)..(167): n is a, c, g, or t
  misc_feature (194)..(194): n is a, c, g, or t
  misc_feature (226)..(226): n is a, c, g, or t
  misc_feature (250)..(250): n is a, c, g, or t
  misc_feature (253)..(253): n is a, c, g, or t
  misc_feature (263)..(263): n is a, c, g, or t
  misc_feature (271)..(271): n is a, c, g, or t
  misc_feature (281)..(281): n is a, c, g, or t
  misc_feature (289)..(290): n is a, c, g, or t
  misc_feature (297)..(297): n is a, c, g, or t
  misc_feature (304)..(304): n is a, c, g, or t
  misc_feature (311)..(312): n is a, c, g, or t
  misc_feature (361)..(361): n is a, c, g, or t
  misc_feature (363)..(363): n is a, c, g, or t
  misc_feature (367)..(367): n is a, c, g, or t
  misc_feature (384)..(384): n is a, c, g, or t
  misc_feature (392)..(392): n is a, c, g, or t
  misc_feature (461)..(467): n is a, c, g, or t
  misc_feature (469)..(469): n is a, c, g, or t
  misc_feature (480)..(480): n is a, c, g, or t
  misc_feature (482)..(483): n is a, c, g, or t
  misc_feature (485)..(485): n is a, c, g, or t
  misc_feature (515)..(515): n is a, c, g, or t
  misc_feature (535)..(535): n is a, c, g, or t
  misc_feature (579)..(579): n is a, c, g, or t
  misc_feature (729)..(729): n is a, c, g, or t
taagtgtanaggtaagaactggctgcctccacccactcccagggagaccaaaagccttcatacatctaagtagggggcaaaaaanggggnngaaagggcacgaaggctcatcattcaaaataaaacaaaataaaaaagtattaaggcgaagattaaaaaagagtttngcattacataatttacacgaaaggcgntgctatcacctcccctgtgtggacttgggagngggctgggccattctccttagagngangtggggtggnttttaggntggcaagggncttcctgnnacaacgngtctcanatttggnntgactattaaaaaaacaacaatgtgcaatcagaagtcctcggccacatngngaantttgggggatgctcgcnccaaccgnctgctgtcaccttcaccgttccagtttttaaatcctgagtcaagccaaaaaaaaaaaaaaaccaaaacnnnnnnngnaaacaaataangnngngccaatctcatcttgttttctgcgcaagtnaggttttgtcaagaaagggngtagacgcgaactaagtcatagtccgcctagaagcatttgcggnggagcgatgggggggccggactcgtcatactcctgcttgctgatccacatctgctggaaggtggacagcgaggccaggatggagccgccgatccacacggagtacttgcgctcaggaggagcaatgatcttgatcttcattgtgctgggngccagggcagtgatctccttctgcatcctgtcggcaatgccagggtacatggtgg

SEQ ID NO: 594870 - DNA, 1236 bp, Homo sapiens
  misc_feature (35)..(35): n is a, c, g, or t
  misc_feature (64)..(65): n is a, c, g, or t
  misc_feature (68)..(68): n is a, c, g, or t
  misc_feature (77)..(77): n is a, c, g, or t
  misc_feature (273)..(273): n is a, c, g, or t
  misc_feature (285)..(285): n is a, c, g, or t
  misc_feature (309)..(309): n is a, c, g, or t
  misc_feature (312)..(313): n is a, c, g, or t
  misc_feature (315)..(315): n is a, c, g, or t
  misc_feature (333)..(333): n is a, c, g, or t
  misc_feature (342)..(342): n is a, c, g, or t
  misc_feature (359)..(360): n is a, c, g, or t
  misc_feature (395)..(395): n is a, c, g, or t
  misc_feature (398)..(398): n is a, c, g, or t
  misc_feature (408)..(408): n is a, c, g, or t
  misc_feature (412)..(413): n is a, c, g, or t
  misc_feature (425)..(425): n is a, c, g, or t
  misc_feature (427)..(427): n is a, c, g, or t
  misc_feature (431)..(431): n is a, c, g, or t
  misc_feature (434)..(434): n is a, c, g, or t
  misc_feature (437)..(437): n is a, c, g, or t
  misc_feature (440)..(442): n is a, c, g, or t
  misc_feature (444)..(444): n is a, c, g, or t
  misc_feature (446)..(446): n is a, c, g, or t
  misc_feature (449)..(449): n is a, c, g, or t
  misc_feature (453)..(455): n is a, c, g, or t
  misc_feature (457)..(457): n is a, c, g, or t
  misc_feature (464)..(464): n is a, c, g, or t
  misc_feature (468)..(469): n is a, c, g, or t
  misc_feature (480)..(480): n is a, c, g, or t
  misc_feature (484)..(485): n is a, c, g, or t
  misc_feature (498)..(498): n is a, c, g, or t
  misc_feature (531)..(531): n is a, c, g, or t
  misc_feature (535)..(537): n is a, c, g, or t
  misc_feature (542)..(542): n is a, c, g, or t
  misc_feature (545)..(548): n is a, c, g, or t
  misc_feature (556)..(556): n is a, c, g, or t
  misc_feature (559)..(560): n is a, c, g, or t
  misc_feature (567)..(567): n is a, c, g, or t
  misc_feature (571)..(571): n is a, c, g, or t
  misc_feature (574)..(575): n is a, c, g, or t
  misc_feature (578)..(580): n is a, c, g, or t
  misc_feature (614)..(614): n is a, c, g, or t
  misc_feature (616)..(617): n is a, c, g, or t
  misc_feature (619)..(619): n is a, c, g, or t
  misc_feature (621)..(621): n is a, c, g, or t
  misc_feature (624)..(625): n is a, c, g, or t
  misc_feature (640)..(640): n is a, c, g, or t
  misc_feature (662)..(663): n is a, c, g, or t
  misc_feature (685)..(685): n is a, c, g, or t
  misc_feature (704)..(704): n is a, c, g, or t
  misc_feature (706)..(707): n is a, c, g, or t
  misc_feature (709)..(709): n is a, c, g, or t
  misc_feature (711)..(711): n is a, c, g, or t
  misc_feature (714)..(714): n is a, c, g, or t
  misc_feature (724)..(724): n is a, c, g, or t
  misc_feature (738)..(738): n is a, c, g, or t
  misc_feature (913)..(913): n is a, c, g, or t
aaaaagttggcaaataaaaaggaattgaagcagcngcagggaagaagcaagaaatatcaagctnntanaaaccactnagaagataaacagaaaaactttctatttttacgactttgggataggaatatggacatagcaatgggctggaagggtgcccaggccatgcagtttggacagcctttggtttttgacatggcttacgaaaattatatgaaacgaaaagaattgcagaatactgtttcccagcttttagaaagtgaaggatggaacagnagaaatgttgancctttccatatttatttctgcaanctnnanatagatgggctttgcacngagagttanttaaacggtatcaagannaatgggacaaattgcttttaacatcaacagaaaantcncatgtagatntatnnccaaaggacagnantatntanttnacnnnanantcncccnnngntatgacnactnncaggcatgacnaagnntatgtaattgggncttttgttgataagagtatgcagccaggcacancccnnnccaanccnnnncggctganccnngcaactnaatnccnnccnnnagataaatatttacaatgggaaattggtaacaananncncnccnnagatcaaatgatacntattttgttatgtctgaaatannatggtaattggcaagaggctcngcaattcgttcccaagagnanncntnctngttttctggngatttctcagcatnctcaagagtttatcaacagactaaagaaggcaaagacttaattcattttcaaaaggttctctgaatgtgcacagaacacgtggctcaaatgagaacatttgatggcttaaaaagtaaatgcgttagaaatacagttctgttaatgtatttcttcccaaacaattcatttttctcntctaaaggtagtctttcccaactgactgtagggttgtgtcttttcccaattaaatatgtacagaactttgggattaggctttgtttcctgtagaaagataatcaaaataagttgtccaagtattgctgaacagaataatctttatcccagttaaatagttgcaccattggtagacttttttatgtaggttcctacagggtggtgccctggggtgggcttgcaagctatgctaccccttcccccatagctttccccaggcctccctttgtctgtatgatccgacatctctttgtcagtaaactggttaatgagattccttcaaa

SEQ ID NO: 594871 - DNA, 205 bp, Homo sapiens
cccatccttccctctatacaatccttccctcctcacacaggctgtaggaagcatggctctggcaaggccgctgctcctgctctcaaggggctgcttttcaaccaaaaaccactggagccccctctgagccttgcacaaccactgactatttttttgccttacccagggtacctcctacctcagtctacgtgaaaaaaggaaggat

SEQ ID NO: 594872 - DNA, 234 bp, Homo sapiens
  misc_feature (1)..(1): n is a, c, g, or t
natcagcatacaagtacagactgaaaattaattcatggatctagcaagcactgcaggactgtcactcaccgaagcaggaaatatggttactacatacactgactgtcaggacagtagttctaatctattctcactaaatccaactggctagactcttcctcattatcttagatgcaaaccaattctcctgtgaactatcttagacaagtgcatgcatttcactactataacatt

SEQ ID NO: 594873 - DNA, 474 bp, Homo sapiens
  misc_feature (1)..(1): n is a, c, g, or t
  misc_feature (69)..(69): n is a, c, g, or t
  misc_feature (72)..(73): n is a, c, g, or t
  misc_feature (75)..(75): n is a, c, g, or t
  misc_feature (78)..(78): n is a, c, g, or t
  misc_feature (95)..(95): n is a, c, g, or t
  misc_feature (128)..(130): n is a, c, g, or t
  misc_feature (133)..(138): n is a, c, g, or t
  misc_feature (179)..(179): n is a, c, g, or t
  misc_feature (195)..(195): n is a, c, g, or t
  misc_feature (199)..(199): n is a, c, g, or t
  misc_feature (202)..(202): n is a, c, g, or t
  misc_feature (206)..(206): n is a, c, g, or t
  misc_feature (208)..(208): n is a, c, g, or t
  misc_feature (217)..(217): n is a, c, g, or t
  misc_feature (282)..(282): n is a, c, g, or t
  misc_feature (370)..(370): n is a, c, g, or t
  misc_feature (467)..(467): n is a, c, g, or t
nggaggagaggagaatttttccaaaatctgacggaaagaaaagaaacaaatggttcagatgggacgganggnngncgngggggggggggtgagtnggagccaggggggctgcctggggtgggggagtnnnttnnnnnntgggacgagttttcatcggctccaggaaagtttcttctgtnaaaagacgcttttganaagnttntttntncgtacaatntgagaaatttttcgaacgttaagtcccccaaaccaaagtttgtgatgtgggatggttggctcggntcccgaggtgggtgggcctatgaggtggttgctaagtcgacgcaagggcggcgggggtggtctcagggatggacaaggggatggagtngagtttgttcagcccccggggctcacaggggagggggacggcggagtcggtggatgacttgtcaaactcgggcgggccctcgctgttcgcatccccnttcacgg

SEQ ID NO: 594874 - DNA, 1231 bp, Homo sapiens
agcggctggaactcctggattggtgttaacggtggtaatttcccccatataagcatgtagcaatcactgagctctgagctagatgaaatctcttaaaattctctggttgtcttcattacggactgactgaggctgacgtctacttctctcactatgaacagctagatcaataacagcagagttctcactcagaatgctcagctacttaactttcccactgcaccaaactgtctctacactaaactgtgctgtactcctcctccaacaagcttaacagctcctactcctgcgctgatccccaccgacaactactaccgtgaaacagaccactgccactgtccccggtaacatacccacccagcagcttcctcgtcacaggccgtgcacccaacgctgccactcctcacactcccgtgcgacacactcatcctctcactcacccccctccctaaacacctaccacctcaccctactcacaccacatcactccccacctaaggcgtgctgctgcacgcccaaaacacctcgccactacttacctcccacacaacttggccacgacgccaccaggacaagccccccccctcacccgcgcaacaacacaggcccctcactcaaccacgcctgatctacaacctggcaagcgacccttggatcgcccatcacatctaccccattataaaccgttacaccctttttggtgcccttgaaccctttctggtgtccctggctacttggaggaacctccctccctactacactcccatttcaaaacacaccacaaccacacccacctcacacaccggcacaaccgcacgcggcgcaccaaacccccgctgctacttacaacacggacaccccctacccccgacaactacccccaccggggatcccccgcgcacccgcacgacacccagacacaccccccccacacgaacaacgcgccccatcacccaccacttcacccaccgcccaccccctccccgaccgccccgccctaaacgaacacccacactcgaacccacacgccgcctccacccacaacaccccggaccgaccacacagaccaccagcgcccgcaccagaccggccaccaccaccaccaagcctcgccccgagcccagccacatcggccgcacagttgaaccaaccccacacgcacaccggacgcggcacaaccccaccaaccccgcaagccacacccgggcaacccgccgcgcgcgacccccag

SEQ ID NO: 594875 - DNA, 143 bp, Homo sapiens
ctatactctatacgacacctccaaatggaggaaatagcaaagaaatcaatctagagctgctcgcatctccctgctgctcatcgagtctgtggctggagccctgtgcgtgttcctcacggagtatgtgcggacaagaaccgtgg

SEQ ID NO: 594876 - DNA, 1022 bp, Homo sapiens
  misc_feature (356)..(356): n is a, c, g, or t
  misc_feature (372)..(372): n is a, c, g, or t
  misc_feature (382)..(382): n is a, c, g, or t
agcgggcggggccgggggggggatggcgcacgctacgaggggcggagcggtgggcgctgagagtcgctgaggatccggaaacgcgccgaatagggtgcggcgccagtaggacgtcggcgggccgggaaggggccgggggcggggacagggaaacgttcagtggccagcggaccccgagggtgaagaggggccagacgcaggacctgcggcatgggaccccgtagtgctgaatctgcttgcctctgggatgaagagagtcgaagacagtaggggcagcgcgctgtgtctgcttctcgagacgtcgcaggcatcggacaggtgctatgggcagaggcgcctcttgtaccctgtaagangctgattcttggaccngtgcacatgngtcctccatgtgatggtgaccctaccgaggcactgtgcgccaaacatacggttggtccagcgggagattggctcgggacccatctcgagtcacctatcgtggatcgcaaaggctgtgggggcggtgtctcacgggggttagtaacgacactccgtgagggtacacgaagttggggccagcgtctcgttgagatgcaggcaggggaatgcatgtaggactagaagtacgtgttaggggtaagcaatcgggtgaaacacctgtgagcaaaaacagcgtagaaacgccccaatgtcatttgcctcggttgattctcacgcctgaagcctaaggcccggaactgccaggacaatgctacattgtctactcacattcggaattgtcttttctagtggcgaccccaaaaaggccacagtatgtaggccagattaccactcaccggggaagtgggacacatttggacactttttggagaaccaccccattggaaagcttcccacatgttggcgtggcgaattgagggaaggctatgcgtcggaaacatttacaaatacaccgtgcgtagagttggacggtccaacagttggcccgttttgagaccacaggtttctttcagagagaggacaagagctccacacacatg

SEQ ID NO: 594877 - DNA, 93 bp, Homo sapiens
cagtgtagcccaaagcccccaaccccccccagtggaaagctcctgcatcatgtgatcgagcttgtgcataaataaagccggggtttttcccca

SEQ ID NO: 594878 - DNA, 308 bp, Homo sapiens
aggggggggggaaaaagcccccccttttaaccgggataattttttggttccctttttaaaagggtttttttggagggttttgcccccccctttcccaaaaattttttgggtttttggcggtttttttttttttttggtttaaaaggggcgggcccttttttttgggttttttgggtttattttttttttccccgggggggggccctctcccccttcgggcctttgggtttggggaatttttccccctttagccccaagggggaaaattttttcccaacccatttttttttttttttccttaaaaggga

SEQ ID NO: 594879 - DNA, 112 bp, Homo sapiens
  misc_feature (73)..(73): n is a, c, g, or t
  misc_feature (99)..(99): n is a, c, g, or t
gcggagagactcccaaaatgtgccaagaatttcccggtcccaggcagggcaggggaaactaagggcaagcagnatacagggcgagggatgtggcaggtnagggggctcccgc

SEQ ID NO: 594880 - DNA, 936 bp, Homo sapiens
cttaatcggccacctgccgcgttctacagcctctttgcatctcggatttcggggcggctccctcccccatctttccctgcttctttgcaccccgctttttctgcgtttcgctcgaattttggagccgtctggttttgcaccccttttgttttgcttctaggcggtgtgtggggtgaaggtgcctcggcatccctttccctggttatctttccctgttttgacagcccccctttctatcgcagtcggggggcctagcctcggtgcaccttcgccgcactgccagcagaccacagtgcgtggctgtgcaccccggaatttgcagcagctgtatatctgactggagtctccctgcctcgctcccgcgcgcatttggtgcgtggagggcttcagcgcgcgacgccccggcttctccgcagcccccagcagcgcgccgggactcgccccgtgcctccaagatggtcatccagaaagagaagaagagctgcgggcaggtggttgaggagtggaaggagttcgtgtggaacccgcggacgcaccagttcatggggcgcacgggaccagctgggccttcatcctcctcttctacctcgtcttctatggtttcctcacggcatgttcagcctcaccatgtgggtaaatgcttgcagaaccggtctctgacatacccccaagtaaccaggatcgactggccacacaggcttgatgatcgaccagactgagaacctgttgtcttgtcacttgtgacttgaagctggtcagtgttcggaagtcacagtcttgacttcaagatcctccgcaaaaattgtgcgtcgggatattgcccgattgggtgaacaaaaagtgccctacgggccagtgtttgctggccccatttacacgccgtttaaaagccattggcacatgtttaaaaaaaacttcggataaacaaagatagag

SEQ ID NO: 594881 - DNA, 453 bp, Homo sapiens
gccgtccagtactttttgctgtgcccccaccagagcctaaaggatgatccatgggatcctagccacgccgggcatgggagccgctgggaacaagccggagctgtatgaggaagagaagttgttcaagaacgcccgggagagggagaagtacgacaccatgcctgatctgtatgcagggacaagacaatgcttgccctgaagaaggactacatcaaggactgagtctaccccagctagcaggtccagggctcaagaatcagctctattgacgaattctgccgcatgatcagcctggactgcccgctggccatgtagcggatcagggaggacctgcccatcaccatcaaggactacaagggcaacctcaaccgctgcatagcagacgtggtctcgctcttcatcacggtgatggacaagctgcgcctggagatccgcgcaatggatgagatccag

SEQ ID NO: 594882 - DNA, 159 bp, Homo sapiens
ggagtttgagatcaactccagcaacatagcgagacccctatctctaaaaaaatttaaaaattagccgagtgtggtagcacgcacctgcagtcacagctactcaggaggctgaggcgggaggattgcctgaacccggaagctgtaggatgcagcgatgct

SEQ ID NO: 594883 - DNA, 455 bp, Homo sapiens
tttctgggagggaagcgggccccaaagcaggccttttgatttttatttttttaaagcgaaattttaagaggttagattttatccaatttgtaggggttctagggattttttcaaaaatgcttggttgcctccactgttcccccctctgctcttggaggggatggggacaggggtggggtccaaacccctggaattttggatcctgatgtctttgttaaggccgctgaagaattatttttttttttttataataagggataacccccccttttttccttcctttcctctacccttttttgggttttgggttgggtggggccggccccctggggtttttttttgccctggccacttttaattgccctggcccggttgttcaaagtccaataactcccccttgttaaccaactggggtactgccccaagccgccctttttaatccgccttaccttaga

SEQ ID NO: 594884 - DNA, 626 bp, Homo sapiens
gatggctgctgagaagcaggtcccatggcggcggcggcggtggcggcggtggcggctgcggtggcggtggtggccgcggtggcggaggtggaggcccgatgcagaagatgatcgaccctacggacggttcgtaggcaatcaacgaattggggatagcgtgggttttgtgcattcttctgattattcaggtaatccaggacagctaggagggtaagcagcatgagacagtctgtcacgatggttactggggagcgaacgtggagcctgctatgactgctgcacgctcttacgatagatcctactcccagctttcaacctcatcggtgcaaatcgatgtagatctccgaacattcccgcatgcgagggaaacgaaacacgtgaactcttgcacggacgccttcgtagtgccgcgattccatgtcctgcgtaccttatgtccgtctctatcgtgttgtcatgcttgggatgtgttcgatgagtaacgcctggggagcgctgcgctgctcatgtgctgcttttgactcccacgggatgcgtccaggccagtgacccccccgtgatggcagtcggcttctcgacttgcctagtcttcgggcctacctgctttagctccgttcagcgcgttg

SEQ ID NO: 594885 - DNA, 461 bp, Homo sapiens
tctagaggatccctctgtgctgggaggagggggattggcaggtcataggacactagtggagggaaggtcagcagacaaacaagtgaacaaaggtctctggttttcctaggcagagtgtttggtgttcctggggtacttgagattagggagtggtgatgactcttaaggagcctgctgccttcaagcatctgtttaacaaagcacatcttgcaccgcccttaatccatttaaccctgagtggacacagcacatgtttcagagagcacagggttgggggtaaggtcatagatcaacaagatcccaaggcagaagaatttttcttagtacagaacaaaatgaaaagtctcccatgtctacttctttctacacagacacggcaaccatctgatttctcaatcttttccccaccttgcccccttttctattccagacaagaaccacacgccagcaaagaaccacag

SEQ ID NO: 594886 - DNA, 401 bp, Homo sapiens
ataatacctgtatacacattgaaagcacttaataagaataatgccagttgaaagtatacctgtctcatcagccgatcataaaataagctcctgtaaaaggcatagactcctcacacgtaaagactttgtgcgtcacagtcatgtgtccaacagttttacccattaaaaatacagccattcaagatatgtgtgcatcctttgcacctagaatccacttaaaaaacgtttgctcattaacctgtcttaaaacattattaaatgtaacacccctcagatgaaaccttcgcagaataacccatatcttatcttccatgtggctacagtcaaccttcagcaacagttcagcacccacatcttattcacagggtccagttcctaagtgttgcagattggcgcaaact

SEQ ID NO: 594887 - DNA, 305 bp, Homo sapiens
tggaagtattctggcctgctgcagtgagtgtgcaggctgacgctgcaactgtaactcgccatcgtggctggcgagccagtccagccccagtggctgagctgcctccaggtctgcagtctggcaaccaggtccagccgcactggcgggcggaatgaaaagcgtggctggggatcggcgcctgtgtcggcggcgatgcgcaacatcagcatggcttccgtgcggatgggcgcgccgccggcgtcgcgcagcggctcggtggccagctcgaagcggtgctcttccagggccgacaggatggcatcctt

SEQ ID NO: 594888 - DNA, 103 bp, Homo sapiens
gtgatgacgacaaggtaaggtataacgggctaaaggcttcccacattcatggcacgcaaacggtttctctccagttgtggatcctctgatgttgagcaaggtg

SEQ ID NO: 594889 - DNA, 425 bp, Homo sapiens
  misc_feature (25)..(25): n is a, c, g, or t
  misc_feature (33)..(33): n is a, c, g, or t
  misc_feature (60)..(60): n is a, c, g, or t
  misc_feature (63)..(63): n is a, c, g, or t
  misc_feature (162)..(162): n is a, c, g, or t
  misc_feature (301)..(301): n is a, c, g, or t
  misc_feature (347)..(347): n is a, c, g, or t
  misc_feature (377)..(377): n is a, c, g, or t
  misc_feature (381)..(381): n is a, c, g, or t
  misc_feature (425)..(425): n is a, c, g, or t
tttatttggcagctgctgcctcacncacagctnttgatatctaggaggactcttctctcncanactacctgtcaccatggcccaccgatttccagccctcacccaggagcagaagaaggagctctcagagatagcccagagcattggtgccaatggaaaggngatcctggctgcagatgaatctgtaggtaccatgtggaaccgcctgcagagtatcaaggtggagaacactgaagagaaccggcggcagttccgagagatcctcttctctgtggacacggccatcaaccagagcattggnggtgtgatccttttccacgagaccctctaccagaaggacaggcagngaaagctgtgcagagacatactcaaggagnaggngatcgtggtgtgaatcaagttagaccaaggaggtgctcctcttn

SEQ ID NO: 594890 - DNA, 546 bp, Homo sapiens
ggcgcacgtgctccatgggcctcattaactcgcaacagcgccacaatacggccgccgccacaaccggcgggcacatagataggccccctccgccccaccaatcggcaccggaatgaagatggggccccccaccgacgccaaccccccacaagaggttgggcccccgcgagcgtatcaccacccacgcccgcgttccacgccgagggggtaacaccaacaaacagcccgcgtcccccggagggtgcgaacgctcgggcaacattcttctcccccgggacaaaagtcttgacagtccgacaaaccacggcaccagacacagaggctggtacccaccacaccacacggaaccaggggtggatgcgccccacagaaccccgtggtagaaagaatgcagctgggcgcatcccaacgcacacccccgccctccccgtgggtacccagctcccccctatgcgccccgcccccgcggcccccaaaaacaggggccctccacgagagacctccccaggcagcaaaaaaattttaccaaaaccccccccacataac

SEQ ID NO: 594891 - DNA, 208 bp, Homo sapiens
tggggggggggcccccccccctttttttttcccccttttataaccccggggggcgcccccccccccgtttttttttttggcggggggggggggtttttttttttccccgggccccccttcccccctccccccttttttggggcccctttaacccgttttttttccaaaaccgggggggggcccgccccggtttcccccggttttttta

SEQ ID NO: 594892 - DNA, 980 bp, Homo sapiens
gggagaggagacgcatcatctccgctgactcgccgctcctacgtctcctcagagggagatgatggtgtggtgggcctggctcctggcctgcctgtctgggtcctggcacccgcctctccctggctctgaatgccccctccactccctgaccctgtggtgtgatttctccctgtgctggggcactcaatgctggcttccaaggcagcacccgggcccagtgcagctgggccatgcagcatgcatggcagcctccaatgcacctgcgtttgcccagctcaccatcgcagcacaggttcgctttcccgtggcaacagccaaaaccaaggctgctggcatgctgcagctgaaccagactgctgggccaacggagcccacccaatgctgtgccagacgtctaccagtgctgatgctgcgacgagctgctggctgctggctcgactcaactcatcctgccaccagctgccctggctggacggttgacgaggtgacaatctggtgcaccatggaccatgtgccacttgttgacgtgcacgaccgctccagagtgctgaaacccaaccctgcaggctggaacgccgatgaatcacgcctgtgctgcctagtagacatggcagcatgactgaatgcccaccctgtgcccgtctggactctggagcaggcaagacgggcgtcgcttgcgcaggagggcagcacccgggtccttggcaggccgcatccacgccggcaggcggcgccggggcactccagcgcagcacgctggccccgaccagccgcgcccaatgcaggaccgctttgcaccgccctggcccccagcgcccccggcccctaccacccggcgacggccgccttgcaacagcccgacttctgtcaaccgccagctacaatgaacgtgcgactgggcagcatccccagcacaccctgtgcagtgcacacccctgacaaagcgtgatacctggtcccaatcgctgaccgaccccatg

SEQ ID NO: 594893 - DNA, 91 bp, Homo sapiens
ccccccccccccccaggttttttttttttggtttttaaaagacgggttgggaaaaaaccccaaaaaaaaaaacttcccgtgggttccggga

SEQ ID NO: 594894 - DNA, 276 bp, Homo sapiens
attgtcctgtacataactggagagccttctaaggtctctcatcgctggctcagctacagcgtggctccggtccgcgtgctctctgctccacccgacttccattttggccaaatcaaccgcacccctaaatttctccgcacatttcctgccggctaggtcccagcatttcgagggtgagtgatggattctgtgctgtttgagagcaacgcctttgactactatgttagcactgaggagctgtggggaagcactccatatgcagcagtccaagtcgtg

SEQ ID NO: 594895 - DNA, 245 bp, Homo sapiens
aagatacccccgccagcccttaaccctatggtttagttgcccttttttaccttagagtgctgaattgggctaaatcgacccctgtggctaggagactatacactagcaatttaagtacctgccgtgcgacagcagaggcaggctgaagcatctagataccaggactgccctgatgacttgctgacaatcacgcatggcctatgacagagcagaccacacatgaggtgtctagggctgactgtaac

SEQ ID NO: 594896 - DNA, 212 bp, Homo sapiens
tttagatggagtctcattcactctgttacctaggataaagtgcagtggcctgatcttggctcactgcaacctctgcctcccaggttcaagggattctcctgcctcaggctcccaagtagctgggattacaggcacatgccactatgcctggctaacttttgtatttttagcagagatggggtttcaccatgttggccagggtggtgtcgacg

SEQ ID NO: 594897 - DNA, 339 bp, Homo sapiens
  misc_feature (48)..(48): n is a, c, g, or t
  misc_feature (94)..(94): n is a, c, g, or t
  misc_feature (96)..(96): n is a, c, g, or t
  misc_feature (107)..(107): n is a, c, g, or t
  misc_feature (116)..(116): n is a, c, g, or t
  misc_feature (133)..(133): n is a, c, g, or t
  misc_feature (138)..(138): n is a, c, g, or t
  misc_feature (141)..(141): n is a, c, g, or t
  misc_feature (144)..(144): n is a, c, g, or t
  misc_feature (174)..(174): n is a, c, g, or t
  misc_feature (257)..(257): n is a, c, g, or t
  misc_feature (275)..(275): n is a, c, g, or t
ccgggttccatgcccaaagggggaagcgcattccccaaccctcagccnctgcccgcccaggaaagccagtcattgccggttatgggcttccccncnaaaggcccttntgcagtggnagtgccacatccagttnttttnttntgntgctgctgtgtttagataattgaagagatntttgtgccacacaggattttttttttttttaagaaaaccctatagatgaaaaattactaatgaaactgtgtgtacgtgtttgngcgtgcaacataaaaatncagtagcccctaaggagcttgaattttggttcctgtaaaatttcaaattgatgtggtattaata

SEQ ID NO: 594898 - DNA, 364 bp, Homo sapiens
ttacttgtgctagtggcccagatgcctgctgagaggcagcgtagcagacgtccgggttcaatcccagctctgcctcttactggtggccttgggctagtggccttggcccctctgtgcctcagtttccccatccttgtgctgagagagatgaatggtggcctgcgtcaggccctcagggcggcccagcctgagtccggatggaggtgaactctgtggctgctcttggaatcttttctgggtgacttgttttctccttcacaagttcccaaatttccacgctggtcatgaattctatttcataaccagaaaaagcctgagagaccatcaaccacccagcccatgacccctagcagggacccactcg

SEQ ID NO: 594899 - DNA, 355 bp, Homo sapiens
  misc_feature (16)..(16): n is a, c, g, or t
tgggctggggaagagnggctgggatggggagagggaagaggtagggtgtgtcaagaatgaggaacagacacttctcaaaagaagacatttatgcagccaaaaaacacatgaagaaatgctcatcatcacgggccatcagagaaatgcaaatcaaaaccactatgagatatcatctcacaccagttagaatggcaatcattaaaaagtcaggaaacaacaggtgctggagaggatgcggagaaataggaacacttttacactgtgggtgggactgtaaactagttcaaccatggtggaagtcagtgtggcgattcctcagggatctagaactagaaatacctcttccccagcccag

SEQ ID NO: 594900 - DNA, 963 bp, Homo sapiens
gaagtaagaaccctctcgatatgacaggaatagcaaactggtaatattgccatgaaatgtggaagagtgttgtagctagatgctgatctgagaacatgccgtggagtgcatgccgaatagtgtgaagaatatgtgcaggaatagtatatgcacgactgttgaactatacacatcatccacgaaatagcttgcgtctatatgaaacatagaatggttcaatgggatccatcttgatctgtctcgagaatctggatgagtggcaaaatgaggagtagatggaacaagaatagtgctgctgacaaaatcctagaggatgggccatttagggtcttgacctcgattataagactatataggtagtgctaaaagaccatggatgtgtaagagatagatatgttgcttatgagctgagaagaattgcatagtgatgaggaggatgttgagtgctggggcgaaaggtatacaaacttagttgaaagtgttggtcaacaattgtaaaattgctctagaattgatgagatgaggtatacttggggaattggtatgtgcaaccaaaagatgtaggcattcattattatgttttgctgtagggctattcatatatatttgtcaaggatatagtttttcataaatggggtgtgagagtctggaatgtactagtgggtcgataagaagtatctgctgatatgagtactcatgtttggaagaggtatgaacgataatggtgcgtagggacacgtagcagggggatttcatcgatttcctaggatagaggttagcagtgatccggggttaaagagctttcgggggatgttccttttcagcaagaccttcgtgcgtggattttcatccccggcttcaacacagtccgatgcggggcatgcgcatctacgggaacgggctcggaccagactcaataaggtcgggtgttcacgcagcacaagatgaagcggagcccaaagc

SEQ ID NO: 594901 - DNA, 163 bp, Homo sapiens
gtcacgtaagatgcatgtacagttgcactcgacttccacatttgtattggcagggcacaaccatgattctcttcccgaggaaggtatcgctcaccattgtgaagaagagacaaagacggggcaacaagcagtggtgaatggggcctggtgacattcagggtac

SEQ ID NO: 594902 - DNA, 248 bp, Homo sapiens
  misc_feature (59)..(59): n is a, c, g, or t
acaagctcctcctcgccgcagcttgagaaagctgagtgcagcaacaaagacccagtgcngccaaaaatgaatgaatgcacgagtaaataaaggcttcctttagaaaaaaaatattgctttgcaagtccacctgtgaatatttgaggctccagttacagttcccatctgacagtgtactcttaagattctctaattgcccttaagagaatataattgtctctccccagtgatgaaacgttgaagggggt

SEQ ID NO: 594903 - DNA, 421 bp, Homo sapiens
agtatagatctgggatgcattgagatgcctcctataaagtagagactttcaaaattcatatttgaaaaacgatttactttaaaataatgaaattagttataaattagtaatctagaaaaacattatcatgataaaaatgctctcatttcaaagggcgtatcactaaatgcctcattatcttcagacctcaagtccggaatcgtcgtcgttgttttctgcgtgatacccagtttggaacttaggcaggagggatatttccttgaattatcaaggatattccatacagacttttaaaatgtcagtctcattaggagatggcactgagactttagcaaatagtgtagtatggatgcaggacaaactacacaacttattataaatgcattacacatatttacatagtggaatcctgcttgaatgc

SEQ ID NO: 594904 - DNA, 619 bp, Homo sapiens
  misc_feature (4)..(4): n is a, c, g, or t
  misc_feature (96)..(96): n is a, c, g, or t
  misc_feature (129)..(129): n is a, c, g, or t
  misc_feature (146)..(146): n is a, c, g, or t
  misc_feature (149)..(149): n is a, c, g, or t
  misc_feature (166)..(167): n is a, c, g, or t
  misc_feature (201)..(201): n is a, c, g, or t
  misc_feature (214)..(214): n is a, c, g, or t
  misc_feature (254)..(254): n is a, c, g, or t
  misc_feature (265)..(265): n is a, c, g, or t
  misc_feature (271)..(271): n is a, c, g, or t
  misc_feature (300)..(300): n is a, c, g, or t
  misc_feature (305)..(305): n is a, c, g, or t
  misc_feature (326)..(326): n is a, c, g, or t
  misc_feature (337)..(337): n is a, c, g, or t
  misc_feature (352)..(352): n is a, c, g, or t
  misc_feature (359)..(359): n is a, c, g, or t
  misc_feature (364)..(364): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (374)..(374): n is a, c, g, or t
  misc_feature (378)..(379): n is a, c, g, or t
  misc_feature (381)..(381): n is a, c, g, or t
  misc_feature (391)..(391): n is a, c, g, or t
  misc_feature (399)..(399): n is a, c, g, or t
  misc_feature (404)..(404): n is a, c, g, or t
  misc_feature (424)..(424): n is a, c, g, or t
  misc_feature (426)..(426): n is a, c, g, or t
  misc_feature (437)..(437): n is a, c, g, or t
  misc_feature (442)..(442): n is a, c, g, or t
  misc_feature (448)..(448): n is a, c, g, or t
  misc_feature (470)..(470): n is a, c, g, or t
  misc_feature (483)..(483): n is a, c, g, or t
  misc_feature (517)..(517): n is a, c, g, or t
  misc_feature (521)..(521): n is a, c, g, or t
  misc_feature (533)..(533): n is a, c, g, or t
  misc_feature (597)..(597): n is a, c, g, or t
tacnctacccgtttttttttctgtttttcagtccctctctcttcccacccccacaggcataccaacagggtcaatcttccttcatggtacctagtntaactgtctttttccttaggtaaatggctaaanatgtattcatgactgcngcngtaagggcatccacctnngtatctttacatactttgagacagtgtgataaanctctttcagcacngcagtctattcattcaaagtcatctaaccggataccttcncccacagctangaaagnatcccagtgtttccctagtttagagatgnagttnctgaaattgcgaaagctaaanggctgggactnagatccaggtcggtngttcagntttancnggngtncncgtnngnattacgaagngttttgangtatncctgtaggggcctgttctgncnccggacggccngggcngggtgncctttgggggttcttgggatgnctcagttgtgtgnctagggctgctcaggaggtggggtcgggcggatnttcncggacaagaggntacatcattcttagtttttagttttatataaacacccccatttttagttttatatgaccagatnaatatggttcacttttatttac

SEQ ID NO: 594905 - DNA, 133 bp, Homo sapiens
  misc_feature (37)..(37): n is a, c, g, or t
  misc_feature (62)..(62): n is a, c, g, or t
cgggcccaaactcgtgttatattatcgaggtggaaancagccatatgtattaggaggggaanctgaggcagaccacaggacggggctccagagggaggacaactaggcccagaaccccttctgtcgtcttctc

SEQ ID NO: 594906 - DNA, 1160 bp, Homo sapiens
gaggatgactatggagacccaggatgtctcaagaatgtatgtcccagaaacctgtggctgcttcaaccattgacagtttatgctgctgctggcttctgcagacagtcaagctgctcccccaaaggctgtgctgaaacttgagcccccgtttatcaacgtgctaccagagaggactctgtgactctgacatgccacgggggctcgacagccctgagagcgacatccattcagtggattccacaatgggaatctcaattcccacccacacgcagacccagcatacaggtttcaaggcacaaacaacaaagtgacagcggggcagatacacgtgccaagactggccagaccagcctacaggaaccctgtgcatctgactgtgctataccgaatggctggtgctccagaagccctacagctggagttccaggagggagaaaacccatacatgctcgagggtgacaaagactggaaggacaaggcctctggtacaagggatacacaattaacatatcccaagcaaactgggcaaagatccccaggacaaatactcccaaatgagggacatcccacacatttcatcacaatccccacaagtgcaaaacgccagaggtcaacaagagggtgaactacacaaatggacatcacggcaaaacaatagggcctatagaacgcacggtatcacttagaaatacccgaaaggccacattggtagcacacaagtcacacccgtggtaccccaaaggttgacccacatgcaaaatagaagagacaaggcctcaaataaaacccacaattggagagagatacacaatatagatcgggcatacgcccgcaaccaacgtttggcgaaacaataaggactgggaacacgcacagccaccaccacataggagaggggccgaggcaccaggcccaagacatgcgggagcacctgaagcaacgtacaaaacaattggcacgcaggcaccaaccacatgcccgcagacactatgccacgcgacccgaacaagacacaaacactaggaacacccgtacgagtaacagagcggcaagcgccaccacacatcattaggacagccacaacaccaagcgaaaacgcgatccaaaacgtgtgcaccggcagagcaccacacgccacagacaaagaaaaccaccccaga

SEQ ID NO: 594907 - DNA, 577 bp, Homo sapiens
ggatggatctcattggcattatgctgaatgaaaaaaggcaatctcaaaaggtcactgttaggttccaggtaggtgggacatggctttattcagcagtttcttcacactgtcggtgctgcatttatgcacctcacagaccataatggctcagaggcaggtgatgagccctcccacgttatggctacatagctgtgattatgtaatgcatgggattgtgcgcctgtgctccaatcccactgtgtcatactgtgcaggatgtgtacctcagcctatacttgactgcagcacagccattgtccttacaatcacatactgtaaggacagtatgtgattccatttatataatagtctcaaaaatgataaaaagatggagaactgattggtgctgtacaaaggttagcagtgttggtgaggggagttgtgactataaagaggtagcataaggaagatatttgtggtgatggaatagttccatttctggattgcacgtggtggttacaagaatacagacgtgattaactggcatagaattacacatatgctttgcaccaatgccaatttcctgatgtcggtatag

SEQ ID NO: 594908 - DNA, 178 bp, Homo sapiens
tctctcagcgtcaatggtctgttagtccccggccttcgcaatcggggttctgtgtaatatctaagcatttcaccgctacactacacattccaagaacttcacagatattcaagactaccagtatcaaaggcaatttctcagttaagctgaaacctttcacccctgacttaatagcccg

SEQ ID NO: 594909 - DNA, 184 bp, Homo sapiens
tgtgctggagagttcattaccctaaggacaataaaaataagggcttgaaagctggagtggcgggggtacacgacggaagtcccagctactggggatgctgagagaggaggatgcagtatgctatgatggtgccggtgaataaccacggcactacaaccggtgcaatatagtgagagcttatctt

SEQ ID NO: 594910 - DNA, 132 bp, Homo sapiens
  misc_feature (1)..(1): n is a, c, g, or t
ntgagtacagagtaggccaggacagcactgtggtgatggccagcaccccttgatgctgacttactctccaggtgcaaagccagcgccaggatgatcacacgcagctcgatggccagcaggaagaagcgtgta

SEQ ID NO: 594911 - DNA, 290 bp, Homo sapiens
atagacaccctgagtctaggatgatctttcaaagtggtcctgggttgagatttagggccctgcctttataccctagtgtgacagccactggatacaatgctctggaaagggagatgaccctggatggagtgccaaagcctttcccaagagggcttataataggattatctgctggcagcaattctagcagctgggacaataagtccattcctgacaggggatctgggtggcgcatcacagaatccattacgtaaaataggagtcaattttgaacatatttctgtggagga

SEQ ID NO: 594912 - DNA, 332 bp, Homo sapiens
ggctctttagatcatagttagtttaaagtctgttttatcagataccaggattgcaccccatgctatagagacacttaccatttgcctggtagatcttcctccatccctttattttgagcctatgtgtgtctttgtacatgagatgggtctcctgggtgcagcacactgatgggtcttgactctttatccaatttgccagtctgtgtcttttaactggggcatttagcccatttacatttaaggctaatattgttatatgtgaatttgatcctgtcattatgatgctagctggttgttttgctgccattaactgatgtagtttcttctaagag

SEQ ID NO: 594913 - DNA, 116 bp, Homo sapiens
aatgattgagctcggtaccaccagtctatgactgcgtctgcgtcatgtttgcctccattcctggatttcaaagaattttatacagaatcctgacgtgaacaaggagggatgagcat

SEQ ID NO: 594914 - DNA, 947 bp, Homo sapiens
agcctcttaaaagcagcaaaaacggcaaacaagaaagagagaaccacacgccgcttagtacattgtagtcctctaccagcaccccccgtgacgccggtacaaggggcaccggtggacccgccaattccgggagcgggtaacgtccctcccccgattttaggccgtacccaaaacggggggactaaacataccgccgtgccgtccgaacacacgcgaatgtggagaccccaaaaaaaaggggttcgtcgggccgccccaggtcgcgtgacccaacgcgtccgcaccgtgttcaagggcgccaaattctcataaatcagggtcatcggccacaagttatgccgccacccgacaccagaacccgtctttgcgggggtgggcaccccacaccaacatggaacccgcggtcattcaaacacacccccccgcggggggggaaacaaagtcgccgccaccgcgtccatggggaaacccgaccgggccaatccacaagggcgttaccacagggccaatgtaccagccccatcccgcgcccatctgtctcccacgaaatacaccattccttccacaccggcataatcagccgatgagccttcgcacccaagaagggcagtcacgagggccaacagagcacaccactggatagacaggcggctgcgcggttcaggctcagcaccacgggtggccccccagaccccacgcgaggagggggtgctgtttcaaaaagaggacgtactatgagacggaggggagcccctagcaccacgctcctcaatccgggggaaaacacgcggagaacaccctggtgcagatgtatttattgtccactcccacggcctgtcaccaggggcggtgctgaccaccaggtgggcagaaatgtcagcctatctccccctcgccaaccccatcctgtccggccccccccctaaccttgttaaaacacaaaaaca

SEQ ID NO: 594915 - DNA, 1273 bp, Homo sapiens
gcgccctccctcctgggctgacagcaccagggtgctcagacgcatccaccaggggagcagccacagaccatgatcccaggacaccacactggcccgggaccttgctggagggaggcagctcctccccgggagcccagagcttattcccaagccatgagtttggacgggggaggatggcctgggatggccactggtgcccaaggtgctgagctggtgatacatcctgagaagccagggcaccccaagcggaccccacacaggacctttctgcttgggatggtttcatccaccttggtggtaaaaccattgacattctgcagagggttttgcagaggacttactacgagagatcttggatgccaaagcccattcgacgtgaccctacattccacatggggttataacatagaaactccccacatcctctgacaggaacagagcccaagaggacttgggagaccatgggacaggcccatgggaaccgacatgaacaaccgaaggacacgaacaaccctcacccagagcagagccacagtggcattgaggcatcaccataggaggaaaacatagattagtagtagcatgagatacattgactagacacacaacgggagagttgatcattgcgcgcaagaagacaaacttgagatgagaagcaagacaccacttgggaacatcagatacaaaagcatgcatagacaaccatgaaaagcaacaggagccagaaccacaatcgggcccactatgaaacgcctggactagcattccctcccaagccgacactatatctcccacgggatttgacgtaccaatgaaccagaacacgaagtgttcaaaacgcactagagaaacgggagaacacgcaaggacacaacaaaggcaaccacgctgggagagtccccactccacccgaaaaaggaacaaggccgttggggaccgggggcccacgatacccaaagccaaaaaaaagaccaaggacgtcgccaagcaccacagcgtcaagcacggacaacgaggggcaccgcaccggcgctggtaggagcacagaaagaacatacaaaggatagcgccactggcacatcggacaacgcgcgagagggagagcacacagataaaccgaagtacaccatcgccacaataaacgaccagcagaccggacagggcccgaaccacataccgcacagagaaagcacaacagcgaacaaaaaccaaactgacaggcaccacgacgccacagcacgacgagcggaacaaaacagcgagcaggcgcggc

SEQ ID NO: 594916 - DNA, 972 bp, Homo sapiens
  misc_feature (617)..(617): n is a, c, g, or t
  misc_feature (627)..(627): n is a, c, g, or t
  misc_feature (629)..(629): n is a, c, g, or t
  misc_feature (631)..(631): n is a, c, g, or t
  misc_feature (634)..(634): n is a, c, g, or t
tgctagtatcatacctgaatgaggaaaaaatctgacaaagacctaatatctaaaatccataatgaacttaaacaaattaacaagcaaaaaccaaacaactctattcaaaaatgggcaaagtacatgaacagacacttctgaaaaaacatacatgaggccaacaagcatatgaaaaactgatcagccaggcgtggtgactcacacctgtaatcccagcaccttgggaggccaaggcgtgcggatcatgaagtcagaagttcaagaccattctggccaacatagtgaaactctgtctctactaaaaatacaaaacataatttagcccagtgtggtggtgtgcacctgtaatcccagctactcgagaagctgaggaccatcgttgaacgatggtcctcagctcaacgatggtcctcagctcaacgatggtcctcagctcaacgatggtcctcagctcaacgatggtcctcagctcaacgatggtcctcagctcaacgatggtcctcagctcaacgatggtcctcagctcaacgatggtcctcagctcaacgatggtcctcagctcaacgatggtcctcagctcaacgatggtcctcagctcaacgatggtcctcagctcnacgatggtcntnanctntgctgagggagtcaggggagctgggcgagagggtcgaaccagcaagggtggtgcaggtatcaggttctggtcaagcaggaaatggggagaagtggatagccggcgtacagggacgaggtggcggttggccgttagggcctttctcctttccggcagctccggctcggtgattaacttggaggaacctcggacaatatccttctcagagtcaaggtccatgacttgaaccgtggcgtacaactttgatctggctctgtgccgggccctgccaagctcttctgaaattcgatcgcgtgttgtgtcagcttcgagtccaggtcagtgctgccgtctccctg

SEQ ID NO: 594917 - DNA, 1166 bp, Homo sapiens
  misc_feature (326)..(326): n is a, c, g, or t
  misc_feature (408)..(408): n is a, c, g, or t
  misc_feature (475)..(475): n is a, c, g, or t
  misc_feature (508)..(508): n is a, c, g, or t
  misc_feature (571)..(571): n is a, c, g, or t
  misc_feature (881)..(881): n is a, c, g, or t
tcacacgtacgaaagcagaagaagggaggggcaggaaaagtgacatgggctaagggggtcttaacctggcttccggctctccacaggggtgacaaagctgggctgcgtgaactggtgcccacacgagctcggcgggcgccactgtggggtcaggctggtggtggtcttctggtgtggccgcggggacattggtggcacgaacaggacaactgtgctgtacagcggaagcactaatgtggcacaaagggagaggagcggttcctgtgcagaggaattcctcgtgtggttgaacggcacggtatcacacaatccacagccctctcctncactatctggcgcggacaaaaccacacacggaacatttgtacagtttgggcgcaacacttgtgtgtgtgagattgtgcgctntcttagggacgcaacacaaggggtttggacacggtgttttggagggcgagcgcaagcggttgggatntaaatttaaaagcaaacatgggtgcgcatctgnggatgtgcgattgggttgttaagattgcggggggtgcagcagcatctccgagagttgtgcacncagggatacttagggcggtctcgggcaaaaggttggttgagcaaacacacacggtctcccaagaggccccccaaggcagcaaaaagtagacgctcatctcccagaggggaatctccctgtgagagcttctccaagaggtgcgttcttctcagaccaggagtgtgccccctgggtccccaaacgttgtgagggcccctacaccttttggtctcacatctctgtgtaatatcgtctcccccatgtgacctgtggcgaatacttttccaaccgtgggttctgggtggtgtgcccgggcaggaatttcccaaantaatctcatggaaggccgtgtaaggtgtgatgcgagggcggtgggccaatctcatgggttgaaccctttgtgcatctggaaggcctaactgcgggccctttccgcgggaacttgttgtgaacctggggccaggaccgccgagttcccaaggagaactactatttcggtccttctagcaagcatcttcgggttcatctctccccacgggtgttgttcggggcctataggcttgtgctgtggcctaccttccttgggcctactctatccttcacgtggtttcccccg

SEQ ID NO: 594918 - DNA, 596 bp, Homo sapiens
tgctagtatcatacctgaatgaggaaaaaatctgacaaagacctaatatctaaaatccataatgaacttaaacaaattaacaagcaaaaaccaaacaactctattcaaaaatgggcaaagtacatgaacagacacttctgaaaaaacatacatgaggccaacaagcatatgaaaaactgatcagccaggcgtggtgactcacacctgtaatcccagcaccttgggaggccaaggcgtgcggatcatgaagtcagaagttcaagaccattctggccaacatagtgaaactctgtctctactaaaaatacaaaacataatttagcccagtgtggtggtgtgcacctgtaatcccagctactcgagaagctgaggaccatcgttgaacgatggtcctcagctcaacgatggtcctcagctcaacgatggtcctcagctcaacgatggtcctcagctcaacgatggtcctcagctgtattctgcagctacttgagaggctgaggcaagagaatcgcttggacccacgaggcaaaggttgcggtgagccgagatcacgtcatcgcactccaacctgggtgacaagagtgaaacttcatctc

SEQ ID NO: 594919 - DNA, 850 bp, Homo sapiens
gtcagagatctcaaactccgatgcccctggggccacgttatgttgtgtaaatggatgaatacaggcccttgagttgggagccatgacttcactttggactttcccagctgtggctggagatcaaagacatcgtgatgagagaaagttcgcacaatctagtcgggtaacagccactttccttgagtaccacagaagaagctgcggtggaggaactgggggtggagagtcacgggtccccgctctgacagctggaccgcttgccatacttcacgtgtgtagctaagttgctctgagtgtgggaattgcaggcctaatgaacagaagatctggagagaagccagatgagtaccagcactgtctgctaatgctgaagtagtcgtgcctgtaattttattgaagatatgctctgcgcgagacatattgagattcgaggacatactcacagagtctgcaggccaagacaaggtgcaggagccgaggcgttctgtgccccatggccgccatggtaggatccctgctgggagcagtgcactcgctgggagtcctaggctgcgtctgtcattgagggatgctgggcactgctgccgggtggccagggtatggggcatgtgcccagcaatgtggctccttggccccgctggccagtgtcctgggccccctggaccaggcgctgggcctggttgaagtggttttggttacaatggccttacaaataaaatgccagcttggcaggcatttgacaaccaaatagcacaaacatcactaccccacatacttataaacaaacaaatattcctcatcaatatatactcaactataaatactctacaccgcctcaagttacaccaac

SEQ ID NO: 594920 - DNA, 589 bp, Homo sapiens
  misc_feature (17)..(18): n is a, c, g, or t
  misc_feature (20)..(20): n is a, c, g, or t
  misc_feature (234)..(234): n is a, c, g, or t
  misc_feature (244)..(244): n is a, c, g, or t
  misc_feature (246)..(246): n is a, c, g, or t
  misc_feature (248)..(248): n is a, c, g, or t
  misc_feature (251)..(251): n is a, c, g, or t
aacgatggtcctctagnncncgatggtcctcagctcacgatggtcctcagctcaacgatggtcctcagctcaacgatggtcctcagctcaacgatggtcctcagctcaacgatggtcctcagctcaacgatggtcctcagctcaacgatggtcctcagctcaacgatggtcctcagctcaacgatggtcctcagctcaacgatggtcctcagctcaacgatggtcctcagctcnacgatggtcntnanctntgctgagggagtcaggggagctgggcgagagggtcgaaccagcaagggtggtgcaggtatcaggttctggtcaagcaggaaatggggagaagtggatagccggcgtacagggacgaggtggcggttggccgttagggcctttctcctttccggcagctccggctcggtgattaacttggaggaacctcggacaatatccttctcagagtcaaggtccatgacttgaaccgtggcgtacaactttgatctggctctgtgccgggccctgccaagctcttctgaaattcgatcgcgtgttgtgtcagcttcgagtccaggtcagtgctgccgtctccctg

SEQ ID NO: 594921 - DNA, 222 bp, Homo sapiens
cgtccgcagctcctggagaatacttgaagctagaaggggaagttggttcaaaattcacatcaatccgttacactagcgagactagatgtaatattactccaatttcccctccaagcctaccaattattcctccaaacatgggtccggtccacgttaaccccccccttctctcccaactttaccttctaacttcggtcaccaccaaaatttaatatgaatggg

SEQ ID NO: 594922 - DNA, 511 bp, Homo sapiens
  misc_feature (17)..(18): n is a, c, g, or t
  misc_feature (20)..(20): n is a, c, g, or t
aacgatggtcctctagnncncgatggtcctcagctcacgatggtcctcagctcaacgatggtcctcagctcaacgatggtcctcagctacttggggggctgaggtgtggagaattgttttgaacctgggacggcagaggttgcaataagccaagattgcaccactgcactccagcctgggcgacagggtgagactccatctcaaaaaaaaaaaaaaatgagtcgggtttggtggtgaacacctggttagtcccagcgtatcgcaataaggctgaggaatggatgatcgtttgagcccagggagatcgaggtgataaggagttataaggagttatgatcatgccattgcactcagagtggggtgcaagggagcaatgactgtgtctctggaagaaaagaggccaggcatgtggggtcaggtctggtaatcccggggactgtggagaggctgaggcgggaagatcatatggaggcaggagtccgaggccaggctggccgaagatgggtgaaat

SEQ ID NO: 594923 - DNA, 487 bp, Homo sapiens
cctactgggctcaagcaattctcccatctcagcctcccaagtagctgggactacgggcatgtgccatcatgcctggctaatttttttttttgtttgtttgttttggtagagacagggttcaccacgttgcccaggctggtctcaaactcctgtgctcaagtgatctgcccgcctcagcctcagcctcccaaagtgcaagggttacaggtttgagccaccatgcctggctagaaccacaagatttttacttaagttcaagaatcttatatctcacctaaggttgggagttcaagaccagcctggccaacatggtaaaaccctatctctactaaaaatacaaaaattagccaagcgtggtggcatgtgcccgtgataccacctactcgagaggctgggccaggagacttgcctgaacccaagaggcagaggttgcagctgagtcatgccactgcactccagcctgagcgacagagtgagactatctctc

SEQ ID NO: 594924 - DNA, 390 bp, Homo sapiens
  misc_feature (17)..(18): n is a, c, g, or t
  misc_feature (20)..(20): n is a, c, g, or t
aacgatggtcctctagnncncgatggtcctcagctcacgatggtcctcagctcaacgatggtcctcagctcaacgatggtcctcagctcaagtctctctctctctgctccctttttttttttggaaagagtgtctcgctctgttgcttaggcgggagtgcaggggccacaatcacggctcacggtaccctcaacctccccaggctcgggatgatcctcccgcttcaacctctcgggtggctggacggcggtcatacgccaccatcgccgggctctttttggtattttttggtacagatggggtttctctgtgttccccaggctgctctagaagctcggggttcaagctatctgcctatctcagcctcccaaagtgctggctttttgggcg

SEQ ID NO: 594925 - DNA, 662 bp, Homo sapiens
tgctagtatcatacctgaatgaggaaaaaatctgacaaagacctaatatctaaaatccataatgaacttaaacaaattaacaagcaaaaaccaaacaactctattcaaaaatgggcaaagtacatgaacagacacttctgaaaaaacatacatgaggccaacaagcatatgaaaaactgatcagccaggcgtggtgactcacacctgtaatcccagcaccttgggaggccaaggcgtgcggatcatgaagtcagaagttcaagaccattctggccaacatagtgaaactctgtctctactaaaaatacaaaacataatttagcccagtgtggtggtgtgcacctgtaatcccagctactcgagaagctgaggaccatcgttgaacgatggtcctcagctcaacgatggtcctcagctcaacgatggtcctcagctcaacgatggtcctcagctcaacgatggtcctcagctcaacgatggtcctcagctcaacgatggtcctcagctcaacgatggtcctcagctcaacgatggtcctcagctcaacgatggtcctcagctcaacgatggtcctcagctcaacgatggtcctcagctcaacgtatgagctgcggaccatcgttgacctgaaagacctagtggagactcctcaagagatagac

SEQ ID NO: 594926 - DNA, 899 bp, Homo sapiens
gccagaacgtcctgctcatcacactgataaccaacactgagcggcggcatcccggctttgaggccaccttcttccagctgcctaggatgagcagctgtggaggccgcttacgtaaagcccaggggacattcaagcgagccgccgtactacccaggccgactacccagcccaacattgactgcgacatgggaacagttgtaggtgcccaacaagccagcgatgtgaaggtgcgcttcatagattcttctacctgctggagcccaggctgtgcctgcgggcacctgcacccaaggactacgtggcgatcaatggggagaaatactgcggagagaggtcccagttcggcgtcaccatgcaagagcaacaagatcacagttgcgcgtgtccagctcagatcagtccctacgaccgacgaccggcattcttagacttgacatacctctccttacgactccagtgacccatgcccgggggcagttcacgtgccgcacaggggcggtgtatccggcaaggagctgcgctgtgatggctgggccgactgacaccgaccaaagggatgagctcgaactggcagtctgcgatgccggtcgaccaggttcacgtgcacaggaaacaagtcactgccaaggcccctcttctgggtctgagacagtgtgaacgactgcggagtacaaccagccgaggagacagggagtgcgagctagtgccggcccgaggaacccttcagaggtggtccacaatcgtggcaaagccgggcgtgctccgacacaaaggcccaggacggtggcacaaggtgacaggacaggactcgagcggggaccggggtcccgaacgaaggactacctagacacaacgggagcacccgtacagcccctgggataccaaactagaacttaacg

SEQ ID NO: 594927 - DNA, 906 bp, Homo sapiens
  misc_feature (288)..(288): n is a, c, g, or t
ggcctcccagtctccggagtcagaggtgagaccccaaggtttgccagtgacagaccagtgcaggcgtttctagtctgcacacgacgaagctgacgcggatcgcccggttcgctcctgtgccgtgagatctctgtcgcccgttgtgcatcgctgctgctggctagcccttacctgctccgatccatacgagcgcggccattcaaggccgacgtgcaacgagtgccggctgcctcgaagcgctccccagagtcccgcgtggtgcttgaagcaggctggtacgtctaagcncgctgggaagtccgtgctttcggtggtatctttgagaccgcgaccgttcgtccgccccgagggcgcataggaacccacggtcgtagcagaacccggtgtaaaacagcggctggatcccatgcttacccaagtggagcgccgcaaggctgaagcggcccccgggcgggttcaatggcacgccagaggagtaacaaaccccccggatgcgtgtcttcgggcccaaggagtcgacctagccatttcggcccaggcgccggccggaacgcgtcccttcgtccaccggcatttgccaagcggaacctgacggaggcgcgaaccggcacccctcatttggcgtttgacatagggggccggagagggtgaatcccgccgagggacagcgtgagggcacccgccaaagaaacttccgagagggaaacctggcaaagcgactggtggcacgaaccaggggtcgcggttgttagaacttgtggcacattccacgtgtaggttcccccccgggaagacttcctggcgttccccttgaaagtttgcgagacccgttaaagcagggacccttggagcttcgtcagggaggggcgccaagacggaaacgtgggcgggaatgaatacaactgg

SEQ ID NO: 594928 - DNA, 334 bp, Homo sapiens
tttttttggggggggggggggggcccccccccccccccttgtttaagggggatttttaaaattccggttggggggaagggttgcccccttttttttttccccaagcccccgggggttgttcccctaaaacccttttaagggggcccaattttttttttttaaatttaaggggttttttttcccgccctgggggggcccaaaaaaaggggttgtttaatttttttttggggaaaaaatttcccccaaggggggtttaaaaaaaaaaagttttttttgcccccaaattttttaaaacccccccgggttattttcaaaaaaaaaattttttttccca

SEQ ID NO: 594929 - DNA, 975 bp, Homo sapiens
  misc_feature (405)..(405): n is a, c, g, or t
ggcacgtggattcagtcgcgatgcccaaatcgcaatgcgcgacaggaaggtctccttaaccaaaattgccaatgaaaggcttgggaattgagacaaaagctggatagaacgagacttcggcaaatgtgctggacaccgtacaagtagcttttcatcttctctgtggccaacatgaggaacagtccagctgaaggatcatccggatagcgctctggagagcatcagctcggagtgttctttggctaaaacaaggtgatgatggtggtcttgggtcggattgccgatctgactgaactacaataggagcaataactgacactcacgggtcaagcaaatagggttcgagagcggtgacggtggggtctccgtgtctctagcacagatccgcgacaagagggatagganggtggaaagtgagtggttcaccgaaactagacacgaccatggactacgcccgagctgggaatgaagcagctatcatctgtgagcctggatccagggcccctggagcagttcccccactccatggagccacagctcaggcagctgggcctgcccaccggcctcaagagaggtgtggtgactctgctgtctgactacgaggtgtgcaaggagggcgatgtgctgaacccagagcaggctcgcgtcctgaagcttatggggtatgagatggctgaattcaaggtgaccatcaaatacatgtgggattcacagtcgggaaggttccagcagatgggagacgacttgccagagagcgcatctgagtccacagaaagagtcagactcagaagatgatgactcgaccgggatcgggactgaaggtctcctgggaagttctgggtctcactggaccatcacggatggtggccgccctctgagagagcccctttatttggctggcgctggacctgattggctggaccctgtaagaacacttgggccggccggggtccccggatcccgcttggaaccctg

SEQ ID NO: 594930 - DNA, 384 bp, Homo sapiens
gcatcccatgagagccttttctcacagatggacacttcacagttaagtgtcattagtatgttaaagctaggaacctacccaaaagtacaaactcagtttactacatgattcccaaggatttttaataaattgtgttaaattccttgctgaatttaaggtataatgtatatctatctattcacccatccaaccaaaccaaccacagattcttcactcaagaaaatcaggtaagcttggcatgatttgccgttttgcctttatgtttcttgctagtgcttttttataatatttattattttgttttagactgaggttttatgtcaaatctgtagttatcagcatatgacctttaccttttagacaacttgagaaatcttcaccccc

SEQ ID NO: 594931 - DNA, 151 bp, Homo sapiens
tgactagaggatcccccatctgtcattgaagtaagatgcttgaactggagtttagtgttacatttttcttgctttggttttttctgtggggacccgtgttatctgctattgaaacttctaaaaataacatgctgaagtacacatcagaaag

SEQ ID NO: 594932 - DNA, 873 bp, Homo sapiens
gcatcccatgagagccttttctcacagatggacacttcacagttaagtgtcattagtatgttaaagctaggaacctacccaaaagtacaaactcagtttactacatgattcccaaggatttttaataaattgtgttaaattccttgctgaatttaaggtataatgtatatctatctattcacccatccaaccaaaaaatagaaaaattagccaggcgtggtggggcacaccgtgtagtcccagtcgtactcgggaggctgagttgaaagaaccacttgaacccaggaggtgaaggttgcagtagtgagctgagatcgcaccactgccctccagcctggacaacagagggaaaaaaaaaaaattccaaattttttgtcaattccacattcatcaaccaggtctccttatatattcataaaattaactcccattataaatttcccttatcccacacacattattaaaccttgaacctacattttttccagagatttaatcataaaaattacacagcaagaatttcttccactactttagggaaatagctttcggacattataggataatgagggccccaacatttttaataagtttacagtatgtataggaaaccatactattttggtttcaccatctctgagagtgctatcttacttccctttccgtccccactttcctttttccctctctcttttccttccattccttcttcttaatctggggggcttcttaagtggctttatttcccttatgctttcccttgggttgcggccattccttatcctagtttataccttctcaatggtgagttccgggcgtctggggacaatgaaggtttgcgacctatttttagcccgcaggaattctgtggcg

SEQ ID NO: 594933 - DNA, 1408 bp, Homo sapiens
tctccccttcccccccttttcaccatttccccttcgggagggcggcttccccggggcagggggcaagagccgggtctcaccccgggctctcccgggacccgcgacgcggcccaagtgggcagacaagggaagcacccacaacacacacaacagaggagcatcaacaagcggaagcgcggcccctcaagagcacagggagagatcaacaacggcacacgaccttacagcgggaacgcgcaccccaagtacggacgcgaaaagacaggcacgccgagacgccccagaaccagaaaaggcgaccaagagcaagcacacagggggcacacagacagcccaccaacgggacaccgcggacatcaccacacaaaataccatccactatacaacaacacgacaggagccgcaaaagccagaacacaagaaccaggaaaccggggacctccaccgccaccacagacacacagtagccaaactaaaggcgcggatgggaaaacacgcgagcgccccgcgacggaggcaagccaccccgcgagggtacaacacaccaagcagaaagaagcggaccgacgaaaagaacacagtggcacacagcgaacaacagcagggaaagcgacaaagaacgagcacaaatacgccgacaaccacgacagacgcggagagccatacatggaccaacaagagagtggagagggagcacggcgcaacaaacaccacgaaaacgggaacaactatcaacagaccacacgagacacccaacgcgccaccagatggaacaaacgacacccaacaccagacgagcgcgacacacaaacaacgacaggacaaaagcaaggccaaaacaacaaccaagcaaaaatacacagacacaaaacgcgcaacaacgcaatgaaagaacaaaaacacaacacagcgaccacaacaagaaccaaagaaacgccacgcaaacagacaccaccaaaccacaatacgcacaccaaaacaacacacgaggaacaaagcacaacaacaacaccaccaacaccgatatccacacgcaaacgaaccacaaaccaaacacaaacacagaacacgcagcaacagcacacaaatgacacgaaaaagagacacagtaagcaaagagacgaagagcagcagaacaatacacacacgaatcaagaagaacaagacaggaagaaaaaagaacaatgacaagataccacgagcagcgaagacaaaccaatcgaccaagacaacgacgtaagagcagacaacacgatagacaatagaagacgacagcaaatagcagcacaactcacgcacctgatctcaccaaccaccgacgaacgaacacatcaaacacgatacacgactgcagagacgaggagaacatcatccacatgcactatcacataacgtctttcacctgacc

SEQ ID NO: 594934 - DNA, 403 bp, Homo sapiens
  misc_feature (12)..(12): n is a, c, g, or t
  misc_feature (355)..(355): n is a, c, g, or t
  misc_feature (365)..(365): n is a, c, g, or t
  misc_feature (396)..(396): n is a, c, g, or t
gacagtgtcttnccctgtcatctaggctggagtacatggtataatcatagctcactgcagtctcaacctcctggcctcaagcgatcctcctgcttcagcttcctgagtagctgggactacaggtgcatgccaccatgctcatctaattttttaatttcttgtataaattaggtctcactaattgtcccaggttggtcttgaactcctgggctcaagtgatcctccgacctcagcctctcaaagtgctaggattacagatgtgagccaccatgcttggcccccaaaacctactttttagtaagtattttgatgggacaaaggatatatgttacattaatttatagttttaatatcntaaaaaacantaaggatttaggaggaaaaggttattattantgggcca

SEQ ID NO: 594935 - DNA, 148 bp, Homo sapiens
  misc_feature (96)..(96): n is a, c, g, or t
  misc_feature (111)..(111): n is a, c, g, or t
ttgtcctgattgtctggtgtgtgatgctagtggtagaatcctgagtatttgagaaataaaatgtgcatatgtggggtatcctaagttgggtgatcnctctagagtctgacnctgcatgtgtcatgcaatgcttgtgcacttggcctgt

SEQ ID NO: 594936 - DNA, 1131 bp, Homo sapiens
cgcgagcattcggacgccactttcacaacacgctccactcgcgccggacacagggcagcagcgagcacgcgatttcccgcaacccgataccatcggacaggacttctctccgccctcacgcccaacgcgggcacgactcatctggcaaacactggctacagaacatgcttaactgcgaacatggatactgacagagccccactggcactactagccttcctgacacggtctactccactgtcaagaacacaagctttcccacgaacaactttggcgtctgcaatggcctgcgctttctacccgacgacgcacagacgctctgcccctgcaccacaacaccctaaggcacttgaaacacatctctaacagcttctgcccacgtcgggcccttaacgcttatgcccacccacttaggctggaacttttgaacgccaactgcaccctcacggcaatggtcgttaccttctgggaaaggacccatctgttacacaccaccgacaacttttccgaccacttgcgagcaaggcgaaaccgccgaccatgcccccaccttatgggcgccacaggccattgtacccttacttccaaacaagccacagctcatacctattccaataaccgcgtacgctctcggttttggacaacctcccgtttccctttccctgcttatccaaaccttgtgccttgtctccgcaccgtgcacaccagccccaccacacacacacagcgcattaggaccccccgtttctgcccacatcctaaccttgggcttggcgcccaccggattcccaacgtaggaacataacgacaacccactatctaacccacagaggccgtgcaccacaggcaaccggactcccccacacccccgctcaatcccacaccactgctggcctgcaaaccatccccaaaagcaagcggccatttcgcgcgccgcccgggccaacatttgcctgtataagcccgttaagcacaaacggggagaaaccccccatcgtacagcttggccaaagctgcaccccacagaacccgcagcacccgtgtacacacggggggcccaaacccgcgttcccaattcagggcgcgccacactccacggacaaaacacccacgccgcgccccattcaaccc

SEQ ID NO: 594937 - DNA, 291 bp, Homo sapiens
gtcgactctaagatcaggccaggcgcagtggctcgtgcctgtaatcccagaactttgggaggccgaggtgggcagaagacttgaggccaggagttcaagaccagcctggccaacatggtgaaacctgtctctactaagaatacaaaaactagccaggtgtgatggtgtgtgcctgtaatcccagctacttgggaggctgaggcaaaagaatcccttgagccagggaggaggaggttgcagatcgtgccactgcactcgtagccctgggtgatgagagtgagtctctgtctc

SEQ ID NO: 594938 - DNA, 209 bp, Homo sapiens
atgatcccaatgataatggagacagaaataggtgaaagacagacaggtacagtgtctaccctaaaaaagagagaagctcagtgattaatgtgccgaccatgtagtgccaaggcacatggagtcagatgtggaagtgtcaccagtgaatagcagaaggggcattgtgtgcaccctgtaagtgaggatcagtggcttggagtggttagggt

SEQ ID NO: 594939 - DNA, 294 bp, Homo sapiens
ggacgagcatcttacaggttggacattcttccttagagtaatgattttcaacatctttttttttggagacagagtctcgtctggtcgcccaggcgggagtgcaaaggggtgatctcggctcacggcaacctccgccggccgggttcaagcgattctccggtctcagcctcccgagtagctgggactacaggcgtgtgccaccacatccagctaatttggtattttaagtagagacggagtttcatcatgtgggccaggcgggtttcaaactcctgacctcaggtgatccacctg

SEQ ID NO: 594940 - DNA, 218 bp, Homo sapiens
ggccccacggttcggtaccacacggaggtgcgcgccgccccggcttcagcttgaggagctcagggtggccggcattcacaagaaggttgcccggaccatcggcatttctgtgtgatcccaggaggcggaacaagtccacggagtccctgcagaccaacgtgtcagcggctgaaggagtaccgttcaaacttcatcctctttcccaggaagccctcggt

SEQ ID NO: 594941 - DNA, 495 bp, Homo sapiens
  misc_feature (33)..(33): n is a, c, g, or t
  misc_feature (47)..(47): n is a, c, g, or t
  misc_feature (111)..(111): n is a, c, g, or t
  misc_feature (119)..(119): n is a, c, g, or t
  misc_feature (124)..(124): n is a, c, g, or t
  misc_feature (153)..(153): n is a, c, g, or t
  misc_feature (166)..(166): n is a, c, g, or t
  misc_feature (178)..(178): n is a, c, g, or t
  misc_feature (211)..(211): n is a, c, g, or t
  misc_feature (239)..(239): n is a, c, g, or t
  misc_feature (277)..(277): n is a, c, g, or t
  misc_feature (291)..(291): n is a, c, g, or t
  misc_feature (305)..(305): n is a, c, g, or t
  misc_feature (307)..(307): n is a, c, g, or t
  misc_feature (319)..(319): n is a, c, g, or t
  misc_feature (417)..(417): n is a, c, g, or t
  misc_feature (431)..(431): n is a, c, g, or t
  misc_feature (476)..(476): n is a, c, g, or t
tgactttaaaaaaagtttttattgtagtaaaanacaaaatttaccancgtgaccatttaagggtatagttcaatggcattaagtacattcaactttttgagcaaccgccancaccattnatcanccatctccgtttttttgttttgagagggngtttcactctgtngcccaggttggngtgcagtggcatgatcttggctcactgcaaccnctgcctccccagtccaagcaattctccngcctaagccacccaagtttctgggactacaggggtgcnccaccacgcccggncaattttttttttntntttttagtaganagggggcctcaccacaacggccaagctggtctcaaactcctggcctcaagtgacccgcccgcctcagcctcccaaagtgctgggacaacaggggttancaaccatgccaggncatcgtctcctgaactttttcatctgcccaaactgaaactctgtncccattaaacaataactcc

SEQ ID NO: 594942 - DNA, 1438 bp, Homo sapiens
  misc_feature (1003)..(1003): n is a, c, g, or t
  misc_feature (1023)..(1023): n is a, c, g, or t
  misc_feature (1027)..(1027): n is a, c, g, or t
  misc_feature (1039)..(1039): n is a, c, g, or t
  misc_feature (1041)..(1042): n is a, c, g, or t
  misc_feature (1045)..(1045): n is a, c, g, or t
  misc_feature (1054)..(1054): n is a, c, g, or t
  misc_feature (1064)..(1064): n is a, c, g, or t
  misc_feature (1080)..(1080): n is a, c, g, or t
  misc_feature (1084)..(1084): n is a, c, g, or t
  misc_feature (1093)..(1093): n is a, c, g, or t
  misc_feature (1096)..(1096): n is a, c, g, or t
  misc_feature (1099)..(1099): n is a, c, g, or t
  misc_feature (1102)..(1102): n is a, c, g, or t
  misc_feature (1117)..(1117): n is a, c, g, or t
  misc_feature (1123)..(1123): n is a, c, g, or t
  misc_feature (1126)..(1126): n is a, c, g, or t
  misc_feature (1133)..(1133): n is a, c, g, or t
  misc_feature (1135)..(1135): n is a, c, g, or t
  misc_feature (1150)..(1150): n is a, c, g, or t
  misc_feature (1153)..(1153): n is a, c, g, or t
tcggctcagagagccgcggttaatcggacgaggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcnaagaagaggaagatgtttgnatcntttattgagtcngnnccnctctttaantcactagagntgtcagaacgaatgangatngtggatgtnatnggnganaagatctataagganggagancgnataatcncncagggtgaaaaggcnganagcttttacatcatagagtcggcgaaggagcatctgattagaagcaggactaaaatcaaaccaaggatgggggaccaggaggtcgagatgcccgctgcataaggggcagtacttggagagcttgccctggtcacaacaaaaccagagcgctcagcttatgcgttgggatgtcaaatgcctagtatggtggcacaacaatgagaggctccgggccggatggcatcgagaaggaatccaacaagaggaaacggcgaaacatgggccccaggctgaaccccgcaccgg

SEQ ID NO: 594943 - DNA, 184 bp, Homo sapiens
gtaccgcccgaagtcacaactcgaacatgcaggacaacggccggtgtggaggctcacgcctgtaaggccagctactcaggaggctaaggcaggacaatcgcttgaacctgggaggtggaggttgcagtgagccaagatcgtgcctttgcactccagcctgggcaactaaagcaaactccatctt

SEQ ID NO: 594944 - DNA, 1089 bp, Homo sapiens
  misc_feature (1064)..(1064): n is a, c, g, or t
tcggctcagagagccgcggttaatcggacgaggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggtaggagatggagctttgaaattgtgtggccacacttaatcggattcatgactcagggcagatgctttatcctattctgtattcagcccacagaggctaagggccaggtgaacaagcttcccaaagccttgtgagagtccacagcttgtccctctctaccagtgctgtcctgagtcctcagcacaactcatatttgaagagcaatcatttagagtagaaagtctcctttaggccaggcgcagtggctcatgcctgtnattgcagcactttgggaggccaagg

SEQ ID NO: 594945 - DNA, 431 bp, Homo sapiens
  misc_feature (17)..(17): n is a, c, g, or t
  misc_feature (391)..(391): n is a, c, g, or t
  misc_feature (396)..(396): n is a, c, g, or t
  misc_feature (416)..(416): n is a, c, g, or t
atgagagctgtgctgtnagtatggctttatggcactgtggtaatcatacgcagctgggaagttgagactatcggatagcaacagtgacccctttatccgcacagctatggcccagtgactgctgcagagtatcctaggtaaaagaacagctggtaaaattttggttatctcttaaattatattgaatacaaatagtatatgggccccctcatttcagctgcttagtgttgtaaaaattaattctatgagctccaatatttttgtttgctttttattgtggtaaaatagacgtaacacataatttaccattttaaccatttttaagtgtatacatcagtgggtattcacattggtacaatcctccattcaccatccatccccaggaaactcnttttnttcttcccaaactggaactnaccattaccaattaa

SEQ ID NO: 594946 - DNA, 149 bp, Homo sapiens
tggtgacctacctagcagcttcagtgatcttaaggtgtccattgagtctcatccctgcctttcccgctgcgtccaacagaacttgaacaactccgacttaacacatgactttgttcttccaaaaccacttttgcttgagggtcagtccc

SEQ ID NO: 594947 - DNA, 543 bp, Homo sapiens
gacgcttagtgctctctctctctgcctggttgtcactgcccgctctgtgcaggtcccgagccatcggctcggcatctccgccgccccccgggagcctggcccgtgagcccgccggagcgcgcactctcaggtcttcccgcggccctctgaggcttcgtcgttctctctaggccgcgggtccgcatctccgtccctggcgctcggcgactccctgcactctgagctctggcgctggacagcttgtcacccgtggtccccggctcaggtccccgttatccctcccctcctgggctgcgctagggggcgcggtccgactcatccccgcttcggcacggagcgtctccacaatggcttccctttaggtagagaacaagcagtctaggccaaggggtctagagaggatggtgaccccctggcgtttgtctgtcagggtctgcttgtcacacttaagatgctttgagttcagaaaggaacttgggcattccagacccctgggatgctctcgcaatgccagactatgttggtttctgctaggtactttgc

SEQ ID NO: 594948 - DNA, 117 bp, Homo sapiens
cggcaacgatgcggagttcttgggaattgtgggaaatatgattgcattttacttcgaaagtcgttcatacgtgtgaactcctaaagctttccagaactgcgaaggctagatcacacc

SEQ ID NO: 594949 - DNA, 739 bp, Homo sapiens
  misc_feature (25)..(25): n is a, c, g, or t
  misc_feature (85)..(85): n is a, c, g, or t
  misc_feature (89)..(89): n is a, c, g, or t
  misc_feature (92)..(92): n is a, c, g, or t
  misc_feature (96)..(96): n is a, c, g, or t
  misc_feature (163)..(163): n is a, c, g, or t
  misc_feature (174)..(174): n is a, c, g, or t
  misc_feature (193)..(193): n is a, c, g, or t
  misc_feature (195)..(196): n is a, c, g, or t
  misc_feature (199)..(199): n is a, c, g, or t
  misc_feature (202)..(202): n is a, c, g, or t
  misc_feature (248)..(248): n is a, c, g, or t
  misc_feature (250)..(250): n is a, c, g, or t
  misc_feature (252)..(252): n is a, c, g, or t
  misc_feature (292)..(292): n is a, c, g, or t
  misc_feature (304)..(304): n is a, c, g, or t
  misc_feature (330)..(330): n is a, c, g, or t
  misc_feature (349)..(349): n is a, c, g, or t
  misc_feature (364)..(364): n is a, c, g, or t
  misc_feature (380)..(380): n is a, c, g, or t
  misc_feature (396)..(396): n is a, c, g, or t
  misc_feature (412)..(412): n is a, c, g, or t
  misc_feature (420)..(420): n is a, c, g, or t
  misc_feature (425)..(425): n is a, c, g, or t
  misc_feature (451)..(451): n is a, c, g, or t
  misc_feature (456)..(456): n is a, c, g, or t
  misc_feature (474)..(474): n is a, c, g, or t
  misc_feature (586)..(586): n is a, c, g, or t
  misc_feature (701)..(701): n is a, c, g, or t
gccccaaccccaccccatcccaggngtatttacagtgggctgaagttaatccatacaactcagctgaaaaacagttacatctggngtgngancctngggggaactggggggggggggggggggaagacacaaaatgctaccactaaaatgggggaggcatggnaacctcagggnggttcttttcacccctgtngnncanggncagggcaaagacaagggggaaggaaaaccataaagccaaagtctgngngngaaccactcaactgagcacaggctgtagcttctccaagangggtgcaagggngaaacattctttcgcttccttctgcngggaaatcattgccctggngtgccagccagtggnaggcacaacctttcanaagttcaagggatgcnggctagagaagggggnattctggnttgcngcctcctctcagaaccctctcctcancccanagcctgcctcctggtgtnttttttcctccaaactctctttacctaacctctcttcatcagaaggcaagcgggaatctgttccgggtttcagtagagtgggagaaaggacaggcaaaggcacagatatttnggcgagagtcaagctacttctggcccttgcatgtcccttattcaggaatagtgggccccgacgactggcactccgactctcaactctggttttgggagaacattagaggctcttnagaggctccccacatcagtgtgcctttcctgaatcctt

SEQ ID NO: 594950 - DNA, 351 bp, Homo sapiens
  misc_feature (272)..(272): n is a, c, g, or t
tcccctcccaagacccagccgccgccgttgagggctgagtccttgctgtggatgtgccagtgtccccaccaacaccaggaatttagaccttttcctgcaccactctcttatcctgggggctctgttacactaatttgaataaactctcccccttctttgcaacttcccagcaacaataatgattttcctggcaggccgtttcctggtccctaattccttttccaagaaactgttaaacaaggttaaaaaaaattctgttttaaaaacccggncccctaacccccccctaaggtaaaaaaacacaagtgtttttttgtgtcccaaaaaaaccttttatccccctggaaaaaa

SEQ ID NO: 594951 - DNA, 1382 bp, Homo sapiens
  misc_feature (66)..(66): n is a, c, g, or t
cggtgcgacgacgacgacgacacactcggacacacgacgacacacactgggacgtgacaaccgagncagacgccacgacgacgacacacgacggacacgacgacctgacgtgtgaacggacgacgacggaccacaggggactgacctgacgacgaccacgacgacgacgacgacgacgacgacgacgacactgacgaccacgacgaccttaacggacacgacgacccctgatgacgctctgaccaagataacaacgactgttggaccacgacaaccacgacacacgacgtgggacgacgacgacgacgacgacgggacgacgacactgacgtgacgacgacgacgacctgggaacgacgaccaagacgactcacgacgtggacgaccagcagacaccgctgacgacgtcggagagccgacgaccgctacgtcgatacaacagagaacgacgacgacgacgacgacgaccgacccgccaacgacgaccaaggacgacgaaaacgacgaccgaccccaccgtcggcgacgtgaaccaccgagccgacaggaagaccgacgcacatacggaccgaccaacatcacaagaacggaagacacccagacacgacacacaccggacgaccaagacacgcgacaggctggagccagaaccatcgccccatcacggcacgcacaggcaaaaacaaaacacaaagaacaccgcaacagaaacgcatgcaaaccacacacacagaaccgcccaatgacaaacagccccgaagaaacacagataggccccacgtaaaggacagaagaggagacgaatgaacgaccaagcaccctcccccaagacccaagaacgatgacagacacaatccgacaccaagagaagacggtccatcccaacaaaacgaaaccaaagggcatccaaccaacagcgcatggacgcaccccgaaacgcaagccgcacacgccgcaagcacgagcacagaaaaacgaaacccacgcggccccaagaggcaacaacgaaaaccagcagcaaagcaagcggcacagccgagacacacacccaacacacaatccacagcaaacaacaatacacaggacacacacgaacaacaccaaacacccagggaacacgcgacgcagaaacccccgaaccacacggggcaacaggccaagacgggaaagaggacacatacaccagaagccaacgcgggcaacaaaaaaaaaacacaaacggaaacagccgaaacacaagaaaccagcgcccccaccaagacgcacgaccaggacccccgaaaataaccaaaagatacacccaagaaagaacgagcaaaactccccgagaaggagagaagcagcaccacacaccagacagacaacacagaaaacagagaaac

SEQ ID NO: 594952 - DNA, 435 bp, Homo sapiens
tgggttaaaacagattctttaaatacaaggaatacaaaagcagtggaaatagtacccccagcgattacacagcttggaacaagtgaaactagggttaccaaacagctattttaataatagcatctacggggtcgggaaagggatgtaccaataaataatcggtagacgcatcagcgagaaacactccatttacttaatcacagaaaagggtggatctggctacatagttttctctcaagtgtcttcattcttcagaatcctccgaggcttacgaaagtgtcatcaatcttcaaaatcattctaaccattggtgtggcaagaagaatatcgtgtggcttttggccaatcaaggttctctatgacagtgcgtgtggcttcatatcattggtcccctggtgcaaacagtcgatgccaagagcagggttcatctccttc

SEQ ID NO: 594953 - DNA, 191 bp, Homo sapiens
gttcccccgatagccgacagacactcaaactcaagctagtgaatgtgaactcttctcttgactaccctatattctccctttgccagaaaagaacttcaccaattgtgctgaaacaaaaatctgctaatcatgtgagattcctctctttccttcaaggtcccctgttccctcccctgtcgggctagtcgggg

SEQ ID NO: 594954 - DNA, 361 bp, Homo sapiens
ttaagaaagtaaaaaaaaaaaaaggaggtagccggtaaattatttaagggactggtggggctacacaggcctctgtcacaattactcaattctgccagaaatacgggacgggcccaggcagggtgccattaaacttttatttacaaaaataggcagggggccagatttggcccccggggtttggccccctggccaatcccctggttctaggacctccaaggtcttttcggggccaagaaatgtaacccaatttttcttccatttaaaccaatatatggattcttgggctggttgggtgggagggtacgcactgggggtcccagatgtctcagattccggaaatccatgggccataaagctg

SEQ ID NO: 594955 - DNA, 169 bp, Homo sapiens
tcacccatcgttggacatgtccgctaaagtggttaccggtgggcttcctctcattcccatcactctatctttcttcatcatgtcccgcagcacgcccgctctttccccatttgccccaaacaccaacttttcaaaaaatcaagcagctccataattttcccttacactt

SEQ ID NO: 594956 - DNA, 1567 bp, Homo sapiens
  misc_feature (286)..(286): n is a, c, g, or t
  misc_feature (1384)..(1384): n is a, c, g, or t
tgccggcctccttgtattaggcgccccgacggtggtgtgtgcgccgacgacgcatacgaccgctggcgttttccgcccgagagacgtgtgttgtgtgtgggagcccctccctcgatatgttggtgtggcccccccgcgaccagcgagtgtgttcgcccacgggagccaccagagcccgccgcgtggggggcgcccccttatacgctccgccccgcgggcaggttgaccacgggagctgtctcctgacttcgtgtgggcccggaccaccacatgatattgtggcgcnccccgcccggtgtgacaatctgctcttctcgtgccttctgtagtggggagtatcggcctcgttttgccccacgtgtggagccacgaggcgcttgtgtttcctggttggagagccccacggaggggaagtgctacccccccacagtaggcctttctggccttgttgggaagaccccacaggccccacaagcccccacagaaattttggggtggaaaaaatacgtgggaagcccccgtgcggggcccccattagggttgagaaataaagacccatagggcgccttttgtggcgtgggcccgccttcggtggtgggttgacgcccccgttgggggtggacacaccgttgggtgtttccccccccagcagcggagattgttcacaacattgtgcgcttggcccccaacattttggcggccgagacgccacggtcctccagaggagccgcacaagatgcgcgcaagggccactttcccacaaggttgtgttgtgtgtgggacgatgtagtgtgcgtccgccccccacaacgctcgcgcgctgttcacacaggggtttgcggcgactttcacaacgctgtaaccacaacggccccttctcgcagcaccacttctgtgtgggtgggcccctctggtgtgggaagaggagccactctggggcccacacaacagggtggagacaacagaagagagagcctctgtgtgttgcgcactactgcgtcgtgagagcctctacactacgcgcccacacgccccacttttggctttggagaggctctctctggggcgtctcgcccctctgggagccccacacacacgtgtgttgagccgctctgatagtgtgattagtgcccgccacagacgtggtgcactctttggtgttacacactgcggtgacacgctgtgggttagaagggcgatatgcgagaggagacgcgctgaggatttctcacagagggcccccctgagaagagatatatggcctgcccccttgagagagaaggaattattgaaggagaggtttgtgtttgtgaatttcttgtttgaaaggaagaagggtgaaggaaagaaggagaggaataactaattatacccatctcctttntggccctgccagcatagtcatagctccccagaatattccagcttccagctttaactgcaccagacactttaaagcttttctggtttagattgtgtttccacttggtgatcatgtcttttcccaagtgtaccctgtcaatatttttcccatcatatctccaagtaaagtccattaaccatccca

SEQ ID NO: 594957 - DNA, 100 bp, Homo sapiens
tcgaagatggcggttggctctggttgctccgaccccgagtggctcagccctggctcccctggcggcggagcccccttctcccgccgctggcggcagcagg

SEQ ID NO: 594958 - DNA, 174 bp, Homo sapiens
tgtgcttggtcaggtacacctcagtaggtgtctcatgatgatagcaggagggtatctgaaggctctaacactttggcatactgggggctctaccaacatgatcttatgatggctctggagatgtgctctccacagatttcagcacagacttcatctgagcagcagggaaagaca

SEQ ID NO: 594959 - DNA, 236 bp, Homo sapiens
  misc_feature (3)..(3): n is a, c, g, or t
tgntgggattacaagcgtgagccactgcacctggccctaatttttgtatttttagtagagatggggtttcaccatgttggccaggctggcctcgaactcctgaccttgtgatttgcctgcctcagtctcccaaagtgctgggattatatatgtgagccaccgtgcctggctgaaatttttattaagtaaaacgtaagttcacttgctcattgccacagtcaaagaactaccatgtt

SEQ ID NO: 594960 - DNA, 87 bp, Homo sapiens
gcggccgcctactactactactactgctcgaattcaagcttctaacgatgtacggggacatgaataaagcaataaaatttgattgtt

SEQ ID NO: 594961 - DNA, 417 bp, Homo sapiens
  misc_feature (250)..(251): n is a, c, g, or t
  misc_feature (371)..(371): n is a, c, g, or t
tttgtggttagtaagtttaattcaaccattatacccagttctgcctcataaaaaattaacaaaatgttcctatcaaaattgtattatcgctgggtggtggttgcacatgcctttaatcctagcacttgggaggcagaggcaggcggatttctgagttcgaggccagcctggactacagagtgaattccaggacagcccgggcgacacagatgaaaccctgtctcaaaaaaaacaaaacaaaacaaaacannaaaaaagtattataatgtaagggcaggtttccttgctctgacacagtgatagaaaaatattgggcaccagatacactttaaaaaaagttttaatgcttaatgtaaggtgacaattgtatnttactgggatttagctgggcactaatttacagattcacactctgag

SEQ ID NO: 594962 - DNA, 182 bp, Homo sapiens
  misc_feature (90)..(90): n is a, c, g, or t
  misc_feature (92)..(92): n is a, c, g, or t
cgacatggggtatgtacctggatgatgacttcttttgctttatattcctcttgcagggccttggggagtgcgcacacaaacgccttggangntgattacatggagtacagaggacaggcaaacaggactctcgtcagaagagacgtgcaatatgagacctttgtgactagattaaatatatc

SEQ ID NO: 594963 - DNA, 868 bp, Homo sapiens
ggtggccggtcggcactcgaggctcgtgcgcccatgcggccagctcgctcgcgcctcggcgtctgtccttccagcttgcgcgtagttgagctgaggcggtgtgtgtgcggggagttgcaatgtgcaatcgcccggtggccgggtgcgttgtccgcttgacctgtatgggccaaccgctgcggcgatggtccgtgctgtgggtaggagagcatacttggtggcctcgtatgtgcgaagtggggggttgatagctaacagcttcacttggcctcgaaggacataagttcctcagttcgtcagggactcccccggaagtaagctctacgagatcttactgatggtagccgagaatggggcaaagaaggccattatcgggtggcgtaggtaacaagtagtatcgacgcttatgcgggcatgttattcgggtccctggcatggacggcccgtgaataaagctccttgcatttgcattcaggatgacttgaaacgcgatgggttaatcggccttatcatgggggtacgagcattaattcatttgggggctcttcagaccaggaagtggcagccagggaacggaatggaacattgcctgggggaataagagacgaagggccggagtaggactaaactagttggaaaggctagtggaattgggttccaacaaagtagtagacttggaatgggggcgcttgcactggctagaagcaaagagattattccttcgggagaccgggtattgtactacgaggcggaagagaagctattagtcctactggtaataacctgggccctttttacccactacactggcagaaagcaaggacacgtggaggtcagcttgcaggttccaggttggttggggtttccg

SEQ ID NO: 594964 - DNA, 378 bp, Homo sapiens
ggtactggaggatctctagagtgacaggctccagcgttaacgatctttggatggtcagcgcgggtgctcacgtgtcgacggaacttggttcagggaggcatgcaccgcggtggtgaatacacgtcgaccaggctccatgtttgcgttattgggtggtcagcacggtgctcacgtgtcgagcggaacttgtccagggaggtatgcaccggcagtggtgaatacacgtcgagctgcgggcatgcctgcctgctcgtggtactggagtgatcctctacacgtcgatccaggttccagtcttaaacgagtatttggcaggtcagcaccggtgctcactgtgtcgaccggaacttgtacatgggagggcatgcacctgcacgt

SEQ ID NO: 594965 - DNA, 116 bp, Homo sapiens
tggttagtgatgttgagcatctgaaaaaatgctaatttttcatacatatcttttctggtgaggtgtctgttctaaatttttgctcaatgtttcttgcaatagttttcttattgttg

SEQ ID NO: 594966 - DNA, 575 bp, Homo sapiens
  misc_feature (444)..(444): n is a, c, g, or t
  misc_feature (453)..(453): n is a, c, g, or t
  misc_feature (457)..(457): n is a, c, g, or t
  misc_feature (520)..(520): n is a, c, g, or t
acattctttctcagttttatagatccctcaacaccaaaaaatccccagaccttttttctagattattcttacatatgcattagattttatttacctaaatcataagatattaggtatagaatttttaccatacttacaaaatcataccctgcagctgggagaaaggcaaaagaagaaaaagagaaagagaagattgaaagaagaggaagggatagaaagcagaaaggtttctgctataaaggagacacaaaagaaagagatgaaaagggtgaaaaaaatgaggtggactaatagatataagtgtgctcacagagcatcaccatgtccttattttccaagcttcacaatcagaacccccacccacccatcctacagtcaaaacacttcaggcaagagatcaactgggcttttttattcctcatttaatgatactgatcactcttnctgacggtngcangacaatgatgatgggctgggtccagagtcgcagcctcctccctctccagaagctacccatctntgtaagaggccacagacaaacacgttcccttattgtgcatcccctctttggggct

SEQ ID NO: 594967 - DNA, 393 bp, Homo sapiens
ggggggaaaaaatggttgttatttagcggtccgtcgcaccagtaagcaggggaaccggtccctcacctgtttctggccagcatctccgcccacctccgttattgggcccaggggcccatgccggtattttaatttatttgtaagataggctcctggtgcccacctttggaagtgagcggcagcccagctcaggagtttagcaagcctggcacatagtagccccgtctcgctaaaaatttaaaatttagcctggcatggtggcggacgcctgtgatcccagctactcgggaggctgaggtaggagaatcgcttgaacccaggaggtggaggttgcagtgagccgagatcgcgccactgaactccagcctggcaacagagcgagactccatctca

SEQ ID NO: 594968 - DNA, 559 bp, Homo sapiens
  misc_feature (466)..(466): n is a, c, g, or t
ggcagtttgaatcgcgcggtgcgacgaaggagtaggtggtgggagtctcaccgtgggtccggattagcctttgtctcttgccttgcgttgcttggatgcttcagcgtgaattcgaaattgtgcttggcggtaagtgctggaaatggactccgggaataggccaatgactaataggtggttttccctgcatctgcaggagagctcggctttgcatagttcccaggtgggacggcagatattcaatcgcatccatcgctaaagatgctgaggtacggaagcaggtccatggtgacgttgatgggacgctgtatctgcacgcatgatgataccagtcagcagtccaataccgtgggatgtaccttcgacgcgctagaagggatagcttgcaatttggcgatggaaatgcgatccataaatgactttgacaggtcaaagcagtatttaccaccttcggtcgacgtttgcnaacgtttgcgtatgtacgtgtgaggatggaagaaatcggggatttcttgatcgatttcaagggcatgaataaattgggctggtgttgggtggg

SEQ ID NO: 594969 - DNA, 209 bp, Homo sapiens
aaacagtgccactgctactgccaccagtggaattcatcacagagatattcacggctcccaccccatctcttggctatcggtttttgtggggcttctccagcttgagaccctccgcgctcacgctgggaagcgcgggaataaccctcaggataccctgaatgacatgccacagacgaaccatgtcctgcataggctgctggctggcagct

SEQ ID NO: 594970 - DNA, 112 bp, Homo sapiens
gcccagacaagtggggtccccgcaagtgaggcactgtgttaagacaggttctgttccccatgccgcgcaactgggtgagagcctccagtagaggttgtcagacgacccaata

SEQ ID NO: 594971 - DNA, 218 bp, Homo sapiens
gggccagtacggatgtgtgtgtgtgtttttttttttcgagagggggtctccctatatggccaaagcgggtgtcaaactcccaggtgggtctctctccgctctccctctttctctctctttctctcaccggtctcctcctctctcttgggagttttaagcccgggctctaaaccgggttaccctcggttctttccttaaattatgcttatcgggtgtca

SEQ ID NO: 594972 - DNA, 1735 bp, Homo sapiens
ggagagaggagaactagctgagttgttgtgtatctatttctcttctctgattgcacaaggtccccgagtgagggctttacttttaactttcttgacatattcacaggtaccgagggcgaatcacttggtcactctcgttgagtgccgcagatagtccgcggacaagagccggtggccgctagcgcgcggcgccatgtacagcgtccagcacaagcgacagggtgtgtcggacaagttgattcatgtactcctacgagtggaatgaatcccggagccgtcttctcccctgttcttcaataaagaggggtactccggaaggtggctcagtgaccgggagtcgggagtaaggggtggaggtggcccagcattcccaggtgtcttgcagctggagacacgtgatgcgtccgcgtgtcatgtggggggggccacggatgggcattccacccggttggggaaaaagaagagatagtcgaactatatcgaggcgacgagcgctgagagctcgctctataacagaccgcgctgttggccacgggctcagggggccctcgcacgcgagggcctaatctcactgggaggtaaacccctggtacttggcgaacgtccaagctggggaatatctccacgaggagcagagagaataggcccagcgggtagggatccccgaggggccacgaccctgtgctaccatagagcgtcgaaccaagttgcgcagaggcccaactccccgtaggaggggcagcctccaacgcaaaagggggcaacaacactggacccgaggggggggccacacgtaccgcggaagagcacccccatgccagcgaggagtgtcgaaacacctcatgaaggactgccgggtggggcaagcccctcagtgcggccacaaagcagagttgctcgggactccctaccaacagtgtggcagaacaccgcaattaagggaaacgcgagtgcttagacagtcgggtggaccaacattgcctaggcccaagcgggcacacaggcactagagagctcccccgggaggccccatatcagaaatcacacagggggaagcattgccacaaacgcgaggcccgacacacggggggaagagaagagccccccgaggtggagcccaaccaccgcgccacgaaaccgtcgcaaggacacccccaggagggtgaacaaccccgggggggggcactgctcagaaaacggcagcgggcgcacgtatcccccggaacataattggcgagcacccaatgttgtccaatgagcccatataaggcgcccccccataagcgcgggctacccgtgtgccgcaagagacagccctgccaatgcgcccaaaaatccctgctaggcacacacacacggggctccaatggcgttagacacggcccacgtgcctaagacaataccggggtacccgagaccgcatgtcccaccccattcaaagcgggcgcacacacacggcatcgaaccccacacaacagcgccacccaacacggtagcgagaagccgccacaccctcgcatacgaacaaacacacagtagagaaacgggtgcaccaacatgagcaggtgactactacaccccaaactgcgcacgcgacccagcacctccgcacaaccccgcccccgtcctcaaacgacacacaaataccaagcgcaaccccaacacacccccacgccgcacaacgaatcggcagccataaaaaagaacaacacaacaaagacacgcacagtcacca

SEQ ID NO: 594973 - DNA, 823 bp, Homo sapiens
gcaacatgattaacagacttgacctaggagcacatgacctaagcacctaagagtatatatatgtacattttcaaaaatggaaaccaatacattctctgaccatggtggaatctggctagaaagcagtaataaacagaaatctgtatatgttggaaaaagtaaatctcaatggaaatcagaaaatatttggaactgaaattggtgatgaaaatactatatatggaaacttgtgggatatattatagctaaagctgtgttagaggaaatttagagccttacataaatacatatattataaaaggaaaaatattaaaagttaatgaactaagcatccatctccagaggtgtggaaaaacaacagcaaattaaatgcaaagaaagttaaaagaggtgaggccgggtgcggtggttcatgcctgtaatcccagcacttgtgggaggccaaggtgggtggatcacctgaggtcagaagttcgggaccagcctggcaacatgggaaaccccatctctactaaaaaaagaaacatgaacaacaaaaaaaaggaaacaaaatattagcatcaaaaatatcaactaggaccaaatctaagtgaaacctgaaactattcctttatgattagtccatttgtgctctttttaaaataaatttcatctctcgaggaggtttgccggtcatccaggttgggttggaggatgaaatcaggccagagtttgacttcctggtcagggactcccactaagcctaaatgtccacggggttcaggtgacccagccgattttatcatcggggggccaacgctgccggccccccgtgcagatcccg

SEQ ID NO: 594974 - DNA, 687 bp, Homo sapiens
ctcaaaaaagatctgttggtaggcaatgggaaggtgcattcatgtcatcctgcaggaggaattctccacgagttttgagcagcctcggttttcccaccacctccaaatcatggaagaaacagggtaagagcaaagacaaggtggctgtggccgatgtccaccctctcgtggcgtcccttctcttctctcctccttgagcagggagaccatcggggtgcaacctggccggggcggggaggaggtgcagggcattgccagagcgggcctgtccatgggcaagggacagcgacctcctgggccaggacatgtgagagctacgcaggcctgggcccggcgtggcggaggtgcgcgacagcggccagaagagggcgccagagtgccaggagccgcccgcggaggagcccgcaccggccccgatacccagctccgcgccacgcggacccaccgagcccgcgctcagacgccccagctccgccgagaggccgctcgcgccgtgtcctttctcttccccaagttcaggcagagtccccggagccatggccagcccttccagcagctccgaagccactggcaagccccgaggcagggatggccggcccagaagggagaaggaggaggacgtcccttccgaagagaagaggctggggctgtaactggaaaggggaagcgcacagcccgagggactgc

SEQ ID NO: 594975 - DNA, 229 bp, Homo sapiens
aggaccccggccgaggctgggcggtgagtctccagcccagctttcatggctggagcggggacgcagctcgatctccagctccggcatcgtgcgtctcaggtctgtgatctccgtctggctgggcctggatcatttctgtgtgggaggccacctcttggttcagctcctcagtctggctgaagaaccaggcctcgacatcccggcggttcttctccgccagggcctcgtg

SEQ ID NO: 594976 - DNA, 339 bp, Homo sapiens
  misc_feature (31)..(31): n is a, c, g, or t
  misc_feature (167)..(169): n is a, c, g, or t
ggaatttttaaaattttttggggggcccccngggggggcccccccaggggggcaccccccctttttccccctttttatttgggcccgaatttaaaccccccttttttttagggggtaagtggggttggggggccccccccccccccggggtttggggattaaaaaannntttttttgggggggtttttttttttaggggggtttttttttcccccccggggggggggcccctttttttttaaaaaaacccccccccgggggggggggggtttttttttttcccttttttccccccccccggggggttttccccctttttagggggggggggggggccca

SEQ ID NO: 594977 - DNA, 956 bp, Homo sapiens
gaggtggcagctggaaccgcgcactgcgacgggaacacgtaccgctgtcttgggtcaggttcgccgagtcgcgggagccccgctgtgcagtcggaggaacacgtgcgccatcgagtaatccattgagacaacccattctgcaccaccttgcttgagtccattggcatccgtgtacaatcaagtgcaacagaagattcttcaattcgacataacatgggatggcattcgaacgcatcatggagcgcttgaccatgtgatcgatcagcagttcttcctgggcaacgcagacccatatcggaaattagtgaatgcagttttcggggctgcaagcacacacaggaatattgcaacacactattctacattcggcacatgctccaccgcaagccaccaccgcacactatagcacagctgccccgctcctcacaggcgcttgtcatcggctgctcaataccctttgccgagcgtcacacttacaaacagggatggtagcccgccagcgcattgctggcgtataggaaccttctcgtggccttggcaattgcgggattgcaattgccatgggtggtagagacacagggtataagggacgcgaagcaaatcccacggcaagcacaccatttaaacagcccccttgagtcgtagagctcctgtcgtgcaaatcctttggttcaacttacgccattccacattggcccacttacccgcagctgcttgcgcagtctctccgcaatccagtcaacaccgtacgcccagagcacccaacgagttctcacaatcgagacacgcaaacttcccagcgggcagccggtagcgcacactatgtggccgccacgccccatccctcacgcacagcacggccgaacatctctggcacactaccagagcttcaacacgctcgcgggcggtcatcacccctcaggagagcatcacttctcgcacgcgaaaaagaatcg

SEQ ID NO: 594978 - DNA, 428 bp, Homo sapiens
cagcagtggtgtcagcgagaagaattgcttgacagtcaggaggtgggaggttgcagtgagtccagatcgcaccactgcactacagcctgggtgacagagtgcaggctgtctcaaaaaaaaaaaaaagattatgggccagttggtggcttgcccccttcttgtgccttatgattgggcccctgttgatttcctcagccacttctcttgtggtgccccagtgcttttggtctgcactgggccttcttggatctcgggcttaacttttgctgtccccactctctgccgaggacacatttccctttgtgtatttcccatcggttatactaacctagtaaatccctggtgtccccatttggtttctcatgtcaaccagtatttcctgagggcagtcttccctcagcaccgagggtcccggagctcggaatcgg

SEQ ID NO: 594979 - DNA, 226 bp, Homo sapiens
cgcgtaccagttgcggttcaccgtgtggcgtaggtccggctgcgagggtgctgcactcgtgtggtggttaccactcccactgacttccctgctttcttggcccgattcgtcacggagactacctctgttgccggcgtgtcggtgttgcacgtggttaaacgcgggcggctgcactcaatgccaatggtctggaagttgcccttgaccccgcaactggtacggcggg

SEQ ID NO: 594980 - DNA, 355 bp, Homo sapiens
atcaagcagaagggaattcacatgtattccatgtgcacagcattttggatagtctactaatggtataatataagtatcatatttgttttcattttgaaatatatttggggggatgcccaagcctgctgtacaaactacagtaagaagtgattctcacttggtgttagatgcccttttgattcttaaactatgagaagtaaagcgcgtggttttgtggcttttagttgtaacagagaacaatcatatcaagaaccagagccatattttagttattcttgtgccgaatagtatttcccaaaagtctatgaaaaaataaaataacaagcataagggtactttttaataacccatccta

SEQ ID NO: 594981 - DNA, 288 bp, Homo sapiens
agcatgtctacgccgtgtagaggagggcatattgcgagggctgatacgtgtgccaccttggagaaatgtgccacgtgctcccagttccatactggagcggattctgcgggctatggggaaggcctaccagcctggctgcttcacctgcgtggtgtgtcaccgcggcctcaacggcatccccttcacagtggatgctacgagccagatccactgcattgaggactttcacaggaggtttgccccaagatgctcagagtacggtggggccataatgcctgagccaggtca

SEQ ID NO: 594982 - DNA, 333 bp, Homo sapiens
cgctatcgccggtgccgagccgattccgttgtatcgcccggaagtgccgatctattcagtggacatccccgctgcgcaggtcatgacgttgcaagccctgggtaccttccatgaacgccagggcgagcaaagcctgctgaccgggaccggtgcaatgccggcaggttggggccgcgcctacggcagtgacttcaacaagagctggtcgggcacgggggcgcccagttttgacggcacgtccaggggcttccaggtgggccatgacctctatgccagcgaaaccagtggcgggcagactcaacgctttggcctgtttatcggccagagtcgcct

SEQ ID NO: 594983 - DNA, 2885 bp, Homo sapiens
  misc_feature (2854)..(2854): n is a, c, g, or t
gagcggggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccatcgtcaatctgccaggctgcagtgccaaagagctggccccggctgtgtcagtgctccagcttttctgcagctcacccaaggctgctctccgctatgctgctgttcgtaccctcaataaggttgccatgaagcatccgtcagctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtgctgtgagtgctctggcgaagtttggagcccagaatgaagagatgttacccagtatcttggtgttgctgaagaggtgtgtgatggatgatgacaatgaagtaagggaccgagccaccttctacctaaatgtcctggagcagaagcagaaggcccttaatgcaggctatatcctaaatggtctgactgtgtccatccctggtctggagagggctctgcagcagtacactctagaaccatcagaaaaaccttttgacctcaagtctgtgcccctggccacggcgcccatggcagagcagagaacagaaagtacccccatcacagcagtcaaacagcctgagaaagtggcagctaccaggcaggagatcttccaggagcagttggcagcagtgccagagttccgcggtcttgggcccctcttcaagtcctcgcctgagcccgtggccctcaccgagtcagagacggagtatgtcatccgctgcaccaaacacaccttcaccaaccacatggtttttcagtttgactgcacaaacacactcaatgaccagaccttggagaatgtcacagtgcagatggagcccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctggatgtcacctgcatcgtcactgtgtncaaaagcagcagactggagcgcaccaggatg

SEQ ID NO: 594984 - DNA, 3014 bp, Homo sapiens
gagcggggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccatcgtcaatctgccaggctgcagtgccaaagagctggccccggctgtgtcagtgctccagcttttctgcagctcacccaaggctgctctccgctatgctgctgttcgtaccctcaataaggttgccatgaagcatccgtcagctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtgctgtgagtgctctggcgaagtttggagcccagaatgaagagatgttacccagtatcttggtgttgctgaagaggtgtgtgatggatgatgacaatgaagtaagggaccgagccaccttctacctaaatgtcctggagcagaagcagaaggcccttaatgcaggctatatcctaaatggtctgactgtgtccatccctggtctggagagggctctgcagcagtacactctagaaccatcagaaaaaccttttgacctcaagtctgtgcccctggccacggcgcccatggcagagcagagaacagaaagtacccccatcacagcagtcaaacagcctgagaaagtggcagctaccaggcaggagatcttccaggagcagttggcagcagtgccagagttccgcggtcttgggcccctcttcaagtcctcgcctgagcccgtggccctcaccgagtcagagacggagtatgtcatccgctgcaccaaacacaccttcaccaaccacatggtttttcagtttgactgcacaaacacactcaatgaccagaccttggagaatgtcacagtgcagatggagcccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttattgaaaaacaattaggaatcattgcagatttttttttattctgctcccacctcccacccgggactacttgctggtgacttttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattgaa

SEQ ID NO: 594985 - DNA, 724 bp, Homo sapiens
  misc_feature (15)..(15): n is a, c, g, or t
  misc_feature (18)..(19): n is a, c, g, or t
  misc_feature (21)..(21): n is a, c, g, or t
  misc_feature (39)..(39): n is a, c, g, or t
  misc_feature (41)..(41): n is a, c, g, or t
  misc_feature (92)..(92): n is a, c, g, or t
  misc_feature (130)..(130): n is a, c, g, or t
  misc_feature (145)..(145): n is a, c, g, or t
  misc_feature (176)..(176): n is a, c, g, or t
  misc_feature (361)..(361): n is a, c, g, or t
  misc_feature (371)..(371): n is a, c, g, or t
  misc_feature (384)..(384): n is a, c, g, or t
  misc_feature (448)..(448): n is a, c, g, or t
  misc_feature (474)..(474): n is a, c, g, or t
  misc_feature (540)..(540): n is a, c, g, or t
  misc_feature (551)..(552): n is a, c, g, or t
  misc_feature (554)..(554): n is a, c, g, or t
  misc_feature (573)..(573): n is a, c, g, or t
  misc_feature (597)..(597): n is a, c, g, or t
  misc_feature (618)..(618): n is a, c, g, or t
  misc_feature (652)..(652): n is a, c, g, or t
  misc_feature (658)..(658): n is a, c, g, or t
  misc_feature (681)..(681): n is a, c, g, or t
  misc_feature (685)..(685): n is a, c, g, or t
  misc_feature (691)..(691): n is a, c, g, or t
  misc_feature (695)..(695): n is a, c, g, or t
atacggctaggtagnggnngngtggtggagattaggtcnangcgcccgcccagaggcaggcagtccgcgagcccagccgccgctgtcgccgncagtagcagccttcgccagcagcgccgcggcggaaccngggcgcaggggagcngagcccggccccgcacagcccagcccagccnagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcnagcagagaanagacattcacggnatggtgtaactcccacctccggaagggcggggacacagatcgagaacatcgaagagatcttccngggatggcctgaaagctcatgagtgnctgcgtggaggtcatgcttcaggtgaacagcttgagccaagccagagcgaggcaagatgagagtgnacaagatctcnnangtcaacaaggccctggatntcatagccagcaaaggcgtcaaantggtgtccatcggagccgaanaaatcgtggatgggatgtgaagatgaccctgggnatgatntggaccatcatcctgcgctttgncatncagganatcnccgtggaagagacttcagccaaggaaggg

SEQ ID NO: 594986 - DNA, 2449 bp, Homo sapiens
gagcggggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccatcgtcaatctgccaggctgcagtgccaaagagctggccccggctgtgtcagtgctccagcttttctgcagctcacccaaggctgctctccgctatgctgctgttcgtaccctcaataaggttgccatgaagcatccgtcagctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgacttttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattgaa

SEQ ID NO: 594987 - DNA, 1801 bp, Homo sapiens
  misc_feature (5)..(5): n is a, c, g, or t
gcggncgcctactactactaaattcgcggccgcgtcgactgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtgctgtgagtgctctggcgaagtttggagcccagaatgaagagatgttacccagtatcttggtgttgctgaagaggtgtgtgatggatgatgacaatgaagtaagggaccgagccaccttctacctaaatgtcctggagcagaagcagaaggcccttaatgcaggctatatcctaaatggtctgactgtgtccatccctggtctggagagggctctgcagcagtacactctagaaccatcagaaaaaccttttgacctcaagtctgtgcccctggccacggcgcccatggcagagcagagaacagaaagtacccccatcacagcagtcaaacagcctgagaaagtggcagctaccaggcaggagatcttccaggagcagttggcagcagtgccagagttccgcggtcttgggcccctcttcaagtcctcgcctgagcccgtggccctcaccgagtcagagacggagtatgtcatccgctgcaccaaacacaccttcaccaaccacatggtttttcagtttgactgcacaaacacactcaatgaccagaccttggagaatgtcacagtgcagatggagcccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgacttttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattgaa

SEQ ID NO: 594988 - DNA, 800 bp, Homo sapiens
ttatcatgcttggctcaagactgcatcatttctgagggtctctttggctactgagttgggggcaggagacgatactgtatccgaggagcctcctgcatgtcctgctgccctgagctcactcaagctaggtgacagcgtgtgaatgctgccaccatgaatgaggtatctgtcatcaaagaaggctggctccacaaacgtggtgaatacatcaagacctggaggccacggtacttccttctgaagagtgatggatctttcattgggtataaggagaggcccgaggcccctgaccagaccttaccccccctgaacaatttctctgtagcagaatgccagctgatgaagactgagaggccacgaccaacacctttgtcatacgctgcctgcagtggaccacagtcatcgagaggaccttccatgtagactctccagatgagagggaagagtggatgcgggctatccagatggtcgccaacagtctgaagcagcggggcccaggtgaggacgccatggattacaagtgtggctcccccagtgactcttccacatctgagatgatggaggtagctgtcaacaaggcacgggccaaagtgaccatgaatgacttcgattatctcaaactcctcggcaagggcaccttcggcaaggtcattctggttcgagagaaggccactggcgtattatgccatgaagatcctgcgcagaggtcatccattgcaaggatgagtcgccacacagtccagagagccggtctgcaatacaggccccctcttaagcctcaagttgcttcagacctgacg

SEQ ID NO: 594989 - DNA, 365 bp, Homo sapiens
  misc_feature (237)..(237): n is a, c, g, or t
  misc_feature (282)..(282): n is a, c, g, or t
agcggattgtgggcagaggggcgggggttgggaagatggcggctcccagcctcctcaactggaggcgagtttcttccttcacggggccggtcccccgcgcccggcacggacaccgagcggtggccatccgggagctgatgatcatctttggagggggaaatgcagggccatcgctgggatggatgcttgcatcagtctacaaacagcggctaccgaaatcacgtgggtttctagcancagctgttagaaggacgatatcgcctccatgggctgtgctgcccnatggactttgtctgtgactggtaccatgaactattacgtattctggggggacactgggttcgacactacttgggaaaggacta

SEQ ID NO: 594990 - DNA, 653 bp, Homo sapiens
tttttttttatacaggttgctcaagctaattttattctttcccaacaggattccatttgtggaaaattattcaagccttttagaaatgtgtgcgcacgcaagaaaaacgcggacttacgcaggaacggggagtttggggaagaagcttcctcctgtggttttgactttagggattgaaggcttccgaggcgtgctgtgccagaacaagtggagtctcaccaacgcagaacaaacacgtgtttctctctgtgaattagaggatgttcccaccattttctcaaggcgtgttctacgttacaagtttcaccacaggtctcccttctttgcgagacgagttgagtctcacgtcttaaccctaatatattctcccccatccaaaaggcgggtttgcgtgaaacgtttcgttttgaaacatatgtgccaagtgccctccacacacttttccaaaaccactcttgttattatcacaacgtgtgtctcacaccccaaaccttggggctaatgtgaagaccaccacattcacaatattcacaatttgaaccacattttgaccgggcgtgcttttgtgccacgatcacgacagcgtgtgggttttagcgacacgcttgttgccaccttgcccgggcctattgaccttgcaatgtgcgcacaaa

SEQ ID NO: 594991 - DNA, 354 bp, Homo sapiens
cgtcgccgggagggttgctgcgcggaagccagcgacggtgctggggtgatgtcgacctttgtatgacaacgatcccgacaagatggaaagaggatatgtggttgtcgacacgcggtatgccgagtggcgaacgaggtggcccaaggtggtgaccgagtgcgacactcaagccgccgctggtctggtcaaggagtactactccaccatgccaagtggtcggcagaagtactcgggttcgcagttcgaggcgattgccgcgcgcaacccagacctcaacagcatcgacacagcggacatcgtcgccgtttctatgctcagcgtcgacgttcccggtcccgcagcactgcgtctgtc

SEQ ID NO: 594992 - DNA, 1813 bp, Homo sapiens
gagcggggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattcttcatctataaccgagtggtcttggagcatgaggaggtccgggcaggtgctgtgagtgctctggcgaagtttggagcccagaatgaagagatgttacccagtatcttggtgttgctgaagaggtgtgtgatggatgatgacaatgaagtaagggaccgagccaccttctacctaaatgtcctggagcagaagcagaaggcccttaatgcaggctatatcctaaatggtctgactgtgtccatccctggtctggagagggctctgcagcagtacactctagaaccatcagaaaaaccttttgacctcaagtctgtgcccctggccacggcgcccatggcagagcagagaacagaaagtacccccatcacagcagtcaaacagcctgagaaagtggcagctaccaggcaggagatcttccaggagcagttggcagcagtgccagagttccgcggtcttgggcccctcttcaagtcctcgcctgagcccgtggccctcaccgagtcagagacggagtatgtcatccgctgcaccaaacacaccttcaccaaccacatggtttttcagtttgactgcacaaacacactcaatgaccagaccttggagaatgtcacagtgcagatggagcccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgacttttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattgaa

SEQ ID NO: 594993 - DNA, 2708 bp, Homo sapiens
gagcggggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccatcgtcaatctgccaggctgcagtgccaaagagctggccccggctgtgtcagtgctccagcttttctgcagctcacccaaggctgctctccgctatgctgctgttcgtaccctcaataaggttgccatgaagcatccgtcagctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtgctgtgagtgctctggcgaagtttggagcccagaatgaagagatgttacccagtatcttggtgttgctgaagaggtgtgtgatggatgatgacaatgaagtaagggaccgagccaccttctacctaaatgtcctggagcagaagcagaaggcccttaatgcaggctatatcctaaatggtctgactgtgtccatccctggtctggagagggctctgcagcagtacactctagaaccatcagaaaaaccttttgacctcaagtctgtgcccctggccacggcgcccatggcagagcagagaacagaaagtacccccatcacagcagtcaaacagcctgagaaagtggcagctaccaggcaggagatcttccaggagcagttggcagcagtgccagagttccgcggtcttgggcccctcttcaagtcctcgcctgagcccgtggccctcaccgagtcagagacggagtatgtcatccgctgcaccaaacacaccttcaccaaccacatggtttttcagtttgactgcacaaacacactcaatgaccagaccttggagaatgtcacagtgcagatggagcccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaaggtaaaatcctgggaatgccatctctggcctaattactgttcaagatctttggctactattgaagtgctcatcccttttctctccaaggatccagggccatgtctggagcacatatgtcaaatgccacttcattaaaagcccttcagaacatgggggagtggtggtggcacaaagggcagataagatggcttaacaatattgggattt

SEQ ID NO: 594994 - DNA, 475 bp, Homo sapiens
gtaacgtcaaaggcagcagggtcagcaggtggcggaggcgaggcatgtcggtttccttgtcgtggtgttgtcgaagggttccatggcacgggccaggctggcttcggagagttcgcccaggtggctgttgatcaggcgcccatcggcttggtagaacaacgtagtcggcaaggccatggaacccacggcctggccgaggcggccgctggcgtcgaacagcacgttgtcgaggttcaggccctgggtggccaggtaagtgctgacgctttgcatgctttcggcctggttgacgaacaggaagggtcaccatcggggcgcatgcgctgggcgttttccagcaccggcatttcgcgtcggcacggcgggcaccaggtggcccagaggttgatcaccaacgggccgccttgataatccgcccagttgcaccaccatcagccaattggcaattgcgcagggtgatatcccggcagggcgc

SEQ ID NO: 594995 - DNA, 243 bp, Homo sapiens
aaacttaggaataactagtcattgctctctaaaaagaacagacctaaaaataaagcagcagcccataatacttactatgccagttcttttagcatttggttatttaaaccggcagtccctaacctttttggcaccaggtactggtttcacggaagacactttttccactgacaagtgtggggatggtttggagatgaaacggttccatctcagatcatcagtattagattctcataagcgggg

SEQ ID NO: 594996 - DNA, 1874 bp, Homo sapiens
gagcggggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtccccctcttcaagtcctcgcctgagcccgtggccctcaccgagtcagagacggagtatgtcatccgctgcaccaaacacaccttcaccaaccacatggtttttcagtttgactgcacaaacacactcaatgaccagaccttggagaatgtcacagtgcagatggagcccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgacttttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattgaa

SEQ ID NO: 594997 - DNA, 2123 bp, Homo sapiens
gagcggggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccatcgtcaatctgccaggctgcagtgccaaagagctggccccggctgtgtcagtgctccagcttttctgcagctcacccaaggctgctctccgctatgctgctgttcgtaccctcaataaggttgccatgaagcatccgtcagctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtgctgtgagtgctctggcgaagtttggagcccagaatgaagagatgttacccagtatcttggtgttgctgaagaggtgtgtgatggatgatgacaatgaagtaagggaccgagccaccttctacctaaatgtcctggagcagaagcagaaggcccttaatgcaggctatatcctaaatggtctgactgtgtccatccctggtctggagagggctctgcagcagtacactctagaaccatcagaaaaaccttttgacctcaagtctgtgcccctggccacggcgcccatggcagagcagagaacagaaagtacccccatcacagcagtcaaacagcctgagaaagtggcagctaccaggcaggagatcttccaggagcagttggcagcagtgccagagttccgcggtcttgggccctctgcagtcctcggctgaagcccgggcctcgccgagtcagaaacaggaagatggcaacgctgcaacaaacacacttcacaacacatgggatcaggagactgcacaacacaactcaatgacagacttgggaagc

SEQ ID NO: 594998 - DNA, 772 bp, Homo sapiens
  misc_feature (1)..(1): n is a, c, g, or t
  misc_feature (78)..(78): n is a, c, g, or t
  misc_feature (90)..(90): n is a, c, g, or t
  misc_feature (155)..(156): n is a, c, g, or t
  misc_feature (159)..(159): n is a, c, g, or t
  misc_feature (170)..(170): n is a, c, g, or t
  misc_feature (173)..(173): n is a, c, g, or t
  misc_feature (180)..(180): n is a, c, g, or t
  misc_feature (191)..(191): n is a, c, g, or t
  misc_feature (224)..(224): n is a, c, g, or t
  misc_feature (253)..(253): n is a, c, g, or t
  misc_feature (273)..(273): n is a, c, g, or t
  misc_feature (330)..(330): n is a, c, g, or t
  misc_feature (334)..(334): n is a, c, g, or t
  misc_feature (382)..(382): n is a, c, g, or t
  misc_feature (395)..(395): n is a, c, g, or t
  misc_feature (400)..(400): n is a, c, g, or t
  misc_feature (467)..(467): n is a, c, g, or t
  misc_feature (525)..(525): n is a, c, g, or t
  misc_feature (557)..(557): n is a, c, g, or t
  misc_feature (587)..(587): n is a, c, g, or t
  misc_feature (743)..(743): n is a, c, g, or t
ntccaaccctctgagtattgtgtttcttttgctcctggagtcctcttgcagctttatattcttgtatatatctcaggnggcagccccagncattatatccccaaagggcgtaggtattagtaaaccttttgctggtcattctttgtccgaatgcnnatngaacacaattnttnagccctntttttcatttnatgatggtcattagtatttaaaaattaagcctnatttgcttattgaaaataaaaacaaaaanacacacaaaaaaaccttgcngataataaatatcgcttattcacttattttaaacgaagtccaattttattcactctnaatntccttgcagtccattgtataccttctcgcactgacccttgtttcagtngctgtttgttacnttctnttgcttcctctgttaactgttcttttggaaaatccacatcaaaagtgattatcaaagagcccttganattgttgttgtaaaagttggggagcccttcccctttcttccatagcttcgctcctggnctggtgatcttatcccgggaaatatgtacctngtgaccatccaagttagtcatatccatctnaaagccaaccagtgactcaactaatgagattgtcacatttgtgtacaaatcatctcctctcctttcaaatattgggtgcttgaaaactttgattcggaaccgtaaatctccaggctccccatccacgtgagggtcaccttctccaataaaggggtnctccatgccgtctctcaccccaggctcta

SEQ ID NO: 594999 - DNA, 2389 bp, Homo sapiens
gagcggggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccatcgtcaatctgccaggctgcagtgccaaagagctggccccggctgtgtcagtgctccagcttttctgcagctcacccaaggctgctctccgctatgctgctgttcgtaccctcaataaggttgccatgaagcatccgtcagctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgcgggactacttgctggtgacttttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattgaa

SEQ ID NO: 595000 - DNA, 185 bp, Homo sapiens
tttttttggggggtttttggggtttttgcccccccccccccccccccccccctggggggtgggggcgggggcttcccccccgccaaaaaattttttttgggccgggggccccccttccccggcccttttttttcctgggggggggggggttttttttttattttaaccaaggggttttcctttta

SEQ ID NO: 595001 - DNA, 524 bp, Homo sapiens
gtctaacaggcgctactgaagtgtagtgaatagtttatcaatcaggtttttgcagtaagcttgtcttcccgtctggttccccgagagcttactgagccctgggcccgaagcacgggccgggcatagatttcctcttccacaagctgccgcttggctgggcaccttgaagcatcagggcgtgaactcaaactagatgtgggcagggagagtgttgcttacctgccctgctggggcagggttccctgaaactgggttaattctttatagaaatgtgaacactgaattgatttgaaaaaatactaatacagattacaaatacttaatcataataataactacagaaaacaagtttacatgtatataggtcttgaagtgagtgaagtggctgctttatatgggtgggcttaattaggctttgggtagaagagattgagatgggtactctaatcaaaaataaggtttggtagtgggaccagaaattacttacctgacatccaccccaataccccctcatccgggggggg

SEQ ID NO: 595002 - DNA, 1770 bp, Homo sapiens
gagcggggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccatcgtcaatctgccaggctgcagtgccaaagagctggccccggctgtgtcagtgctccagcttttctgcagctcacccaaggctgctctccgctatgctgctgttcgtaccctcaataaggttgccatgaagcatccgtcagctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtgctgtgagtgctctggcgaagtttggagcccagaatgaagagatgttacccagtatcttggtgttgctgaagaggtgagtctagccaggggccctaatggggacagtgttcccttggacccaagcagctttcctttgtctttatttttttttaactgaaaagggagagaaaagttatacagctactgattgtag

SEQ ID NO: 595003 - DNA, 464 bp, Homo sapiens
  misc_feature (322)..(322): n is a, c, g, or t
  misc_feature (335)..(335): n is a, c, g, or t
  misc_feature (418)..(418): n is a, c, g, or t
  misc_feature (442)..(442): n is a, c, g, or t
atgattggttattgtgtctggtaagtctttgaacattcaacagccagacatttgtgttttatttcatgatgttccagtcaagttccaaagccctaacacagttaagctggctcagactccaggttctagtaaaaagttggaattaatgttataaggaagtattaaaacactgaaacatttctccagaaccagcaagtaagggatatgtatgtatttatgctcagttttagttggcctaaagcagagttgaatgggctttctaaatagctaggcctgcaggtacctgccactactcccatcttcagaggtatataagggagantgtgtagcagttngaggcttttgctgtttttaaaaaagccttatgaatcagcagcacatcgggaaaaataggctcacatagtacctgggttttccncaagtaagccaagggcatgatttnctgtggtacattttatttaaca

SEQ ID NO: 595004 - DNA, 455 bp, Homo sapiens
gatcatcacgtcacaacattatgacagcacgatgtgcatcacacacatcatgatatcaaacaaaatccgtagccttctcaatacttcaagccaactaggctagataatagtgacaatcggcatcaacctaaccccacctagcatttcttcacatctgcatgcacgctttcttcacagcaatactattcatatgctccggatccattatccacagcctcaatgacgaacaagacatccgaaacataggcggactgtataaagcaataccattcaatgacactgcatggaatccactgccatcaagtcggtgacgcattttaccatgctgcatggaatccactgcattcattcgggatccatatagccatgctgcatgtaatgcactgcgtttactcgggatgcattttaccatgctgcatggaatccactgcattcaatgacactgcatggaatcc

SEQ ID NO: 595005 - DNA, 232 bp, Homo sapiens
cggcggtctatagcttcagatgctcggacacgcgcccatccagattcgatatgttgggcgtgcatatggtccatcagtgtcctcgcgaatttgcaggttcctcagcaccgtgcccagctggcccacagtttcaggctgcgggagctcacagaagcgcctccgggcattgtatcctgggaggccgtggtccctgctgcgctccttgtacagatgcaggcaggtccagcccatt

SEQ ID NO: 595006 - DNA, 140 bp, Homo sapiens
cggacagtctcgaatggtactggttgaacattgtttgttggtgtatatgttgtaattgagattgctcagcgctatctcgaaatggttacatgaaaagatgctcagccgggcatgatggctcaacatacgtaatcccagca

SEQ ID NO: 595007 - DNA, 610 bp, Homo sapiens
ggacgcgtgggtcgatccatgcgtccgatctagtgttagtataagtaccatgaattgatttctcctccgtcataatcctgcgtcagattatgatattgaactgatccgattaacagtccaatatctactatcaaccaacaagtcattattaccctcacatgtcgaacgccagacacatgagtcggagtgctcataaggaaaggttaaacaaagtaccaggatactcggaaaatctgtggaccccgtccctgcttgtaccaaaaatatcacctctagcatcaccagtattacgaggacagccggctgcccaggtgatccacatgttaaacggaacgcggtaccctatactcgtgacagaggtagactataactcacttgtaccttatacatagggacctgtatgaatggctccacgagggttcagctgtgcctcttactttgaaccgagtgaaattgacctggccgatgcaagaggcgggactctgacagcggaggaagacgagaagaccctatggagcctttagattgacttaatgcacaaacagttatgctagctaaagcacatgaggtacctatactaacaaacctggctttgaaacatcctcggttg

SEQ ID NO: 595008 - DNA, 312 bp, Homo sapiens
tccgtggcagccctgcccgtttgtaagtttcaggtggtgattccgaaatcctaagcctgccttgcacctggttaaccgcactgctgcccctggcctcaccggcctcaggaaacggtggggcccctgcatttcggggtggttttgggaatcccaggccctaggggtcccatttgctcaggaagtgggtatcaaatttaggtgggggtgtcaaaggaggcaaaagggtcccaacttcggtcaggactttggtgggatttccccctcggcagggtccctgcccagtaactgctcaataaaggctgtgtgtgtgga

SEQ ID NO: 595009 - DNA, 128 bp, Homo sapiens
gcctggtcccaggaactggcaatctaacaggatggcaagtggttttgaaacatatatcctccagcattcagtccagggggagccacggaaaccatgttcttgcttaagccattaaagtcagagatgaa

SEQ ID NO: 595010 - DNA, 183 bp, Homo sapiens
gaatagtttaaaatctagcttacataaaaatagtatttcacaggctgggtgcggggctcacccctgtaatcccagcactttgggaggccgaggcgggcggatcaggaggtcaggagattgagatcatcctggctaacatggtgaaaccccatcgctactaaaaatacaaaaaaaaattagcca

SEQ ID NO: 595011 - DNA, 400 bp, Homo sapiens
cgtcgacttcgaaatggctgcaaatgcctcacaatcgtagtgcaaggcaaggaggagcaagtcacatcttacatggatggcagcaggcaaagtaagagcttgtgcagagtttttttaaaactacaaaatctcgtgagacccattcattatcatgagaagagcatgggaaagacctacccccatgattcaatcatgtcctttcgggtccctgacacaacacttggaaattatgagaactacgagatgagatttgggtggggacatagagccaaactatatctttccatgcctggccactcccaaatctcatatcttcacatttcaaaaccatcctgccttccccatagcaccccaaactctcgtcgacgcggccgcgaatttagtagtagtaggcggccgc

SEQ ID NO: 595012 - DNA, 310 bp, Homo sapiens
cactcgagctcggtaccatctcgaaagtgtgcactggcggcatctgtgggcggactcttcagtctacgatgtcttctgggtatgtggaccaatgtgatggtgacagtgggcaagtccttcgaggcaccaactaaaagtggtgtttccccaggatctgctggagaaagtgctcgatagaaacaactttgccatgctgggactcggagatgtcgtcattccagggatcttcattgccttggtgctgcgctttgacatcagttaggaagtagttaaaaaacgcgacttcctttttcacttcctcaattttctc

SEQ ID NO: 595013 - DNA, 134 bp, Homo sapiens
acctccaaataccgttaaactgaacctcggtgccatgcttcttcgccttggcctccccccagcccctcctccccttcctgcacccgtacccccgtggtctttgaataaaatctgagtgggcggcaaaaaaaaaa

SEQ ID NO: 595014 - DNA, 109 bp, Homo sapiens
ggagacgacgtgtcagacataggcacctcggaaaggggagggaaaggagggaggacaaggtaatcagcctcggacctaaggtggctgagggagagactgaatttggtgt

SEQ ID NO: 595015 - DNA, 869 bp, Homo sapiens
agcgacgtgaattagtattgtgaagaagggaagctggggcaggtaacacgcagagccagccacgtggaacggtctgtccgccggtctgatacccgcttgccgggcttctagtgtgacaagtcttggacttaacggagacttcctgtgggttgccattgatcgacacgatctcgttagactcttgattttatcaggatgagggtgagtttgccaaacggtgataaagaaaatgcagccaaccaggctcccgtctcacttaacgagagttctacacttaagtaagcactaaacttcttcctgacgaaactgacatccatcagttggtcttttggagttctgcaaggtgagtttccaggtgcacagcgccagcaaaccagggcgcctgcaggcatcagcgcacagcgcagctgccccatcgacgattccactgacaagggactggagacgaacaaacttcattgtccacgcgggtgagacgcaggagttggggccaccaagtggagtttccagacagacagttatatggggatcacaaggcaaattgtccaggcattggggaagattggacccagatggttcaatacaccagtgggagttgccaatacccaccacagatgccggtgaagcacaatgaaggggacgcaaatttggaggcctgctccgcataatagcgaaggtcgaatgggacccccatggagggaatggactcagccaaacataaacaggaggcattgggacccaaagttagtacccccaattgggatacaccgcggccaacccatttcaggcaggaccaccgcgagcacaaagtggtgacccattggggagcccatcaacaagcggtgagctgaaccgtatgcgaccacaaa

SEQ ID NO: 595016 - DNA, 167 bp, Homo sapiens
  misc_feature (15)..(15): n is a, c, g, or t
  misc_feature (43)..(43): n is a, c, g, or t
acatgtgtccgaaancagagctctcacggtgaatgtgcagggnagctactgggacttttctgataccgtaggtctggtttgcagggaggacctgagaatccactagcaagggagtttctttttaaaacattttgttaatttttttgagggagtcttgctctgttgtc

SEQ ID NO: 595017 - DNA, 702 bp, Homo sapiens
tcaatggcttgactatggaagctatttcttatccatctaatagtttattgcaggtgtttctggtaggtggggattggggttgtggccaagggactaggcatatggataattcctaccttgcctttttcttcaccttcacaatgcccatccttgtctcttttccatccctttcgttgtctgtcccttttgttggactctctgcctccatgcctttcattttgccatgatgaacaattgcctcccttgtcttctgctgtagggccatgccgctcacgtctttgctcagatacaaaattccttgcacacagcactgaacccgtctgaggagcccaacaccgtcttattgtctgcctgtctgctcctgtcaccctatccacacccactttactcaagccctggtctcttcttgccccgccaccttatgcctgtactttcgacccttaacatccccttctccaatgcgcgcacctcctcacttggccttttacacttccgcctgattctcttgggcacacaatatcctcttttactaccttcttttattccaattcattgtcatcaacattttgtgcctttttgttcatcgttaacgtgcgttttccccgcacatccacctgctttccgccgctttcctccagaccactatcaattgttagctcatatcttttcctcgttctttttcattttcttcactcatcaaat

SEQ ID NO: 595018 - DNA, 542 bp, Homo sapiens
  misc_feature (413)..(413): n is a, c, g, or t
  misc_feature (463)..(463): n is a, c, g, or t
tcacgcttatacttcctaattgtcactttttacctatgcaatctgttccttctaaccttccagcttctggtagccactattttactctcgacttctatgaggtcaatgtttttagattccacatatgagtgagatcatgtggtatttatctttctgtgcctggcttatttcatgtgatataatgtcatccaggttcatctatgttgctgcaaatgagaggatttcattattttatgattggatagcattatgatcccagtagtgggactgctggatcataggtagttttagttttaattgttgaggaagcattatactgttttccataatggctgtactaatttatattacattcccactgacacagtgtatgagttatctgtttttcatcatcaccacatttgatatctttngtcatttcgatagtagccattctaagcagggtgtggtaatatctcatttnggttttgatttgcatttccctgacgattatgggtgttgagcattttttcatatgcctaatgggcattggtatttttttc

SEQ ID NO: 595019 - DNA, 613 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (537)..(537): n is a, c, g, or t
  misc_feature (545)..(545): n is a, c, g, or t
  misc_feature (549)..(549): n is a, c, g, or t
  misc_feature (552)..(553): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 595020 - DNA, 89 bp, Homo sapiens
gtggaggaggagagcagcgtggttagctaaggttattgctttttgtggcaaatctaattaaatgacaggaatctcttcaaaaaaaaaaa

SEQ ID NO: 595021 - DNA, 773 bp, Homo sapiens
  misc_feature (199)..(199): n is a, c, g, or t
  misc_feature (555)..(555): n is a, c, g, or t
ggggcctttttttccaaatacgcgcggggggagggattatccactctaatttccacctcaccccccacatacacctcccggatcgaacatgccataggcgtatccgaacataacggaccagcgcctcaccccttaacccttgatgcatacgggaccaaacgtccttcacttttacgagaagttcagcgggtatcaaatnaggcaacaggatatttcctaaaaatctatgaaaaagtaccaccctattcgtaacaaaactcatgggaggtttataggttaagggctcaaaccttcctagcctggcgaatgactgggcgccttgatccacttcactccgccgtgtaattccccacaaaccctgaaagtgcctttatcaaaacaaccactggaccaataacggagaacattcttggaacatacggaaaaacactctacagggcactttattatttcacaacccctgaggccggccgtaaaccatttctccattctaagggaggggtttaaccctaaatctcgttcctggaaaaattacgtattcactaacaaaaccgntctcccttcgcctttgtacccctaactgcttaatgaaagaaacaactggaagatgccccccaactccccgactagggaaaccttacccttttccaggttaagggattcgaactgaagcgcgcttaccaaaaatgttatccaagaaaaaaggggggaccccactaaattcccacccggggggccacccattttccacttgcgttcaagacccccactcc

SEQ ID NO: 595022 - DNA, 424 bp, Homo sapiens
cctagttttagaagtttcaatagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacccgcaatgtgctattgaaacttctaaaactagg

SEQ ID NO: 595023 - DNA, 147 bp, Homo sapiens
caggtagactaacccagtagacctccaggtagacctaacccaggtagacctaacccaggtagacctaacccaggtagagaacgcctgctgtaatctacactgttgctgggacaatcatctgtcactcatccaacacagttatataca

SEQ ID NO: 595024 - DNA, 390 bp, Homo sapiens
  misc_feature (239)..(239): n is a, c, g, or t
tgttgagccttggctgctgtgggaagacacaacattgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgagnaatcaacaacagtccacagcagcccaggtgcaactggaacagcactcttccctacccgctctgcaacctcagttcttgttggagaacctacaacgtcaccagggtagactgttcaacctgttcctgctccgcctccactatagcagatggt

SEQ ID NO: 595025 - DNA, 286 bp, Homo sapiens
  misc_feature (184)..(184): n is a, c, g, or t
  misc_feature (187)..(187): n is a, c, g, or t
  misc_feature (190)..(190): n is a, c, g, or t
  misc_feature (196)..(196): n is a, c, g, or t
  misc_feature (204)..(207): n is a, c, g, or t
  misc_feature (213)..(214): n is a, c, g, or t
gctggtccagatagaggagacactgctaggtgtaaggagaagatggttaggtctacggaggctccaggatgggagtagttcccttccctggcccacacaaagccagtattgtgccttcccagcaccaccagcctcatcccttggtcaacaatctacaaccttccacagcagcccaggcgacacnganacnacactnttacctgnnnncaccannacctcaggccccctcctaatactaactacctgactcctacccctcacagtcatggcaagccacgccacttat

SEQ ID NO: 595026 - DNA, 1244 bp, Homo sapiens
  misc_feature (187)..(187): n is a, c, g, or t
  misc_feature (1008)..(1008): n is a, c, g, or t
ggagcgcgcccgtcagacagctgctccacagtcatgttcttgaggctctccagagatcttgatggactctttcaactcccggaagctcttgaggtggcccgtgtggacgtcagcagcaaggtggaggtggtgtgggctgacaactcaaagaccatcatcctgccccagcacttgtacaacatagagnctgatgattgaggagatcagactacgacttcgcgctagaaggcagcaccacgcggggcatcctcggatgtaatgggaacgatgatagtgacagagtgggagacggatcaatggagctggtggacggacgagcaccccaacgtatagaggagccccccatcccacccctggagcaggcggtggagccctgaggacaacgggagtggtgatcaggggaacgaggcatgacagcaagcatgacgtccagaggaggctggcggctcaatggacatagaccccatggagacgaggctgatggaaacaggctggcaaaggacgggccagcccaatgagcttgcccgcgtaggtgaacagaggccatcaccagatccctcggcaccagcctctaagtaacattgactagtggagccagctgctgacggagctcgcgctacctctccgactgttggaagcctgagcaagccaaattcgggagaagactgtctcttggcatgcacatcacgaagctcactggataaacctcaagaagactggacaaatggtcgggccattggcaccagtactggaagacgatcggccgcggtgccggacgacccatctgtcgggagtgacagcgacggagatgggagcacccgtatcgcagtgttgccgggcaaaccctgacctgttcttcatggaggacccaccttcggtatttccttcaagagctagcacctgacacagattgactgggaataacagtttagagtagtccaaatatgccagtatgcaagtagatagaatggctcgcaggaacctacttggaacgacacggtagggtcntcattcttcttcttactagagttcgttagtcaacatcaaacagaagcaaacaagaacgcgagccgcagccaaatgatcaaagagaaatgcagacaaaaagaccacgtagagcgcaagagagagagaagatacaatacaaaggagaaacacagaaaacagggccagtagaaaggaagaaatgagaaatcacaacaaacaacaacgacaatacaacaacaaaagatcaacaaaagact

SEQ ID NO: 595027 - DNA, 3862 bp, Homo sapiens; identical to SEQ ID NO: 532394
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
  misc_feature (3786)..(3786): n is a, c, g, or t
  misc_feature (3794)..(3794): n is a, c, g, or t
  misc_feature (3798)..(3798): n is a, c, g, or t
  misc_feature (3801)..(3802): n is a, c, g, or t

SEQ ID NO: 595028 - DNA, 126 bp, Homo sapiens
ccgaatcgcacgacttacatcctacattactattctgcctagctaactcaaatctacgaacgcactcacagtcgcctcataatcctctctcatggacttcaaactctactcccactatgaagcttt

SEQ ID NO: 595029 - DNA, 869 bp, Homo sapiens
cttcttctgcactcctggatcctgatgactgcccaaagaaaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgacttttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattgaa

SEQ ID NO: 595030 - DNA, 3711 bp, Homo sapiens
  misc_feature (36)..(36): n is a, c, g, or t
  misc_feature (135)..(135): n is a, c, g, or t
  misc_feature (3635)..(3635): n is a, c, g, or t
  misc_feature (3643)..(3643): n is a, c, g, or t
  misc_feature (3647)..(3647): n is a, c, g, or t
  misc_feature (3650)..(3651): n is a, c, g, or t
cggtgcatgatgtgatctggatctgagctggtctcnggtctggcgtcgttactaagtgacacaggctcaacagtaaacaccagtatggaggtaatacaacttctgcatccacacccagttcaagcgaccttttancacctttagtgactatggggtgtcagtcacatttatcacgggctcaactgcaacaaaacacttccttgacagctccacaaactcaggccacagtgaggaatcaacagtatcccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagcatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 595031 - DNA, 165 bp, Homo sapiens
atcctggggcgtgtcgcacacctctcctcttctgtgacaagcacaccgaaatccatcatcagatccggtgggccttacctttagatacatagctcatcttctcaagattccaggctggtctaagatataatccactctctccggggctagggcaagagcctcgtg

SEQ ID NO: 595032 - DNA, 3576 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
  misc_feature (3543)..(3543): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagcatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggctccggcgctgcgggcntgtgggtggcagaaatagggtaccgacgctcga

SEQ ID NO: 595033 - DNA, 3469 bp, Homo sapiens
  misc_feature (23)..(23): n is a, c, g, or t
  misc_feature (3393)..(3393): n is a, c, g, or t
  misc_feature (3401)..(3401): n is a, c, g, or t
  misc_feature (3405)..(3405): n is a, c, g, or t
  misc_feature (3408)..(3409): n is a, c, g, or t
tctagaggatccctggcgagtgnatggctgcaacagtcttacctgccggctctacaccctcagttcttgttggagactcgacgccctcacccatcagttcaggctcaatggaaaccacagcgttacccggcagtaccacaacaccaggcctcagtgagaaatctaccactttctacagtagccccagatcaccagacacaacacacttacctgcccgcatgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagcatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 595034 - DNA, 3864 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (310)..(310): n is a, c, g, or t
  misc_feature (318)..(318): n is a, c, g, or t
  misc_feature (323)..(323): n is a, c, g, or t
  misc_feature (325)..(326): n is a, c, g, or t
  misc_feature (332)..(332): n is a, c, g, or t
  misc_feature (336)..(337): n is a, c, g, or t
  misc_feature (352)..(352): n is a, c, g, or t
  misc_feature (355)..(356): n is a, c, g, or t
  misc_feature (367)..(368): n is a, c, g, or t
  misc_feature (377)..(377): n is a, c, g, or t
  misc_feature (391)..(391): n is a, c, g, or t
  misc_feature (407)..(407): n is a, c, g, or t
  misc_feature (418)..(418): n is a, c, g, or t
  misc_feature (421)..(421): n is a, c, g, or t
  misc_feature (511)..(511): n is a, c, g, or t
  misc_feature (3788)..(3788): n is a, c, g, or t
  misc_feature (3796)..(3796): n is a, c, g, or t
  misc_feature (3800)..(3800): n is a, c, g, or t
  misc_feature (3803)..(3804): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatctacaanctaccacngcagncnnggctcnactnnaacaacacacttccntgnnagctccacaanntcaggccanagtgaggaatcaanagcatcccacagcagnccagatgcaanggnaagtggaacaacaccctcatctgcccactccacaacctcaggtcgtggagaatctacaacctcacgcatcagtccaggctcaactgaaanaacacgttacccggcagtaccacaacaccaggcctcagtgagaaatctaccactttctacagtagccccagatcaccagacacaacacacttacctgcccgcatgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagcatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 595035 - DNA, 284 bp, Homo sapiens
  misc_feature (35)..(35): n is a, c, g, or t
  misc_feature (84)..(84): n is a, c, g, or t
tccctaatcccctggcaaccactttaaaaaaaaanttaggttcagggggtacatgtgcaggtaaactcgtgacaagggggtttnttatacagattatttagtgacccaggtactaagcctagtacccaatagttacttttttggtcctgtcccttttcccaccctccaccctcaggtaggccccagtatgttattcctttgtgtccatgttatttcactcccacttgtgagaacatggaatatttggtttcctgttcctatgttagtttgttaaaggataatgg

SEQ ID NO: 595036 - DNA, 3862 bp, Homo sapiens; identical to SEQ ID NO: 532394
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
  misc_feature (3786)..(3786): n is a, c, g, or t
  misc_feature (3794)..(3794): n is a, c, g, or t
  misc_feature (3798)..(3798): n is a, c, g, or t
  misc_feature (3801)..(3802): n is a, c, g, or t

SEQ ID NO: 595037 - DNA, 596 bp, Homo sapiens
tggtgctgtagaggtgtaaaacagtggccaatgagctactgcagagaagcgacgaggagggcaggctccacggggggatgcagctgtggctctgaacaaggggcccgcgaggcaggccaaatgctgtgcccactaggtgcagccactcctgggggctgtggggaagacacccctctgcctgggccatggccagctctaggtggattctgattcactgtcaatgctgggttgctcccgagccctagatgttcccatggaaggaaggagtttgcctgaaggtccagatgttggtgtgcatggaatggttcgggcagactgaaccaacaggtgtcggaggtgttcaatacagtggcccaagagctactgcagagaagcgacgaggagggccaggctccacggggggatgcagctgtggctctgaacaaggggcccgcgaggcaggccaaatgctgtgcccactaggtgcagccactcctgggggctgtggggaagacaccccctgcctgggccatggccagctctaggtggattctgattcactgtcaatgctgggttgctcccgagccctagatgtcccatggaacggggggatctct

SEQ ID NO: 595038 - DNA, 708 bp, Homo sapiens
agcgggaggaagcggaagatggcggcggcggcctgggaggcctgtgaggagagcggcggctgcgagggcggccgatggcggccgggaggcgccctcgtgacacttgctgggtctgttaggtgctgcgactgctggcgaggcatgtcaggagcactgtggatgccctgcagctcctggggcccggtgcccaatcggctggcggctggctggccctggccccacgcagcgcgggccttcgcaccccacaagtctcagaccccaaacccccatcatcgaacgtgcagcgacctggctcattccacagcgctggttcttcaaagatggcgtgtcaccatattcgcaggctcttcccgacccgaccttccgcacgtctcttcgaggttcttcgtgctgcgtcaaggcccatgtttgtgctcttcgtcctggcctacatccacatcgtcttctcccgctcgcccatcaactgcctggagcatgtgcgtgacaagtggccgcagtgagggcatcctgcgtgtggaagtgcggcacaactcgagccgagcgcccgtcttcctacagttctgtgacagcggcggccgcgggagcttcccgggcctggccgtggaaccaggcagcaacctggacatggaagatgaggaggaggaagagctgaccatggagatgtaagggaacagctccatcaagatagagctggacatcgagcccaaa

SEQ ID NO: 595039 - DNA, 1518 bp, Homo sapiens
tctaatagcctgtatgtctagattacagaactattcaaagaagctcacagactggcttacatgggacaacacctgttctgacaaactaactggctaaagctaccggcactataacatctcacatgacgcactactccaaactttttcatctacttatcgcttctgttctatatgattgcctattaacctatatgctacatcctaagcaatgcacctgtatatagatgccgttaactcccagccacaggcatactcccaacatgctactctcaagcaagctaatgccagagccacacctataaccgtgaaccatcaccaatgacagcaacgaatatgtacaaaatcatatcctctctacacacgcacacctcaaggctcaacctcacacctgctgatcactcctaacactcactcccgcatcctccactaggcccgcttctttcaaccattcttctccttgatttacaattgctgctacctccatccccctgtcctcacgccaccactctcccctcttcttaccaccctctacacctgggctacggcgcctccccaccacctcctctccaccttcacaccctccctggctctccactctctaccttaccccgatcccctccaccgctacccgcaccactctccctctcctcctccccgcctctccctccacctctcctactcctctccgcacacgcacttcaccacatggcccctacgggcacacacgcccttctccgctcctctacctacttccctccgcccaatctctacaacacttgcgcgcttccgcgcggcaacccccagcccgtccttgcaccctccctccacccccccactgcctctcgtgtctttaccttgcgccccccccctcccttctatccctcccttcaccctctccgcccacacccgcatcacctcatctctctaccctcacccgcccctcacgcaacccacacaccctctcccccccccaccggccccccaccacttcacccccccttggcgcccgcaccccgcccggccgatctcgccttctggctcccctttgatttaccccttacgtggcaccccaccgcctatatcccccagacaatacgcttacctgttctacaaacccaacattgggccacccgcccactattcactagggcaacacactatatccaagggctatatcatcaaactcaacacacactacagtcacaacacaataaagtatcaattaatacaagacgaagtacagtagggaagacccagataacaacaggataatataacgcgagcatgatacattcgacgcatatacaaatcacagctttacactatggagtcgcctatcaaccacacgcgtaacaccacataccgcaaatcacaacgcgcacgacaatgacatcaccgccaccctaccacaactcggaccctatccccgctacccgccgcgactaccaccccagcccctccacacccacccgctcgacacacacacgtcaccaccaccagccccacccttctcccacc

SEQ ID NO: 595040 - DNA, 115 bp, Homo sapiens
ggatgatcaaaaagggatggcgagtcgcatgtccggcgcatggcgcggggatcgaatcactagtgaattcgcggcgctgcaggtcacatatgggaagctccaacgcgtagatgca

SEQ ID NO: 595041 - DNA, 224 bp, Homo sapiens
attggtagttctgaacgttagatatttttcctctccattggggttcaaaaggtacctaagtatatgattccgagtggaaaatagggggacagacatcaggtatttggcagtctttcccattttcattttgtgtttgactttttaatataaatgcgggagacgtaaagcattaattgcaagtcaaaatagtttcagtgaacaagtttcagcggttcaactttata

SEQ ID NO: 595042 - DNA, 673 bp, Homo sapiens
  misc_feature (1)..(1): n is a, c, g, or t
  misc_feature (53)..(53): n is a, c, g, or t
  misc_feature (207)..(207): n is a, c, g, or t
  misc_feature (213)..(213): n is a, c, g, or t
  misc_feature (220)..(221): n is a, c, g, or t
  misc_feature (235)..(235): n is a, c, g, or t
  misc_feature (244)..(244): n is a, c, g, or t
  misc_feature (278)..(278): n is a, c, g, or t
  misc_feature (294)..(294): n is a, c, g, or t
  misc_feature (300)..(300): n is a, c, g, or t
  misc_feature (321)..(321): n is a, c, g, or t
ncttctatgagactggagagattccccgaagaatctggatgtcatgaaggaancatggttcagccagaggaaccggctgctgagattactaggaagctggagaaaccggagaagataccgctttaagaaggaaagaaacggctggctgcacttgccctcgcgtcttccagaaaaccgccgtagtactcccgaggagtgtgaggagangagtgnaaaaccnnaaagaagaaaagcnaaagccccnggaggttcctcaggagaatggaatggaagacccntctatctctttctccnaacccnagaaaaagaaatctttttccnaggaggagttgatgagtagcgatcttgaagagaccgctggcagcacccagtattccccagaggaagaagtctacaccccaggaggaaaccagttaatgaccctgaggaggccaggcccaccagaagtggctcccagaaaaagaggaaattctcccaagaggagcccggtcagccgtgggcctgaagaggcggctggccagagcagctcccagaagaagaaaaagttccataaagcatccccggaagattagaatgccaatggacattctctgggaggtggggcataccatagaccccaggtgacatttccccccctgtgccgtgttcccccaattaaaaccaattcaccaga

SEQ ID NO: 595043 - DNA, 258 bp, Homo sapiens
gatccggtgtataacgcgagtgacacactagctcatatcacctatctgtggagtatctgccacacttcagaggcacttttctgttcaaataccaacccccaaaggatgtttaccacacagtgttgactgtaatgcaccactacgaagatacatgtgtcaaagatatttctaagaatgccagtttatatatgaataaggattttcctccttttcaaaaggatatgttcacaaaactgaggtatgtaatatgctctatgg

SEQ ID NO: 595044 - DNA, 133 bp, Homo sapiens
caaaatggtaccaacacggagaatcccttaagaacctgaggaggcgcaacattaaaagctacgattatcgccttagcaaggatgtaccatgcctatcagtatgccagcctgctatcctcctacttatacccaa

SEQ ID NO: 595045 - DNA, 577 bp, Homo sapiens
agtgtccgaggatccccgagtctgagatgtgttaggaaacagatacaaagatgagatacaggaggaatagagagaacaaggccaagattgaagatgagaaaacagatgaagaaggcacgaagaccccaaaggaatacctgaatttcggcttaactgttatgaagaatgttgacttgcccagtgctatggtatcaggaacacgctaaacctatgctgaagcactagacagatatcgaagtgaagtactcagatgctggccagcctatgagtatagacttagaatttcactttgaacccaatgaatattttacaaatgaagtgctgacaaagacatacaggatgaggtcagaaccagatgattctgatcccttttctttagatggaccagaaattatgggtcgtacagggtgccagatagataggaaaaaaggcaagaatgtcactttgaaaactattaagaggaagcagtaaacacaagggacgtgggacagttcgtactgtgactaaaacagttatccaatgactctatactttaagtttcatgcccctacctgaagtacctagagagtggagatct

SEQ ID NO: 595046 - DNA, 565 bp, Homo sapiens
  misc_feature (99)..(99): n is a, c, g, or t
  misc_feature (105)..(105): n is a, c, g, or t
  misc_feature (112)..(113): n is a, c, g, or t
  misc_feature (127)..(127): n is a, c, g, or t
  misc_feature (136)..(136): n is a, c, g, or t
  misc_feature (170)..(170): n is a, c, g, or t
  misc_feature (186)..(186): n is a, c, g, or t
  misc_feature (192)..(192): n is a, c, g, or t
  misc_feature (213)..(213): n is a, c, g, or t
cgaaagctatacaggagagatgctatacctggaacgttattgctgggatgtattaacctgtactcacggattgttcggctgtccttccctttgcgagangagtgnaaaaccnnaaagaagaaaagcnaaagccccnggaggttcctcaggagaatggaatggaagacccntctatctctttctccnaacccnagaaaaagaaatctttttccnaggaggagttgatgagtagcgatcttgaagagaccgctggcagcacccagtattccccagaggaagaagtctacaccccaggaggaaaccagttaatgaccctgaggaggccaggcccaccagaagtggctcccagaaaaagaggaaattctcccaagaggagcccggtcagccgtgggcctgaagaggcggctggccagagcagctcccagaagaagaaaaagttccataaagcatccccggaagattagaatgccaatggacattctctgggaggtggggcataccatagaccccaggtgacatttccccccctgtgccgtgttcccccaattaaaaccaattcaccaga

SEQ ID NO: 595047 - DNA, 1134 bp, Homo sapiens
  misc_feature (723)..(723): n is a, c, g, or t
gcccaatagggcgagacgagcagggatgcgccggcgggaggatgggtgtgcgcggtgcgatctctgcgatcagtgtttccatgtgcgtcccatcgggcatcagtccactgtctatcccagggacacggcatcgcttcctctgctgacacgcacacatctacgtcagggtctccatctccatcttccatacaccctgtcctgcttatatgtccccgtctacgcacgcacgggtgcatcctgtcgcgagggcagtgtgacctccaagcttagacgcgcatgcgttgctcaaccgcatggtgctccgtcgagcacatatacacgcaaggaggacccataccgagctgcgagtactgcgtcgcaaacgcttgggtgagtctgcgctatgtggtcagagggggaccacaaggcctgcgacgcgaccgatgcagacggaactggctcatatctgacgtccatgattgtgagctcagagctgagggagacctgggtcagaaggaacatcacatgtgtatgcacagcacaacgaggatgaggggaccgtgtggattgacggcggtgccctagctgtgtcgcaaggaacctctcacgggggcaaacttgctcgcgaacgggtaggcttgcagatggggtacgcgttgggggtggaaaattcgcccacaggaaagttcgaattgccaggccttgcaacaggtcacggctagagcagggacggttcgcagaacntgatatccggaaagcaccctccaatactcttgttgggtccaccaagtgagacgtgaccgagagcggcgcacgtgatggcgacttcagaatgcacagccccttggaaggcggcccccaattggggccacccgattgacttaagaacgcgacgaacctaaacctattctgggtggcaagagaaggcggggcttgcacaaccagcgcgcttagggatgggcatatagtgagcacacccaccctgtggtgaccatccctgggcgggaatacccgggaggccagacaaaggtgtacccactttagtgggtatgaaacgccccaacgacaggccccttcccccggggcactccgcaaatggggacaaccgtccgtaccagccaaacaagcgcccatgggcacagccgccacactatc

SEQ ID NO: 595048 - DNA, 299 bp, Homo sapiens
cgccgctcgacttgttgtcgtcgtgtcatccgcccgcgcatcgcaggcatagcgtctgcgaattgcttcagagcgcatccggcgatgacatttacgctccgagggcggccactatcgcgtggtcgaagagcgatgcaaggtaattccaaatacccgaaaagtatgcgaatccctgtaaattaaagggtccagcggaatcacgcggcgcggcgcgcaggccgattcgcgggagagcaagcggaaattcgctctcggtcatcggcgccggttggtgcgagccgagcgcggcttgggagtcc

SEQ ID NO: 595049 - DNA, 477 bp, Homo sapiens
tgtgtaccacccccagggcctcctgttccgagactgaatgtgggggccaaactgcagaactgacgaaggagagaggaagtagtgcggggcctggatgtggatggtctggttactagttgcacacaactgcctggcagacaagccatggacttggaccaaggatgtccgtgagtgccctggctgcaagtggaacagctctccaagatggtctctgaagcacaactgagggcagatgaggcaaaacaaagtgctgaagacattctgttgaagacaaatgctaccaaagaaaaaatggccaagagcaatgaggagctgagaaatctaatccagcaaatcagaaactttttgacccaggatagtgctgatttggaccgcattgaagcagttgctaactgaagtattggaaaatggagatgcctaggaccccaaagaagttaccgaacttgacaggaagatatacggtgaacgagttggaag

SEQ ID NO: 595050 - DNA, 407 bp, Homo sapiens
  misc_feature (78)..(78): n is a, c, g, or t
cgtgagtcgatctaaggtcccccctcatcagtgggctcagaaggaggggacctcattatccaggatgtcttctgagancctgtttggaactgttccccccaaggcaggagctgggagactggcttcaaagggggagccagagggctgagagacattgctattccatggtctccggctcctctttctggggtgctgatggggcacagagggggaatttcaaagcattctgtggcatttactcctttttcttgtaaacaaaaagggtttggggttggggggcttccccaaaggtcctttttaaagggggggccaacttcaaggaacccttccttcaacccaaaggcttaagaacaaagttctccagttttttcctaattcctaagtagcttggagtccagcgaaccctc

SEQ ID NO: 595051 - DNA, 501 bp, Homo sapiens
  misc_feature (226)..(226): n is a, c, g, or t
  misc_feature (232)..(232): n is a, c, g, or t
  misc_feature (444)..(444): n is a, c, g, or t
tggtctgtcttgcttgtaggtgcgtcacaccagcagcccctgcatcgcttcgcgcaaattcccggaatcggcactggctggttcgaagctcggtccacaaacacatggacaaagcgccccgccgcacacgcctcctgctcgcccgccttgaataccgccagctcatactgcaccgagctattgcccagcttgcccacccgcagaccgacctcaatgcactcggganaagcgntcgaggcgaagtaatcgcaggccgaactcaccacaaaccccaccacctcaccgtcatgaatatccaacccgccctgttcgatcaggtaggtattaacggctgtatcgaagaagctgtagtaagtgacgttattcacatggccgtaggcatcgttgtcgtgccaacgcgtggtgatcggttggaagtggcggtaatcgtcgcgcacaggcgtngagtcaggcatcggcaagtctcaacaaagttgatccaattgagcagggacccactcg

SEQ ID NO: 595052 - DNA, 118 bp, Homo sapiens
  misc_feature (13)..(13): n is a, c, g, or t
  misc_feature (19)..(19): n is a, c, g, or t
  misc_feature (96)..(96): n is a, c, g, or t
ttggactaaaganacagantctgaaatttattgtgataatttgtatgtcttttgtcttgcaatttaatgccaaaagtttgccatgtgccttaaacntattactatatattttcccctt

SEQ ID NO: 595053 - DNA, 227 bp, Homo sapiens
  misc_feature (12)..(12): n is a, c, g, or t
  misc_feature (53)..(54): n is a, c, g, or t
  misc_feature (56)..(56): n is a, c, g, or t
  misc_feature (60)..(60): n is a, c, g, or t
  misc_feature (183)..(183): n is a, c, g, or t
  misc_feature (218)..(218): n is a, c, g, or t
tcaagtgagccnccagccttggacctccccaagtgctgggattaactgtaacnngntganttatgactttttaaacaggatttgagcagtacattggaacactgcattactttcattataattaggatgttcaaaaagctatacaactatagctctctacaggacacaactgaatgttaaggnctaaatctgcaagtatatgctctaaatatgatccngggacattt

SEQ ID NO: 595054 - DNA, 470 bp, Homo sapiens
taaattaaaagccaaattgtacctcatttatgcatgttttcaagaattcagtttttaagattgtatgaactttttttcacaccacaaaatcaccaacaattatttgttgagattattttaactttgggatgctggaaagagaggagacaagtaaagataatggtccctgcccttgaagaatatggagacagcacttatttacccagaacaggttgagaatgataaataattgtgtgtaattgcgaccaaagctggattgtgtcccagcaagtatctgctaaaagatctttccatgcagcaggaaaagcaagtacaaaggctgtgatgtgggactgtgagtttcacagttgagaaccagcgtggaagccagtggggctgaaagcagaggaatacagtgggtgagtaggtggtaggggagggctgttgattcctaagagagctgctttaagggtaatgtataaccatgtaat

SEQ ID NO: 595055 - DNA, 247 bp, Homo sapiens
cgaggaattaacttccagaaataaacccgagaactactccttcttgcaagttaaagaagaccttcttaaatgatgagatatattgcccgcccgaaaccgccgttcctttggcctcccatgccgtccaggcccaggtatggaggattaccataaagagataactaaggccggcacccggcaaatgatgggcccctaccccggctgtattggacccccaaccacaaggaccggggagaagacctgcctg

SEQ ID NO: 595056 - DNA, 120 bp, Homo sapiens
cccccaaaagggggtttccccttttgggggggggggtggtttcccccctttttttgggggttaccccttaaaaagggggggggctttttcttttaaccccccccttttttttttccccca

SEQ ID NO: 595057 - DNA, 496 bp, Homo sapiens
tctaaaaataaatggaacttaagtgtctatcaaagatggtgtggcagattactgtgaaaagaggagactgttcagcaaaaggatctagaaatagtgattattgataagaaaaaaaattaaaatgtccccctgccatgcacattacacaaaaataactctatatagtttaagatctttatgtcaaaagcaaaacattaaaacatggaataaaataaatgtggatttcctcctgcttcggagtagggaagggcttaacaaagagacataaccttaaaaaatatgtaaaaattagaataaaattaataaacttgggttcatcaaaagacccctttaaaaagtaaaacaaaaagcaagctataatctggggaacatatttgccacacatataatggaaaatgaatcaggaatatataattgactaaggatcaaaattttacatcaagagattccaaagaatgcctacaaattaataacaaatctgactacggtcacaccc

SEQ ID NO: 595058 - DNA, 191 bp, Homo sapiens
ggcaaatagaagccgggtagagagtgtttgtagatcaccccctccccaatagagctaaaactcacctgagttgtaagaaactccagttgacacagaatagactacgaaagtggctttaacagtatctgaacacacaatagctaagacccaaacagggattagataccccactatgcttggcccttatcgag

SEQ ID NO: 595059 - DNA, 331 bp, Homo sapiens
ggaccgagtggagcatgttgtgagacatgtgtacttcccatcctgccacatggccactttgttcatgggcttattgggcgacgatgggtggcttggaaaagaggctgagtggtgtcctcagaacaggtcatcctatccactcaataattaaactcctcctctgctgaggtcacccgttggtgagcactcacatgggatacaaatgtcttcacagattttggccactcagagaggtccatccacatacctcttctccaaatttctttgtcaccaattttctaatcatgcttctttgaagtccctgacctttcccttctcgcctccttccctg

SEQ ID NO: 595060 - DNA, 139 bp, Homo sapiens
agacactccagcctggctgacagagtgagactcggtctcaaaacataaagagaaacctgcatcccaacacaggccgggcaaccgcgacactggctatgcagaagcagggcacgtggccactgtcatctccactcagcct

SEQ ID NO: 595061 - DNA, 111 bp, Homo sapiens
acccgcatacttcttgctagatcaatccggtggtacgacgatgttgctggatcacgccgaataaccatgacagatctttgtggacgacgtatgtggggtaccgaagctcga

SEQ ID NO: 595062 - DNA, 210 bp, Homo sapiens
  misc_feature (193)..(193): n is a, c, g, or t
aggatatacttgggtctccaaagattattcttctttatattattaatttattattttttagagactggggtctcactctgttgcccaggccaaagtgcagtgctgagggcatagctggctgcaacctcaaactcttggggctcaagatgatcctccgtgcctcagcactttagaagtagctagagaagtacanggtatggcaccattggc

SEQ ID NO: 595063 - DNA, 263 bp, Homo sapiens
actacttatttatattaatagtttacctgcattatttatgaaaactgtgagtcatcatgtaaagttatttccctgtcaaccattttatagcctgtgaatatcagatatataggtgagtagaaaccttaagattaactatatggttatattactaaataattcagtatttaactgtttgcattaaaacagtattaacgtcttatttatcaaaaattacacaaagcaggaaaacttacccaagccaagatcaattctgtgtaggg

SEQ ID NO: 595064 - DNA, 374 bp, Homo sapiens
ttcagagacattggccgcagttttgcagaggtgggtggatccttatgaaccgcaccggccgcgccctgaccctgtgctgcctgttgcttcttcagcccctgctgggcttggcggagggcggtaactcggtgctgattccggcgacgtgccgctgcaccttgaacgttcagcctgaagacctggcaaacgccctcaaggcctgtgagcagacggcaaccgcgggggatgcccaggcgcagttcgaactgtgcgagtaccactacacgcaaacgccaaaaaaactcgacatagccctggactggatccagatggcttcgctgcaaggccaggctgatgcccagtatcgcctgagcgccatgttcttccatggtgaa

SEQ ID NO: 595065 - DNA, 1721 bp, Homo sapiens
  misc_feature (48)..(48): n is a, c, g, or t
gaggaggtggtagaggaggtttccaaggcagtggagattatggtggangagggggttatggtggaagagggggctcatggtggaagaggctatggagatccatatggaggaggtggtggtggtggtggtggtggtggtggaggaggtggatatagaagatactaaaaactataaaaattagatagcagtgcttgcttctttatagatacattagaaatagtgttccaaataacatacttgaatatcatctttgaagtaaacaccatgttagactccctggtgataccactcttgaattggttaatatgtaagaacattgttttttattaccagttgatctctcaaatgaagtgatgactttttccatattctgtgtacccttgagcatgttgtgtctttttaaaaaacaaaaaaaagaacaaaaattattttttaaaatgtaaatatttattaccatcagacttggaaaatggaaagtattttattgtcatgattgaatttagattgttacctgtattttgttcaggtttgagacatataaaagaccccacctgtaatagaaaggaatatagacccttgcctcacctgtattgctgtggatgtgtttgtgggtttttcattcgattttacaaaatagggaaaggcacttccagttgtatttagtaggcagttgttgtgaatcatttttttctcttataggaggagattcctctctagccatgtttctgttaaagtttcattaattgaagcccaagtttactttttactgtacatacttattttctaattggatttgaaatcagcatgattttgtttgacaaagcaaagtttaagattgaggtcagaaatactttaatggagcaaagacacataccaactttacatgacggtgtgagaaatagtcctataaactggtctcttcatcatttatgctctcactttagatatccaaatattaaaaggcaggctgacctgtatcacacagaattaaggcagtaattttctgcttcagtagatcaagggtagggctaaggcatcctgtggtaattctgattcacagctagatttgggaaacacaaagttagggaatggctatatgtgatttgctagttggagcagtcaaagtcttagctatcaagagttgtgaatttgaatcatggcactaggtcaggggtgctatggattgaaatgaccttagttctcaaggagtgatttgtcctcatttgtcaaatgaggaatgagacacttaccatcatctcaggttgtttcttaaagacctaaatacaaatacaatttgttaaaaacttacagagggcctattttgaatgctttaagatgtaggccaagtaatgtatttttctcttagtgtagaaagttaagagaaaaagagctggtaccataaattttttcaatcttagtgtaaaatctgtatctcattgtaggcttctggtcaatacctatacataacaacttaatgtgatctaaccaactcaactgatagaaagctgaattgttcccagtggacaagtggtatttgatgtttagcaggtttttttgttgttatttttttggtaaactctgtggtaaaatctaaaataatgttaaaaccctaaaagtaactattgaatattctgtaatcttagacatgtatttttcaagctaaccctttgaagaaatgtgttcaaggtaggaaaatataaaattttttggttatttgtaaa

SEQ ID NO: 595066 - DNA, 3713 bp, Homo sapiens
cagcgctgctccccgggcgctcctccccgggcgctcctccccaggcctcccgggcgcttggatcccggccatctccgcacccttcaagtgggtgtgggtgatttcctggcggggggagcagccaggtgagcccaagatgctgctgcgctcgaagcctgcgctgccgccgccgctgatgctgctgctcctggggccgctgggtcccctctcccctggcgccctgccccgacctgcgcaagcacaggacgtcgtggacctggacttcttcacccaggagccgctgcacctggtgagcccctcgttcctgtccgtcaccattgacgccaacctggccacggacccgcggttcctcatcctcctgggttctccaaagcttcgtaccttggccagaggcttgtctcctgcgtacctgaggtttggtggcaccaagacagacttcctaattttcgatcccaagaaggaatcaacctttgaagagagaagttactggcaatctcaagtcaaccaggatatttgcaaatatggatccatccctcctgatgtggaggagaagttacggttggaatggccctaccaggagcaattgctactccgagaacactaccagaaaaagttcaagaacagcacctactcaagaagctctgtagatgtgctatacacttttgcaaactgctcaggactggacttgatctttggcctaaatgcgttattaagaacagcagatttgcagtggaacagttctaatgctcagttgctcctggactactgctcttccaaggggtataacatttcttgggaactaggcaatgaacctaacagtttccttaagaaggctgatattttcatcaatgggtcgcagttaggagaagattttattcaattgcataaacttctaagaaagtccaccttcaaaaatgcaaaactctatggtcctgatgttggtcagcctcgaagaaagacggctaagatgctgaagagcttcctgaaggctggtggagaagtgattgattcagttacatggcatcactactatttgaatggacggactgctaccagggaagattttctaaaccctgatgtattggacatttttatttcatctgtgcaaaaagttttccaggtggttgagagcaccaggcctggcaagaaggtctggttaggagaaacaagctctgcatatggaggcggagcgcccttgctatccgacacctttgcagctggctttatgtggctggataaattgggcctgtcagcccgaatgggaatagaagtggtgatgaggcaagtattctttggagcaggaaactaccatttagtggatgaaaacttcgatcctttacctgattattggctatctcttctgttcaagaaattggtgggcaccaaggtgttaatggcaagcgtgcaaggttcaaagagaaggaagcttcgagtataccttcattgcacaaacactgacaatccaaggtataaagaaggagatttaactctgtatgccataaacctccataatgtcaccaagtacttgcggttaccctatcctttttctaacaagcaagtggataaataccttctaagacctttgggacctcatggattactttccaaatctgtccaactcaatggtctaactctaaagatggtggatgatcaaaccttgccacctttaatggaaaaacctctccggccaggaagttcactgggcttgccagctttctcatatagtttttttgtgataagaaatgccaaagttgctgcttgcatctgaaaataaaatatactagtcctgacactgaatttttcaagtatactaagagtaaagcaactcaagttataggaaaggaagcagataccttgcaaagcaactagtgggtgcttgagagacactgggacactgtcagtgctagatttagcacagtattttgatctcgctaggtagaacactgctaataataatagctaataataccttgttccaaatactgcttagcattttgcatgttttacttttatctaaagttttgttttgttttattatttatttatttatttattttgtgacggagagagattccatctcaaaaaaacaagttattaaaaatgtatatgaatgctcctaatatggtcaggaagcaaggaagcgaaggatatattatgagttttaagaaggtgcttagctgtatatttatctttcaaaatgtattagaagattttagaattctttccttcatgtgccatctctacaggcacccatcagaaaaagcatactgccgttaccgtgaaactggttgtaaaagagaaactatctatttgcaccttaaaagacagctagattttgctgattttcttctttcggttttctttgtcagcaataatatgtgagaggacagattgttagatatgatagtataaaaaatggttaatgacaattcagaggcgaggagattctgtaaacttaaaattactataaatgaaattgatttgtcaagaggataaattttagaaaacacccaataccttataactgtctgttaatgcttgctttttctctacctttcttccttgtttcagttgggaagcttttggctgcaagtaacagaaactcctaattcaaatggcttaagcaataaggaaatgtatattcccacataactagacgttcaaacaggccaggctccagcacttcagtacgtcaccagggatctgggttcttcccagctctctgctctgccatctttagcgctggcttcattctcagactctggtagcatgatggctgtagctgtttcatgggccccttcaaacctcatagcaaccagaggaagaaaatgagccattttttgagtctccttcatagacttgaataactctttttcagagcttctcacagcaaacctctcctcatgtctcctcatgtcttattgttcagaaatgggtaatgtggccatttcaccagtcactgccaacaacaacgaggttcctataattgtctctgagtaaccctttggaatggagagggtgttggtcagtctacaaactgaacactgcagttctgcgctttttaccagtgaaaaaatgtaattattttcccctcttaaggattaatattcttcaaatgtatgcctgttatggatatagtatctttaaaattttttattttaatagctttaggggtacacactttttgcttacaggggtgaattgtgtagtggtgaagactcggcttttaatgtacttgtcacctgagtgatgtacattgtacccaataggtaatttttcatccattaccctccttccgccctcttcccttctgagtctccaacatcccttataccactgtgtatgttcttgtgtacctacagctaagcttccacttataagtgagaacatgcagtatttggttttccattcctgagttacttcccttaggataacagcccccagttccgtccaagttgctgcaaaatacattattcttctttatggctgagtaatagtccatggtacatatataccacattttctttatccacttatcagttgatggacacttaggttaattccattcaatttcattcaatttaagtatatttgtaaggagctaaagctgaaaattaaattttagatctttcaatactcttaaattttatatgtaagtggtttttatattttcacatttgaaataaagtaatttttataaccttaaaaaaaaa

SEQ ID NO: 595067 - DNA, 1667 bp, Homo sapiens
  misc_feature (48)..(48): n is a, c, g, or t
gaggaggtggtagaggaggtttccaaggcagtggagattatggtggangagggggttatggtggaagagggggctcatggtggaagaggctatggagatccatatggaggaggtggtggtggtggtggtggtggtggtggaggaggtggatatagaagatactaaaaactataaaaattagatagcagtgcttgcttctttatagatacattagaaatagtgttccaaataacatacttgaatatcatctttgaagtaaacaccatgttagactccctggtgataccactcttgaattggttaatatgtaagaacattgttttttattaccagttgatctctcaaatgaagtgatgactttttccatattctgtgtacccttgagcatgttgtgtctttttaaaaaacaaaaaaaagaacaaaaattattttttaaaatgtaaatatttattaccatcagacttggaaaatggaaagtattttattgtcatgattgaatttagattgttacctgtattttgttcaggtttgagacatataaaagaccccacctgtaatagaaaggaatatagacccttgcctcacctgtattgctgtggatgtgtttgtgggtttttcattcgattttacttttttctcttataggaggagattcctctctagccatgtttctgttaaagtttcattaattgaagcccaagtttactttttactgtacatacttattttctaattggatttgaaatcagcatgattttgtttgacaaagcaaagtttaagattgaggtcagaaatactttaatggagcaaagacacataccaactttacatgacggtgtgagaaatagtcctataaactggtctcttcatcatttatgctctcactttagatatccaaatattaaaaggcaggctgacctgtatcacacagaattaaggcagtaattttctgcttcagtagatcaagggtagggctaaggcatcctgtggtaattctgattcacagctagatttgggaaacacaaagttagggaatggctatatgtgatttgctagttggagcagtcaaagtcttagctatcaagagttgtgaatttgaatcatggcactaggtcaggggtgctatggattgaaatgaccttagttctcaaggagtgatttgtcctcatttgtcaaatgaggaatgagacacttaccatcatctcaggttgtttcttaaagacctaaatacaaatacaatttgttaaaaacttacagagggcctattttgaatgctttaagatgtaggccaagtaatgtatttttctcttagtgtagaaagttaagagaaaaagagctggtaccataaattttttcaatcttagtgtaaaatctgtatctcattgtaggcttctggtcaatacctatacataacaacttaatgtgatctaaccaactcaactgatagaaagctgaattgttcccagtggacaagtggtatttgatgtttagcaggtttttttgttgttatttttttggtaaactctgtggtaaaatctaaaataatgttaaaaccctaaaagtaactattgaatattctgtaatcttagacatgtatttttcaagctaaccctttgaagaaatgtgttcaaggtaggaaaatataaaattttttggttatttgtaaa

SEQ ID NO: 595068 - DNA, 1755 bp, Homo sapiens
aggagaaaagggcgctggggctcggcgggaggaagtgctagagctctcgactctccgctgcgcggcagctggcggggggagcagccaggtgagcccaagatgctgctgcgctcgaagcctgcgctgccgccgccgctgatgctgctgctcctggggccgctgggtcccctctcccctggcgccctgccccgacctgcgcaagcacaggacgtcgtggacctggacttcttcacccaggagccgctgcacctggtgagcccctcgttcctgtccgtcaccattgacgccaacctggccacggacccgcggttcctcatcctcctgggttctccaaagcttcgtaccttggccagaggcttgtctcctgcgtacctgaggtttggtggcaccaagacagacttcctaattttcgatcccaagaaggaatcaacctttgaagagagaagttactggcaatctcaagtcaaccaggatatttgcaaatatggatccatccctcctgatgtggaggagaagttacggttggaatggccctaccaggagcaattgctactccgagaacactaccagaaaaagttcaagaacagcacctactcaagaagctctgtagatgtgctatacacttttgcaaactgctcaggactggacttgatctttggcctaaatgcgttattaagaacagcagatttgcagtggaacagttctaatgctcagttgctcctggactactgctcttccaaggggtataacatttcttgggaactaggcaatgaacctaacagtttccttaagaaggctgatattttcatcaatgggtcgcagttaggagaagattttattcaattgcataaacttctaagaaagtccaccttcaaaaatgcaaaactctatggtcctgatgttggtcagcctcgaagaaagacggctaagatgctgaagagcttcctgaaggctggtggagaagtgattgattcagttacatggcatcactactatttgaatggacggactgctaccagggaagattttctaaaccctgatgtattggacatttttatttcatctgtgcaaaaagttttccaggtggttgagagcaccaggcctggcaagaaggtctggttaggagaaacaagctctgcatatggaggcggagcgcccttgctatccgacacctttgcagctggctttatgtggctggataaattgggcctgtcagcccgaatgggaatagaagtggtgatgaggcaagtattctttggagcaggaaactaccatttagtggatgaaaacttcgatcctttacctgattattggctatctcttctgttcaagaaattggtgggcaccaaggtgttaatggcaagcgtgcaaggttcaaagagaaggaagcttcgagtataccttcattgcacaaacactgacaatccaaggtataaagaaggagatttaactctgtatgccataaacctccataatgtcaccaagtacttgcggttaccctatcctttttctaacaagcaagtggataaataccttctaagacctttgggacctcatggattactttccaaatctgtccaactcaatggtctaactctaaagatggtggatgatcaaaccttgccacctttaatggaaaaacctctccggccaggaagttcactgggcttgccagctttctcatatagtttttttgtgataagaaatgccaaagttgctgcttgcatctgaaaataaaatatactagtcctgaca

SEQ ID NO: 595069 - DNA, 1927 bp, Homo sapiens
  misc_feature (48)..(48): n is a, c, g, or t
gaggaggtggtagaggaggtttccaaggcagtggagattatggtggangagggggttatggtggaagagggggctcatggtggaagaggctatggagatccatatggaggaggtggtggtggtggtggtggtggtggtggaggaggtggatatagaagatactaaaaactataaaaattagatagcagtgcttgcttctttatagatacattagaaatagtgttccaaataacatacttgaatatcatctttgaagtaaacaccatgttagactccctggtgataccactcttgaattggttaatatgtaagaacattgttttttattaccagttgatctctcaaatgaagtgatgactttttccatattctgtgtacccttgagcatgttgtgtctttttaaaaaacaaaaaaaagaacaaaaattattttttaaaatgtaaatatttattaccatcagacttggaaaatggaaagtattttattgtcatgattgaatttagattgttacctgtattttgttcaggtttgagacatataaaagaccccacctgtaatagaaaggaatatagacccttgcctcacctgtattgctgtggatgtgtttgtgggtttttcattcgattttacaaaatagggaaaggcacttccagttgtatttagtaggcagttgttgtgaatcatttttttctcttataggaggagattcctctctagccatgtttctgttaaagtttcattaattgaagcccaagtttactttttactgtacatacttattttctaattggatttgaaatcagcatgattttgtttgacaaagcaaagtttaagattgaggtcagaaatactttaatggagcaaagacacataccaactttacatgacggtgtgagaaatagtcctataaactggtctcttcatcatttatgctctcactttagatatccaaatattaaaaggcaggctgacctgtatcacacagaattaaggcagtaattttctgcttcagtagatcaagggtagggctaaggcatcctgtggtaattctgattcacagctagatttgggaaacacaaagttagggaatggctatatgtgatttgctagttggagcagtcaaagtcttagctatcaagagttgtgaatttgaatcatggcactaggtcaggggtgctatggattgaaatgaccttagttctcaaggagtgatttgtcctcatttgtcaaatgaggaatgagacacttaccatcatctcaggttgtttcttaaagacctaaatacaaatacaatttgttaaaaacttacagagggcctattttgaatgctttaagatgtaggccaagtaatgtatttttctcttagtgtagaaagttaagagaaaaagagctggtaccataaattttttcaatcttagtgtaaaatctgtatctcattgtaggcttctggtcaatacctatacataacaacttaatgtgatctaaccaactcaactgatagaaagctgaattgttcccagtggacaagtggtatttgatgtttagcaggtttttttgttgttatttttttggtaaactctgtggtaaaatctaaaataatgttaaaaccctaaaagtaactattgaatattctgtaatcttagacatgtatttttcaagctaaccctttgaagaaatgtgttcaaggtaggaaaatataaaattttttggttatttgtaaatttattttttgtgtgtttatatttaatgaaaagatgtaatttcatttgtgatagctgaaaaaaaggctttccataattaagaaaatacctttatcagtagctatgaactctgaaaaataatttttaaaaacttttaagaaaaaaactacttgagtaaaatatttcaagagttgtttaaaaatcttctttaaaacctttaaaaaaaa

SEQ ID NO: 595070 - DNA, 980 bp, Homo sapiens
  misc_feature (48)..(48): n is a, c, g, or t
gaggaggtggtagaggaggtttccaaggcagtggagattatggtggangagggggttatggtggaagagggggctcatggtggaagaggctatggagatccatatggaggaggtggtggtggtggtggtggtggtggtggaggaggtggatatagaagatactaaaaactataaaaattagatagcagtgcttgcttctttatagatacattagaaatagtgttccaaataacatacttgaatatcatctttgaagtaaacaccatgttagactccctggtgataccactcttgaattggttaatatgtaagaacattgttttttattaccagttgatctctcaaatgaagtgatgactttttccatattctgtgtacccttgagcatgttgtgtctttttaaaaaacaaaaaaaagaacaaaaattattttttaaaatgtaaatatttattaccatcagacttggaaaatggaaagtattttattgtcatgattgaatttagattgttacctgtattttgttcaggtttgagacatataaaagaccccacctgtaatagaaaggaaaaaaaaaaaaaaaaaaaaaaaaaaaaaaaaaaaaaaaaacaaccaaaaacaaacaagaaaaaaaaaaaactaaactcaagcgcaggaacaagccacgaaaaaaaaagacaacacaagcaaaaacacacaaaagactataaaaaaaacagaagacggaggcaggggcagccaagaaagggtaacagacagagtgagacacacaaagcctagagaaagaggaaaaaactaagagaagtaactagcgaagcagagagaagaaataaccaaaagaagaggcacagcgcgccaacagacagagacagcgaggagggaccgcaagcaccaaggacagaacgaggaaccacactatcacgggtacaaaacagacaagaacacaacaacggacaaaccaagcacaacacaaagaacgtacg

SEQ ID NO: 595071 - DNA, 2252 bp, Homo sapiens
aggagaaaagggcgctggggctcggcgggaggaagtgctagagctctcgactctccgctgcgcggcagctggcggggggagcagccaggtgagcccaagatgctgctgcgctcgaagcctgcgctgccgccgccgctgatgctgctgctcctggggccgctgggtcccctctcccctggcgccctgccccgacctgcgcaagcacaggacgtcgtggacctggacttcttcacccaggagccgctgcacctggtgagcccctcgttcctgtccgtcaccattgacgccaacctggccacggacccgcggttcctcatcctcctgggttctccaaagcttcgtaccttggccagaggcttgtctcctgcgtacctgaggtttggtggcaccaagacagacttcctaattttcgatcccaagaaggaatcaacctttgaagagagaagttactggcaatctcaagtcaaccaggatatttgcaaatatggatccatccctcctgatgtggaggagaagttacggttggaatggccctaccaggagcaattgctactccgagaacactaccagaaaaagttcaagaacagcacctactcaagaagctctgtagatgtgctatacacttttgcaaactgctcaggactggacttgatctttggcctaaatgcgttattaagaacagcagatttgcagtggaacagttctaatgctcagttgctcctggactactgctcttccaaggggtataacatttcttgggaactaggcaatgaacctaacagtttccttaagaaggctgatattttcatcaatgggtcgcagttaggagaagattttattcaattgcataaacttctaagaaagtccaccttcaaaaatgcaaaactctatggtcctgatgttggtcagcctcgaagaaagacggctaagatgctgaagagcttcctgaaggctggtggagaagtgattgattcagttacatggcatcactactatttgaatggacggactgctaccagggaagattttctaaaccctgatgtattggacatttttatttcatctgtgcaaaaagttttccaggtggttgagagcaccaggcctggcaagaaggtctggttaggagaaacaagctctgcatatggaggcggagcgcccttgctatccgacacctttgcagctggctttatgtggctggataaattgggcctgtcagcccgaatgggaatagaagtggtgatgaggcaagtattctttggagcaggaaactaccatttagtggatgaaaacttcgatcctttacctgattattggctatctcttctgttcaagaaattggtgggcaccaaggtgttaatggcaagcgtgcaaggttcaaagagaaggaagcttcgagtataccttcattgcacaaacactgacaatccaaggtataaagaaggagatttaactctgtatgccataaacctccataatgtcaccaagtacttgcggttaccctatcctttttctaacaagcaagtggataaataccttctaagacctttgggacctcatggattactttccaaatctgtccaactcaatggtctaactctaaagatggtggatgatcaaaccttgccacctttaatggaaaaacctctccggccaggaagttcactgggcttgccagctttctcatatagtttttttgtgataagaaatgccaaagttgctgcttgcatctgaaaataaaatatactagtcctgacaaaaaaaaaaaaaaaaaaaaaaaaaaaaaaaaaaaacaagaataaaaaaaaaaaaaaaaaaaaaaaaaaaaaataggaggggacgcgcgcagcgagcgcaccagacgaaaaacagatcataaaaaacacacacgggggggacgcgcggcgcgcccaaccgagggacacagcacacacaggagcgagctcgaaaccggggcgcacgcgcagagcaacatccggcggcgcaacaaacaaacaaggggcaggcgagggaaaacctccccaccccaacaaaaaaaaaaagaccacccgcgcggcgggaaaacacaagcggcgcggtgtgctctcacaaaaacaaaacccacccaaagaagagagcgagcactgagcggggcgaaccaacagaggagggagtactataacaaccaccagacgaaggaacgacacaaagagagaaccaacgcagcacaacatgaaacagatagcaacccccaccccccccgagcagggaacgac

SEQ ID NO: 595072 - DNA, 317 bp, Homo sapiens
  misc_feature (25)..(25): n is a, c, g, or t
  misc_feature (28)..(28): n is a, c, g, or t
tggtatccccagaggcagccttcgnttnatccaagctttctatttaggagattcaagccatctccctgactaccaattaatgtgtttgttaatgctcggcttacagagttgcataaatgtcagtgatctgttccaatcctgtttttttctgtaagttaattttaatgcataattttgcagaacacaaggttttccaaagcatgtatatagtattacagtagaaatgtatatattttggggggggtcttctatttatcaggcatttttaagtaatggggaatttaggatgtggaaggaaaaccagggtaaaaaaattt

SEQ ID NO: 595073 - DNA, 1208 bp, Homo sapiens
cagcgctgctccccgggcgctcctccccgggcgctcctccccaggcctcccgggcgcttggatcccggccatctccgcacccttcaagtgggtgtgggtgatttcctggcggggggagcagccaggtgagcccaagatgctgctgcgctcgaagcctgcgctgccgccgccgctgatgctgctgctcctggggccgctgggtcccctctcccctggcgccctgccccgacctgcgcaagcacaggacgtcgtggacctggacttcttcacccaggagccgctgcacctggtgagcccctcgttcctgtccgtcaccattgacgccaacctggccacggacccgcggttcctcatcctcctgggttctccaaagcttcgtaccttggccagaggcttgtctcctgcgtacctgaggtttggtggcaccaagacagacttcctaattttcgatcccaagaaggaatcaacctttgaagagagaagttactggcaatctcaagtcaaccaggatatttgcaaatatggatccatccctcctgatgtggaggagaagttacggttggaatggccctaccaggagcaattgctactccgagaacactaccagaaaaagttcaagaacagcacctactcaagaagctctgtagatgtgctatacacttttgcaaactgctcaggactggacttgatctttggcctaaatgcgttattaagaacagcagatttgcagtggaacagttctaatgctcagttgctcctggactactgctcttccaaggggtataacatttcttgggaactaggcaatgaacctaacagtttccttaagaaggctgatattttcatcaatgggtcgcagttaggagaagattttattcaattgcataaacttctaagaaagtccaccttcaaaaatgcaaaactctatggtcctgatgttggtcagcctcgaagaaagacggctaagatgctgaagaggtaggaactagaggatgcagaatcactttacttttcttctttttccttttgagacagagtctcactctgtcagccagactggagtgcagtggtacaatcatggctcactgcaacttcgacctcccaggctggtctcttgaattcctgtgctcaagccatccttccacctcagcctcccagagtgccaggattacaggcatgagccaccacacccagccaccacttttctt

SEQ ID NO: 595074 - DNA, 779 bp, Homo sapiens
cagcgctgctccccgggcgctcctccccgggcgctcctccccaggcctcccgggcgcttggatcccggccatctccgcacccttcaagtgggtgtgggtgatttcctggcggggggagcagccaggtgagcccaagatgctgctgcgctcgaagcctgcgctgccgccgccgctgatgctgctgctcctggggccgctgggtcccctctcccctggcgccctgccccgacctgcgcaagcacaggacgtcgtggacctggacttcttcacccaggagccgctgcacctggtgagcccctcgttcctgtccgtcaccattgacgccaacctggccacggacccgcggttcctcatcctcctgggttctccaaagcttcgtaccttggccagaggcttgtctcctgcgtacctgaggtttggtggcaccaagacagacttcctaattttcgatcccaagaaggaatcaacctttgaagagagaagttactggcaatctcaagtcaaccaggatatttgcaaatatggatccatccctcctgatgtggaggagaagttacggttggaatggccctaccaggagcaattgctactccgagaacactaccagaaaaagttcaagaacagcacctactcaagtaagaaatgaaaggcaccctagagatgttccagccccaaagatatttgaataggttggactcgggcaccaatctagcaagtcctacggaagttgtataaagctgaaaatactgaagcatttcccaaatgggaaatcctaaact

SEQ ID NO: 595075 - DNA, 1596 bp, Homo sapiens
  misc_feature (1270)..(1270): n is a, c, g, or t
tggtattggtttgggttttggtttttgaaatggacctcttggctcagctcatctccaggcgtggagtgtgcaggtggcacgatattctgtggtccccgtgcaaccttctgtgccctcctggggtttcaagtgtgattctcttcaccaagcaggagcgggccccttccctcacgcggagccgcttggcacgtggacaggccttcgggagaagggtcagggcttgaagcggtccttttccttctgtgggcacccctgggaggggtgcctccccattgggctttccctcaagattatgcaccattcttcgggggctccagcttggccatgggcctggatatataagagttttaaacaatggctgggcgccatgtccacccatattcccctatattattatggaatctttttacacaaatgtctctgagacctctttggaaacgcttttcaggggcgccctcagagggggagacacgttttggtatacacatgtcacaacaagaagcggctctgggcctttctaacctctctctgagatctctcttctttccaccacaatcttggatctttcctgagaaattactatactattcagagatattctgggcgcaaaaattgagcaccctgtcgggcgcccacatatactatccccctctttcttattgagacatctccagcgctattacacgctttgatactaaccttgggcgcagggtgtccagagagacatacccctgagtgtttcacacaaacgcggtggttcctttcacacctcttttctccacaccccgaatgcggggtctcaaaaagtcgtttcctacaggatatgtagtcctctgggtattacgccaacggtttgggcggcaccattacaatttaaaaacccgttccctgagaacctgtgggcatcgacaccccttgttctccagtcgccggcccacacccttggtagggccccaccagcaagggggtctctacactcgtgcttcgccccctgtctccccactttgggcgagcgccctttggtgcacacgctcggtgcaacccctttcctgttgccgcggggcacccaccccttataaagggcgctgtcgctacgggggtcctcttgggtactaacaccccctgttgactagggagcggctgctatgttgcgacccactctctcccgtgtgcgctgctgcacatacacacaaaggggggagcgacccccacgacaaactggttggccgcacgatcacttcatgctcgctccaacgaggaggagaccttncacccgagctgatcagtcagaccgttctcacagaaacactgcgcagcacatagcggcaaaaagcaaataataggcgacacatagcaaattaaacgaccaacaaacagcataaacaaaaaatacaattagataacagacaaagacgataaaatataagacgacatcgaccaccaacaacagagaatagagcagcaagaactaatacacatcaaccactagataacaacgtcacgtacgatcctcgccccgcggcgccaccatcgctcccacctcatcaccacactaaccatcacaaacacacaataacaacaaaaacaccacgacaa

SEQ ID NO: 595076 - DNA, 461 bp, Homo sapiens
ggacccggatgcacactgcaacaagcaaacttcagatttcaaataaacacttgggccaaacagtattaccagatacatcagtttatcaaactctaatttcccatgatttgcctggcgtggtggctcatgcctgtaatcccagcactttgggaggcagagcggagcggatgacctgaggtcgggtgttggagaccagcctgaccaacatggagaaaccccgtctgtactaaaaatacaaaattagcaaggtgtgctggcgcatgcctgtaatcccagctacttgggaggctgaggcgggagaattgcttgaacccgggaggcagaggttgcagtgagccaagatcgtgccatcgtactccagcctgggcaacaagagtgaaactccatctcaaaaaaaaaaaggttatacaattatgaacccagaaaaaacaaaataatcttggttaatgtgcctttttttg

SEQ ID NO: 595077 - DNA, 997 bp, Homo sapiens
cctccgatacaatgttggtcacagtcatacgtccaaggtagctcgacagattataagccgtggttacgtttagtctgctcgcataagcactagcgtatcgtctgctaacggtccatcgcatacagtgcatgagaaagagtgtgccgcaagattatgtgtgaatagtcgtaaaatgctaaggatcagagtgtttcgctatgcacatcgcatggccattctcgtacagtggcatgtattaaatacgtagagaacgtagctgcctttgctacatgaacatgtttggcttccaaaattggaactaggtctgtgtagacacaatctcaaactctaacaggaacacactgccaggaacaagtccagttatcgcaacgaaggaccaggtcatatagttggcatcgtacttagcataggtatttattgcgcgccagtgcagcgtcctcaggaaaccatggagttgtacgacaaggcccctccagagtaacatgggtgattcagttgtcttgtctaatggcacactcaaacccaggtaaaagcccatagtgactcgtagaccaaggtactggctcatgtgcatgactaggtcattcgtcgacccataaccgggtgttcacgaacttccctaccccttgtcgtgtgcacatgtcctagagacaacctcattgaagcatcctgccgacctttcgaatcagttgagacaatcaatttttagtacagactcaacaattgtcttccccaattcaatcgagttaggcatgtggtgcgactcgaagggacgaaaggcccaagctttcaccccttcagccaggcaaggtggcccttccctggcacaagattcacggaaatcccccaacggtactcgatggttgaaagttcaaatgccaggacccccagacaaatagcatcaggctttgttcctttggggcaagcaactgggtcaaaaccctaaaagaaagactcttgagggaaggcttgggctttgccctgaattgtgaaatcc

SEQ ID NO: 595078 - DNA, 192 bp, Homo sapiens
tgcagcttcttgcccgtctgcacaagctgcaaaagaccctttgcacggtgcgtatcctttcccgttggggcttccactgacccggaggcgtcctagatgtagtagagcggcacctcgccacacagggtgctcacggtcatgaccaggaaggacgggtcccctccggagggtgctgagcctgaatctcgcccc

SEQ ID NO: 595079 - DNA, 663 bp, Homo sapiens
acatatttcactaaagacaagttttgggctggatgcggtagcttacacctataatcccagcactttgggaggctgaggtgagagggtcacttgagcccaggagttctagacaagcctgggaaacatagcaagatctcatccttacaaaaaataataatggtgtgtgctgaagtcctagctacttggggtggtttgagggcaggaggattgtttgaggttgaggggaagttggagggttggcaaggtggaacttaatggatatttaaccaattggaattcccaaggttgggggcaacgcaaacattggaggaaccgtggtttttcaaagaaataaaacacaaaagttgtttggcttaagagattaatgggcgggttggacatgtggtgcacatttggagaaggttttgggaacccggggggaaacttttaaagaggtgggcttttgtaaagaagtataaatctccgggggtgtcctgcaacattgtttgaaaacacctgtgggtgcccgattgggggcgattataaacgcggcgcgtttaatatgcaaccaattggggatgttggggagaaggggggcgtttttcaccaattcaagaggggatttggggggtaatgggtgggtcaccatttcggaaagggggtgttccccccagaaattggggg

SEQ ID NO: 595080 - DNA, 101 bp, Homo sapiens
cggtgaaactgacgtggtaggcgagtgtatgggacgggatgagcggactggggaggcggcacggtgggccagctaccatctatcttccattgatgtggctg

SEQ ID NO: 595081 - DNA, 351 bp, Homo sapiens
taggccagggtggggcccccccaaatgggctcaggaagccccagggtgccctcagagaaaagccctccctttcagttgccaaaagctgcatcaggggaatgcggcaaggcacacagggttttggcagcccctggggattgggcgctgcccctgggaggggaaagcctggccagggctggtgttgggcccggagcagcattttccggtgctatcctcccctcccccccctcacagctcaagccaagtccagcggccgcagttttcccctttccccactccctttttatttggggtttttacttttgcctgggtttgctctttagccaataaaccgtccttgtgtgggagtca

SEQ ID NO: 595082 - DNA, 146 bp, Homo sapiens
ctagttatccaaatggtacttatataccggagtcagtaagttcacaatcatgggagattattccgacgcctggtctgatatgaatctagcacttcagggtgacctgaaaaatcagaatagatgtaggaatagaatggggtcacctc

SEQ ID NO: 595083 - DNA, 529 bp, Homo sapiens
atgtatgggcagcgggagataatgcctgccctgttgatggacatgtcgagcgcagcacaagccctcgatagcttaccaaaaggcactcaggtgattgctagaaaccaagtacgccttgcagaagtctggatggatgaatacaaggaaatcttttataggagaaatacagatgcagcaaaaattgttaaacaaaaagcattcggtgatctttcaaaaagatttgacataacaacaccgccttcagtgtacaaattttacatggtatctagaacaacatttatccagaggtgtatgtgccagaccttaatcctgttatatctagatacattaaaaagcgttggtcagcctctatgtctggatgttggagaaaacaatcaaggaggcaaaccattaattatgtatacatatcatggacttgggggaaaccagtactttgaatactctgctcaacatgaaattcggcacaatatccagaaggcattatgtctacatgctgctcaagggtctcgttccagctaaaggcatgtac

SEQ ID NO: 595084 - DNA, 220 bp, Homo sapiens
ggtgtacacgtaataccatcatccttgccctttagtggaggattttatattttgatgtaccgtgtgtcgcggctgaagactgtgtcgtaacactcgcacagtgtatagagaaagtaatattgaccataggaacaatgttttaaagtaatccgttgaatattttcatgaaaatccaggttgattttgcctgagcataagtaggtcttcatcaataacctct

SEQ ID NO: 595085 - DNA, 508 bp, Homo sapiens
tagggaaatatctatgttgaggctgtcctcagtgctgatcctcgtcggggggaagtaggtcaggaacttgttcatgaggtcgaagccttggtctgagagcagagccccgaagcgcttggggaggtggttgtaggggtgctcgctgaaggtcatcttcttgagtggtgggagctcgctgtagccgggccagattttctcactaggggtccccagatccttgaacaccttgtggatcggatcgatttctgacttcccggggaacagaggcttctgagtcagcagctccccgaagatgcaagccagggaccatatgtccacggccgtggagtattccttggcaccaagcagcagctctggggcgcggaaccacagggtcaccacgagcggggtgtaggccttcagaggggatccgtactcccgcgccagaccgaagtcacccaccttgaggatgccggcgtggctcagaagcaggtgggacgtcttgaggtcacggtgcaggatccagttg

SEQ ID NO: 595086 - DNA, 316 bp, Homo sapiens
ggtaatgatatagttgtgttagaaataactccggccaggaggtggctcatgtctgtagtcccagcactttgggagactgaagtgggctgatcgcttgaggtcaggagttcaagaccagcctggcaacatggtgaacccctctctctactaaaaatacaaaaattggttgagcgtggtggcgggcgcctatcatcccagctactcgggaggctgaggcaggagaatcacttgaacctgggaagtggaggttgcattgagcccaagaattgtgcccacttgcattccaagccttgggttacaagagtgagactgtccc

SEQ ID NO: 595087 - DNA, 294 bp, Homo sapiens
ccgcattccagtcgcagggcctgccccatccacatgcaccactgcccactcccaggtgcaggtggcgcatggctggcatgcaggccccccatcgcatgtgttcccagccagccgcacgggcaggtgtgcctggcgcagccgccgtggccagggccccatgtttctcagcagggccctgtcccccagccctgggcctgtcccatcctctgccattgctatgttcctgcttggtgggcatcctcgtcagcagtctgcaccatgccaggccatgccacagcttgtgacacatggcct

SEQ ID NO: 595088 - DNA, 1022 bp, Homo sapiens
ttatgaaaatcatttagttgacaaggtgcctatgccatgttaaattttctttaagtaatttaacaacagattggctaatttaaaataataaatgaaaaaaaaaatcttaccagcagttggtaaaggtctggaagtcacagttttgggcattcctttagttcaggtctctgtcgtcgtccaacgtacacttaaattttggtgccgagcagggagtataaccggcagttaagtgaaaagaaaatccagcgcctccccctccaaaaaaaataatagaaaataaactttctattttttataatagtttagtgggttcgttatttaagaaccttgttcaaagggggtctttgtttaacctgttgtgatattaccctgtgtgtccaagttcagacgaacggaacattcatccgccttttgggaatagctgtggttaaggctggttgttggccacctccgtcggccggagtaatgtgtcacagctatcagaacagtggcttcatcagaaatggtgcataaatctttgcaccaacactcttgggcgggtccggcatggtgtgaaataccttttagtaagtttcactgactcccaagggtactttgatgtagggcttcggaaacatcaacatttcggacaatgccctccccaaagtggtcatacaggttcttatggagggcccgatggaattgctggtagcgttttgaattagaagagttctggggccctagattcggggggcatacaagtgttgaagccgtctccaagacatgagaagtggtggacgctttctttcgtttaacactctttatactttgcatatagaccaatgtgccctgggttggtaacacagattgggcatacatggggaggaagaacgtgctctagcgggccaagggggaatttaagcctacgcgtgggtgagagttgcgtttcccagacgactgggtcctaaccagcaggttcggctcagacgaggaggaggggataaaacccaggcagggcgaaagactatagaggcgtgatcaat

SEQ ID NO: 595089 - DNA, 955 bp, Homo sapiens
gtccaaggcaggcggtcaactgcgacgcgccaccgtagagagaccacccggtagtggaaggcccgctggctgctacaacttcaggaacctggaaaagggccacccctgctacgcgccaggcatcatgaaaatgcggtgatgagtgggcatggtggcgtgacctggtgaacgggagggacaatgcagatgatgacctgctggctcgctcctggcggagacggaccggtgggcccagggctggctggtgttactggctccgccacgtctagtggaaggacggtagtagggagggaaagactcaagataccaaagacgggaggctctttccttccttcccaaacctgcctaccgcttctctaggccctggctggctccagagcactttattcttctgattcgtgcgggctgggcggggcacacaggggtggaggttgagcctggtctccatccaggcactagcatttcagccattctcgagcaaacatgtctggaggtgcccggaatggccaagggcaactgcaaaaggtagaatgcgcggtgcccttgcacgatggctcccaagagtgggcgagcagagaaggggagtggcctggaggcgcgaggcatgtacaggtagcaggggatcccgtgctgacagaccgtgacacctcccaggaacactttgcgccagcctgggacgaagattcacccacggagcatcggaatgcaggaacaagacggccacactcccatcacgggatgcacttcatacgatacgtgaacagtgccgaacttacggtaggcacccgtggcccaaggcaaagataggaagcttctggacgcaggaattgcccggagcttacttcggcaatggggcatcatacgtgcgagcgtatatcctagtacagacgggcgaggacacccagggtcctcgaatgttgatgtgcacgacactacggaatagcggttaataccc

SEQ ID NO: 595090 - DNA, 194 bp, Homo sapiens
ggcacgagattttattagtgcttgagagaatcttaattgtaggattgggttcaacctcacacaaggaaaaggattttttaccacttttttttatataggatataagggtgaaggaaccccctttaggtccttgaaatatgtggtacattaatatgccttgtttaattcacagaaatttcccaaaccttgtacta

SEQ ID NO: 595091 - DNA, 165 bp, Homo sapiens
  misc_feature (15)..(15): n is a, c, g, or t
aagaaacccgagacnccaactaatcccagaacagctaaaaccaataaagaaccaaaacttcacgaccactttcctgaggaccctgctgagtgctcatgacaccaatactgacaattgtagcggtaatacatacaatgatttaataagcctatgctactggacaca

SEQ ID NO: 595092 - DNA, 342 bp, Homo sapiens
  misc_feature (2)..(2): n is a, c, g, or t
cntgagacgacttgagactggcatgtctagagatgtgcatccctggggcctggtggtgggcggtgtgtccagtggtcagtgagagtgagggcagtggttactgtttgggataatcaagaatggcactagaacgaatatgtgctaacataacaattatcataaagtgaaaagaaaatagaaaagggaccatcaacagaggtggatgacaaccaggggtccatggggaatacgagggagaatgattatatataagcagatgaaaaatgaaacaaatcagacagaggtcttgtccaggacatctgagcagacattgtcccttgtccaaggtcttcatcttgcagg

SEQ ID NO: 595093 - DNA, 161 bp, Homo sapiens
atctacaggctccggaataactcctcatattgtgactaagactccggataatctagaaccattgggatacataagtctgatctgagctatgcatatcgattggtttcctatggtttgaatcgtgtgagcacaccagtatattctaacaggtaggaactagg

SEQ ID NO: 595094 - DNA, 130 bp, Homo sapiens
gggttgttgggatgtggctcactaaatttgcatgcatgaatgtgcaatttcaaacagcatttttgctcacttcacagtgtttttcatttgtttgcattcctcaaccaagcacaccctgtgtacctgagct

SEQ ID NO: 595095 - DNA, 884 bp, Homo sapiens
tgcaccacgctctggtctcaggtcgcatagtgtgggagcaatgtgtggcgccgttgggtgacatacacggtgtctcaaggaggtttcctcttgggttcccccaggaaggcacccgcttccgttggtcgtccggtgccctgcccgccgctttagaggtcgcgcctccgacacgttcctacgaggtggggccttcccccgccgcaccatgctacaaaccccgcgtcgcaccccggtagtgggccgtactcctacccgtaggtccaatagtgtgaccgacttcttccgtcgcatgggcagccacgttgtgacgagcccccttctggcgatgcatgttgtaccgcccctcctcttttccccgggtaattttccccccaattttcaagactccccctcgagcatatgccccctaatatctctttatgtcttacgctcacccccacggtagtctgatctcttggtgatggatgtagaacaagaaaacaacatggtaacctgtgtttttttcgtggtaattgatgcccaatgaatatccctcctgcgcgcagcgttcaattttcatggattcaccacaccggcatcaccacccggtcttattggagaaaaaccttttatcttatgccgtctctgataaaataaatagcatgtaatcccacaagatgatttttatagttatacagccacccacccacaaaataggagtgccaacaacaggtatcccccctatgcaatcactcctgttgttttcatcatgcccctttctcttttgagagaaagcctgagacattttggtcccccttctccccacaacccctatattttcccctaatgcgcggccctagttttaaactttttcccttcttggagaaaaagccccccacaaaaca

SEQ ID NO: 595096 - DNA, 886 bp, Homo sapiens
ccgagctcatgatttatttgcctcttctgcagtagctttaccgtgtgaactagttgacagccctgtgccctttgttgaccactttttgggcccaaagatgccacgggttctctttctaaaagcccttgtgattccggcgcgtgtgccaaaagctctcccgtcaaaaattcctaattagcccgttgataccccctgcgtaatcggcgctccccacaatagcgttcacgcggtatttccttgtaaaacgccgccccccaatttttgggccgaggatctctctctcccgagatgcccgcaacacctcgtcacccgcgtatacctctccgaccggggttgtcccccccatttcgacgggcccagctactggtcggaaaaagttccccgcaccctgtttttaggagatctgggtcccccgacgaacgccccttttggggaccactttactacgggtccccgcaatagttttgacccgttgttagaccacttacaacagtggtgtggggaaatgatactaatctcggcgtgaccaccctttgcgccatgtaaaggtatcgccccctaattagggacacagcatagtaaaaaggtgctgacccggtaccccacccgttgatcatttttactgcggtccccatttcagacggcgaaacaattttgatagtataataaagacattcatttggagggccacgcagagcatctcgggaatatacgtctaaaccgtgtggtccctcaatagattccccggggggtcctggtttcccctctcgtcctagtggggaatacacaatcccactttgtatgcgagatatcatcatggccccccaagggagataaattggcaaaacgtttcccaaaataaaagtaaaaacccaaccacaataac

SEQ ID NO: 595097 - DNA, 262 bp, Homo sapiens
  misc_feature (172)..(172): n is a, c, g, or t
cccgatggctgctatcaggagagagtcaaaaggcagcttgccagaagaataatgaggacatctaggagatgggtctgaggaggggcaaagaaacctcacagcatccaggaaagtgacttcagagagacactcccatcagatgagcagaaactgcctaatgaactcgtatgtntgtatgggaggcactgtggtggtggccaggcagagcatccttactccacattgagtccctgccagtttatagacatttacctgttaggtc

SEQ ID NO: 595098 - DNA, 929 bp, Homo sapiens
ggcctgtcctgacaggaaggtggtgcatctacgtggagtgtggacatgtttgtgcctccactgttgatactgctggctgcaatgtacctgcaccctgtgacctctcatgggtgaactctgttcaacccctgtgtgggactgaatgatgcccttcgacttccccaatggtggtgcttgcccacgctggcttcacttctgcattgcagcctttgagtgagtgtggggtaaattcgtcagtggcaccggatcctgcctgtctctgccatccgctccggataccactacgtctgcctgctggaacgaggccaaccaacctgctgtgcctgccggccctgctcatctacaccgaagcctcggactacattcctgacgaccaccaggactatgctggaggccctgatcaaccccattaagcacgtcagcctgatggaccagagggcccggcagctggcctgccctcattggggagagtgaggctcaggctggccaagagacgtgccaggacacccagtactcgagcaggctgggaggtactcaggctgtccttcaaaatcgtccaagcccccctgccccgcatgtaccacactcaccgccgaaccgacttccctcacccccacatacgctctcaccgctccatctctcctactctaccacttcacccccacgcccctactgctttctcctctctacccccacacacccacccgcctccccccttacccacaacccccccttctctcccgtcccccctcatattaccaatccttccccctccccctccacataacaccctactccccaccccccccctacatccccactctctcccccaccctccccccctctcctttctcccctcccacccacatcattctcccccaccctctctatcccacaccctacacacctctcacaccaacctccctacc

SEQ ID NO: 595099 - DNA, 313 bp, Homo sapiens
tgaaagttgttcaaagccaaaataagtttagatatcaaaatcattccagctctgcttttatctatactggatttggtagaaaactaatttgaaagagaatttaattttcttaaaattccatatatatatatatatatatatatatatatatatatatatatatatataaatataaatatatatatatatatatatataaaaatatatatatatatataattgtctttaattgtattcaggatttattttaataataaccgatttggaccattttgaacattccctgtgttaaaattcatatgacttcctttta

SEQ ID NO: 595100 - DNA, 131 bp, Homo sapiens
tcccccatcgatggggttcctggaaggtggaagcctccctgtttttactcccttgcccagtcttcccccacggcgcgtggattacctactcgcattagttgactcccataatctgtcttgtaaatctatgt

SEQ ID NO: 595101 - DNA, 825 bp, Homo sapiens
gagagtcttcctctgtcaccaggctgcagtgcagtggcatgatctcggctcgctgctaactccgcctcctgggctcaagcgattctcctgccttggcctcccgagtggctgtgattcctggtgcacaccaccacacccagctaagtttgtatttttggtagaggtggggtttcgccatgttggccgggatggtctcgatctcttggcctcccaaattgctggaattacaggtgtgagctgctgcgcccagccttctattttattttattttattttttgagacacggttttgctcttgttgcccgggctggagtgcagtggcgtgatctcggctcgctgcaatctctgcctcccgggttcgggcggtttttctgcctcggctcccgagtagctgggaattgcaggcatgcaccactagacttggctaatttgtattttggtagagatggggtttctctatgttggtcaggccggtctcgatcttctgacctcaaagtgatcctcccgcttgttctcccaaaattaacttgttatcaggtatatcgttgcaaaatatttctatcctgtagagttttagaaatttgttctcttgctgtgaagaagcagtttacttgatacaatcccacttgtggtattcaccggtcgtgcttagctgttgatggcatatcaaaacattcattgccaggaacagtatccaaggttttaccatatgttcgtcaggagtctaaggttaggctacgtgtagtctcccatttgcgtcacttggggatagggaaacgccaagcgtacacttgccgggcaaggtgcggcctgttcccagctcgg

SEQ ID NO: 595102 - DNA, 150 bp, Homo sapiens
atgattgagataacatattccttacacacattggaaacatatcaatataggcagctaaatatgtgttaaagttacagcggaatacatatagaggatatatagggagcaaaatcaaattatgttctgctctcagagttcataaaaccccca

SEQ ID NO: 595103 - DNA, 400 bp, Homo sapiens
acccagcccaaattggaaaatggcccccttccatgcaagccacattggaaaaggaaagcattttggtttttcaaaatttaacgctgtgccttggcagggcacaataaccttgttgaaatcccacctgtcagaacgcctaggggtttgtaccgggttggcttgggcctataactttttaggaaaccctcccccccccttgtattccacccttggattgggggcccctcccttgggaaaggtttccccatgggcctgccccaggagacagacaaaaaaggcagcagggggccttttttgttaagaaaggggtttggccctccctccttcttttttgtttttaaaagcccggggggggggggaaaacccccccccctcctgcaataaaataggagcttgggca

SEQ ID NO: 595104 - DNA, 633 bp, Homo sapiens
aatttgtggtgattctgaaaataagacaacaataaagtttggtacattgattgactctttgacaaaagatttctctgtagttcgtatggctatttgacagcattttactcgcagtagaacttctttcaaaattggagtcagtcatctcaaacttggcttctgctttatcaactaagtttatggaatgttctaaatcctttgttgtgattttgacgatgttcacaacatcttcaccagaagtagattccatctcaagtatccactttcttttctcatccatgagaaataactcctcgtctgttcaagtttgatcatgacattgaagcaattcagccaccacttctaattcttttgttgcttccaccacatctgcagttacttcttctactgaatccttaaacctctcgaagtcatccgtaagagtcaaaatcaatttctttcaaactcctgttgatactgacatttggactccctctcatgagtcaaaaatgttcttaatagcatctagagaggggattccattcccgaagacttttaatttacttttgacggatctatcagatgagtcacttttttttacaccttacagccttattaaaggttcttatttaagtaataagaacttgaatgtaa

SEQ ID NO: 595105 - DNA, 730 bp, Homo sapiens
tctccctgtccccctcccatgtctgtaatggcccccccccggagttaccgctgaatgggaatatactccccctttagcttccctattcccccattttcccctttttgctgacagagaatctttttaaacagacccttaactgtgctatctcacgtttgtgtccgtacatctttgtggaccccccaaaaaatactcccaacacggggggggacccacccccacagcgatgttccacgccgtgctatacccgttctggttgcaccctctcaacgcttcccctttgcatccctcattaacagaatctttcgctctttttctgcgttacacacaatgtgttgctttttcctcacccccctccctgtagtctctcgctctgtttattatcgccactcttgaataagcccacttttatgtggtcctataaacgcttgctttctattaagacagtttatacctccgcgaattttgcccaaacacccaccacaaagcttttttttctcccctccagaacctacgaccccctttgttcgtgaacctaacactagctggtctcagcatgactactctttgctggcctcttgaaagagcacttatcaactttcacccgaattatacttctcccctctggaataataacagcctctactcgccatggttacatgttgttatctattggcaatcactttggtaccacacaccacgacccattttaaaaacgcacaacataaca

SEQ ID NO: 595106 - DNA, 164 bp, Homo sapiens
atgtcggcggaggtgagttcggtctgctggtcaggtcgaggagcttctgcttgatctcgtccttgttgggcaggtgactgatggcgtcgtccattttggtcttgtagtcggcctgcacggtcgggtctttgaacagttcgccaatctgctcctgcaccgccttg

SEQ ID NO: 595107 - DNA, 374 bp, Homo sapiens
agaatataaatggaaaacccctagaagaatacttgccttttcctttttcctaggtgcacattaattagaacaagattaaagggcatgggtcaggtgaggtggctcatacctgtaatccccagcactttgggaggctgaggcgggaggattgtttgaggcccaggagttcaagtccatcttgggcaacataatgacaccccccaaattaaaaaaaaaaatagccgggcatggtggcatgcactgagtccaagctacatgggggactgaggtaggagggttgcttgggcttaggaggtagaggctgcagtgagctatgattgtcccgctgcattcaagcctgcatgacagagcaagaatttgtctcaaaaaaaaaa

SEQ ID NO: 595108 - DNA, 153 bp, Homo sapiens
cggcccgaaatcctaatacgcaactcataacttaatggggcattattatgtcagtatttagaaacatatgcaggccttgtttgcttcttgaaatggcctcatcccaccatcccctccttctccaccacgttgagttagcggtttcggggtatg

SEQ ID NO: 595109 - DNA, 556 bp, Homo sapiens
  misc_feature (19)..(19): n is a, c, g, or t
  misc_feature (65)..(65): n is a, c, g, or t
  misc_feature (77)..(77): n is a, c, g, or t
  misc_feature (81)..(81): n is a, c, g, or t
  misc_feature (88)..(88): n is a, c, g, or t
  misc_feature (99)..(99): n is a, c, g, or t
  misc_feature (111)..(111): n is a, c, g, or t
  misc_feature (115)..(115): n is a, c, g, or t
  misc_feature (124)..(124): n is a, c, g, or t
  misc_feature (128)..(128): n is a, c, g, or t
  misc_feature (134)..(134): n is a, c, g, or t
  misc_feature (142)..(142): n is a, c, g, or t
  misc_feature (148)..(148): n is a, c, g, or t
  misc_feature (186)..(186): n is a, c, g, or t
  misc_feature (188)..(188): n is a, c, g, or t
  misc_feature (206)..(206): n is a, c, g, or t
  misc_feature (222)..(222): n is a, c, g, or t
  misc_feature (232)..(232): n is a, c, g, or t
  misc_feature (240)..(240): n is a, c, g, or t
  misc_feature (289)..(289): n is a, c, g, or t
  misc_feature (293)..(293): n is a, c, g, or t
  misc_feature (383)..(383): n is a, c, g, or t
  misc_feature (447)..(447): n is a, c, g, or t
  misc_feature (553)..(553): n is a, c, g, or t
tggggggaggatgatgganaatgctcccctatgtcttgtatgaaacaactcggagtaaagtgtgntggtaaatctgnaatncccatgntaaataaaaantgtagaggaaantaanatatatagntagntattgntaaaactnaaaatnagaccacgttcgataaagcttctttaaaaggaatatananatgtatttgtaaacacanacaaaaagggaaaacnaaaaaatatncaaaaatntatcaaggggatcaaggccgttaagaaacacacaggtaatctcccactnactnagctggggaatgatagaactacgtgaacacaccatacttcaatgctgcagagcatgcacgggagacacaatgaggccccctccttggganagttgagaaaggcaggaggaagggcaaaggaagtgaggctgggcgggaaagcttgagcccaganacccaggtgaaagagcaacatctatctgttgcttcctttcttaaaaatgaagtggagaaaatactgaagatttgtggacaactaacagtcaagacatgtttctgtnaaa

SEQ ID NO: 595110 - DNA, 226 bp, Homo sapiens
ctttgtacagtacgccatctcactgaacacgcagggaatcagtggcgtaggttgggacagtgactgaaatcagcgcaacttatattcctaggagggcttagctacaaatgccctgacatgactttgtccataggttgcattgagtcatggctaggtacccacctaccattggcgcatgctgactccactggcagtcgtgcgtgcttctctccagctgcgtgtcctc

SEQ ID NO: 595111 - DNA, 499 bp, Homo sapiens
gagtgttagtttccaaatatggaggattttttcagagatctttctgttattgatttctaattgaattctattgtgggcatataattactttgtatttaaaatatatgaaaactttttaattaccaaatattgtttatgttggtaagtattttgtgtgtattttaaataaatgcatattctgctatttttgcttagagtgttctataaatatcaaccagatcaaattgatggatagtattgttcaagtcttttgtaaaagccttacagattttccatctacatgtattatcagatattgaaaatagggttttgaaatctctgactgttatagtggacatttctattccaccttgcagttcttttttttttttcatcatatactttgaaattctgtcttaagtacatacacatttagagttgttatgcaatcttgatgaatgtactttattattattatgaaatgacctttatctatgacaatattcttcattttgaagtc

SEQ ID NO: 595112 - DNA, 382 bp, Homo sapiens
taggtcgcacctaacgtacgtcggaagaatactacccgacttagggtgattatctagactatactttttgagatgcagctttcgcacttgttgcccaggctggagagcaactggtgcgactctaggctcactgcaaaattcgcctccgaggttcaagcgattccccgtgtcctcaaactcccaagcagctgtgatcacaagcatgcaccaccacaaccggctaaccctgcacttctcgtagagacggggcctctccatgttgcccaggctgatctcgaactcccaacctcaggtgatccacccacctttgcctcccaatgtgatgggaccacaggcgcgagccaccacgcccagcacaggatgatttatcttagccagatgg

SEQ ID NO: 595113 - DNA, 165 bp, Homo sapiens
gatcgagctcggtaccatggagaccaggctgagggtatgtgcactgcgctacagccgggccgcagcgcatctcagggcaggtggcaagatcctcactttcgaccagctggccctggactcccctaagggctgtggcactgtcctgctctccggtcctcgcaaggg

SEQ ID NO: 595114 - DNA, 432 bp, Homo sapiens
agacataatcccaggctggctgcagactgacaatataagaagctctattttcgctatcatgggttccttggggcacaccaagagtctaccaaggcatactttttcaggcgcctattatataaaaatgcttggcttaacatcacggtgaacaataccaaactgatgaatgcgtttcaaagcttggaacagattaagcatatattcccgtacttcttgaaaggaaagagaattcagaatgtccaaaaacgactcatgctccagatatggcatagcaataactacatgatcattcttcctaaagcagtatttaactcccatgacattatcttgccccccagccactgttaggcactgaagttcagctgcaattcttataggatgacttgttggaatcaagtgttttagagcaattttctcttcaggtcctacttg

SEQ ID NO: 595115 - DNA, 295 bp, Homo sapiens
gcccaaacccactccaccttactaccagacaaccttagccaaaccatttacccaaataaaggataagccgtaaaaatttaaaccttggcgaattatgataagtgaccccataggaaagtatgaataatttataaaccacggatgattattagaagggtataccccataactcttgaagaatgaagttatactagagataacgtttgcacgagagagcccgccaaagttaaaactcgcgataatacgagatgcgtctttatgcaaggagacagtcgactgaaaacagacaaacgct

SEQ ID NO: 595116 - DNA, 451 bp, Homo sapiens
tatctagagatccccggcgcacagcttctcagctatgtgtcttccgccggaaagatattaacaccactgaccagcaatatcactgtgctagtgacatgggctcaggcatgaaccgtatgcaccattgtgaactaccagatggtgaagactaaggaagctgggatgcagccagagctgcagatccggggagtaggatttgaccgtaccctggggggcctgtcagattgagctccggcttcgagaacgtcctgtctgggcttctcaatgagcagcgtcaatggtcatagagcctaggatggtgctggggaaaccccgcgtgccctggccaagctgtgtgcgttaggcctgcgtcggtttcccaggcgttctctgggcctatgctgatcgcgttggccatattgaaggcctgatgggtgatgtggacttcaaggctccagttcccggtgtggca

SEQ ID NO: 595117 - DNA, 651 bp, Homo sapiens
ttgaaatgtgttggaaacgtcattatgagatctgccttaccgaaactgtcgattattacgtaacgcatggcggaagcccacctatagcagcataaagtgcctgcgacgtctcagtctgtttagcgagtggaaacacagtaagaaacactgacctggtttgacattaaggattttgggtctggaggactcaggagaggaaagtgctggggctgcttcccagtgtcaccactggtgttgggaaccctgcatgtaaacatggtcggactcaatcctcaactgctggcagtcagccttctcaaccatacctcagggccaagtggaactaaacattttagctttttcaacactccaaacctacgcgggcataaactcgagaatcttctgccatttacttagtttttctattcagacttctgagtttctcatacatacattggttggttttcctcccaattcagaaagggtaactgggtaggtttcacatgtatctttccaacatgtcacgaaaggctggattaaagatgtgagacgcgtgatattcatcctaatgcagctaagtgtatggacaagggccacttggcctttcttcagaagatgaggttcaacagaaggagaagaacagctgtgctagtgtcagcactgggcatgcag

SEQ ID NO: 595118 - DNA, 631 bp, Homo sapiens
  misc_feature (273)..(273): n is a, c, g, or t
cccacggggtgtccaccgtggagaccccacgctgggggcgcccacgtggcacaacggttctcgccgcccctgtggggtcctcgcgcccctactgcgacacgcggtgtccccccgtgtcgcgctcacgcgcacgagtgggcgcgcgcctcagccgccggtggcgcacacacgcgcgcgcgtcgaccccctggcatggtcccgtcccacaccgagcgtgcacagccagagagatttcgcaagaggcccccacacccggtgcgcccagacgtctcncggagcctcaggacacacacaccagacgccagatggccacagagccccacaccggggcattctctccgatggacccatgagtgcgctctcttccgcggagagaccttttccctgcccacgcccaccgcacgcacacaccgcggagagaagacctgaactgtctctcttggctgcatcttcccgaccctggcccagagagggctttttctgtgggatgggccctgggcacgcggccctttcctcgtcacgtgccggcccacccaccagcaggccccccaccccccggcagcccggcagaggacgggaggagacccgtcccccaccccgccgtacccagaaataaaggcttcttgtgctt

SEQ ID NO: 595119 - DNA, 1018 bp, Homo sapiens
  misc_feature (408)..(408): n is a, c, g, or t
  misc_feature (533)..(533): n is a, c, g, or t
  misc_feature (571)..(571): n is a, c, g, or t
  misc_feature (911)..(911): n is a, c, g, or t
  misc_feature (936)..(937): n is a, c, g, or t
cgggattataggatcctgtcgccctacaggcgcgatgccggcagcgccggggcgaggcccgaggtggccggggcccgtggaggcgccgccgtcgccgctttcctggttgctgtctccgggagtgctggggccctttgagccggctcgcgtgggagcctgcagcccggtgcggagaggaaggcggtcgggtgtgacagcggtccgtgttccgggtccttgcggcggtcggcgtgcgggtcgtgccggacagtcgccttgggcgacggttgagccggtcgtcgtaggggcgcgtgtgtccgtgtgtgtcctcccgttgcgtgacagttcttcattcttcctttctttcgtgctccctttggtgcgcccctgtggccgcagttcctgcgatgtgcggcccccgtagttcgntgttagagatcggtatgcgcgtgatgtgtcccttggtgctgcgatgcgtggccgggttcaaatacgacgggtgttggggggttcttcttatctttcgggcccgccactttcccgctttggaaggnttccgacccatattgtctttcttctcgcggatatcttncctatcttctcctttaaaagagagcgccctatagaggttgcacgaggcacgttgggcttggcattacgagggcctacgtgcgcgttggcttgtaatggcacttaaggtcggaaaagccggaggtttgttacgcgcccctttcggagtaccccgcctctacgttaagaaacctatttgcgcccggaatgctgcaatcctttctatcccgcgtgtagattaagcgacgagtgctttataagcgggcgacgacgatcgtgagacacgcgttaggttcatacagcttcgttatccccctgaacatttacgcccgagggcttcagttaagcagcaacggagggcntattgtggtgcgcagagtacggaannttttttcgccccgcaagtgcagccttacaagatactcccagttggttatatttggtatccgatccgccctttcgcccccga

SEQ ID NO: 595120 - DNA, 104 bp, Homo sapiens
ctagaggatccgttgaaaattagcgacggggagcagcacctgcactggaagaggttgaacagaagctggcatgctggccctgactctgactcctcccactagga

SEQ ID NO: 595121 - DNA, 1132 bp, Homo sapiens
ggctgctgtgcctgatgcctcccgtgccgtgcctggctggcctgcggggaacagtgcgtggctgctcggggtggctgctcgcgggtgtgcggggggagttccggttccggttctttgtgcggctgcatcggcggctccgggaagatggctggccgggcgggtttccagtctgtgtgctccaatgctggctgtgctgccggagcctcaggaggggcgggcgcggctgctgccttgggcccgggcggaactccggtggcctcctgtgcgaatgggcccggctccgggtcaaggggctgtaccgctccctcgatgcccggagcgtgctatcctgagaccaggtatgttgccagtgcagccgaatgacacctcgagggagcttccatgggaccccctggctatggggggaacccttcagtccgacctgggctgtgccagtcagggatggatcagtcccgcaaagagacctggccctcagcgagattccagcaggtccagcagcatagcggtccaaaatcgaaaccacaattgcacagaagcacagaagatggcttgacaaaattcttacctcaaaaggattcgtgaacttggtaccagaatcacaggcctatactggactctcttggcttttgacaaggaaactggaccagactatcatgaggaaacggctagatatccatgagggcttgaaacgtccccattaaggcaaaagaaggaagctggaagttattcagtactaacactttcaatcccggtaaggtcgatgctgaagattgggacaaggacacagtgagtccctgggacgcatcgggacacaagagcgtccttgaggattacgctgtgtcaaatatgtgtgcgaagaacaaggagggagtcctagttcagattaaagagtacagtagcgaaagaaccggtggcacgcgacatcgtatttgacaaacaaacactatgtggcaaaacggcaaagagccgcgaatacagaagaacagcaactagtaagaagggggagacagaaaaaacgaagcaagacaaagtagaggttagcgcgcagtatagttaacgaacacaaacatagtggagtcaagtacgaactagcacgacaattaaacaagaacatacgaagtatataggtagt

SEQ ID NO: 595122 - DNA, 959 bp, Homo sapiens
  misc_feature (96)..(96): n is a, c, g, or t
  misc_feature (98)..(98): n is a, c, g, or t
  misc_feature (170)..(170): n is a, c, g, or t
  misc_feature (175)..(175): n is a, c, g, or t
  misc_feature (199)..(199): n is a, c, g, or t
  misc_feature (201)..(201): n is a, c, g, or t
  misc_feature (204)..(204): n is a, c, g, or t
  misc_feature (208)..(208): n is a, c, g, or t
  misc_feature (215)..(215): n is a, c, g, or t
  misc_feature (217)..(217): n is a, c, g, or t
  misc_feature (226)..(226): n is a, c, g, or t
  misc_feature (241)..(241): n is a, c, g, or t
  misc_feature (246)..(246): n is a, c, g, or t
  misc_feature (257)..(257): n is a, c, g, or t
  misc_feature (288)..(288): n is a, c, g, or t
  misc_feature (290)..(291): n is a, c, g, or t
  misc_feature (293)..(293): n is a, c, g, or t
  misc_feature (296)..(296): n is a, c, g, or t
  misc_feature (298)..(298): n is a, c, g, or t
  misc_feature (300)..(300): n is a, c, g, or t
  misc_feature (303)..(305): n is a, c, g, or t
  misc_feature (307)..(307): n is a, c, g, or t
  misc_feature (319)..(319): n is a, c, g, or t
  misc_feature (323)..(323): n is a, c, g, or t
  misc_feature (381)..(381): n is a, c, g, or t
  misc_feature (950)..(950): n is a, c, g, or t
attggagttcccgagaagcatggctgagggaagcttcagcgtgcaatcggaaagctacagtgttgaagacatggatgagggtagcgacgaagtcgngngaggaagagatggttgaaggcaacgactatgaagaattcggtgcgtttggtggctatggcaccctcaccatnctttnacatccatatcctcagagccttcngnatnttgntgtccantnccttcgctntcttatcgaattatnccctntggaacttggnaaacccttgttcttgcccataccctttgttnanncnttncntnttnnntncggaaacacttnccantgatgacggctcgcccttttcttccaacgtagcccgcgccgcctgcctccaatccgtncggctcgggtccgctgccgccgctgtcccgtactcgtccttcagtcatggtggtcgctagctcaccggtgtggccacgccgcatgtctcatgtgagaggatacccagcccacgacctacgccgccgaggctcaggggcccacccctgagccaccccttgcttctccgcagacctcccagatgttagtcaccagtaagatggctgcccccgaggctccggctaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggcccagtgctgcctctggtgtgcccagacgggacctggcagggaggtggcagcacccggccaagaccacaagtcggggaagcgctggcaaaatcggtgggtgagctcaaatnttgtgcaca

SEQ ID NO: 595123 - DNA, 1026 bp, Homo sapiens
taactagcgtagtcttcttctagagcctctctagtgaccatccgtcgctagtgatgtgatttcacgttccgactccatacatgcaatctcgtcactacatagagcctatctaggcaacataataggcatataccaatgattgagcgagtatagcaagaaacaaacggcacataccagggacccagcaacatatcagctgtttccgaaaatgggcattcagtactaatcgagtgattgaatacacttagtttcattgaccttcaagaacgatttttatgtctattgccagcgaattgttgtcttcgaaggccttttcacctacctcacaagtctgtagacgctcgcatagtcgcgctcccatattctgcagggagtgagcttgaggtcctgcaacctacgtgcaagtgccatcccctcggcgtatagatcccccttagaagcttctgaggtctttaacaacatgcgatacttacatccgcagtcaaaaggaggtttgcagaatacaacctagaggatctagtcgcgtagagtcctgaaagtaccaataatcaatcctgaaaacacagagtaagttcagtgctactgggattattctgaacaatattaaaccctgtgcgtctctattggtaacaccctctgtagcatatggttcaaagaatgtaccttggacgtgtacctcgttacagccaatttttacagactgggatcctaacggcgtccaagcatttccggccgctagcccaacaggcaattcccatagttgacttttcaactgctcagtgagttggcgacaaacgtttgcgcatcaacggtaatcttgcttccaatgccggccaacatcgtaatatgtgcagcaattcaacacgtccatatataggatcaactttgtgggttttcctaaaacccaggcggccaatgagtacttgccattatgggatcacccttttgtttcgacctaatatcgtgaatgtttcccactcgccttggatgagggggcttccaaccgaaggcaaacacctttaaacc

SEQ ID NO: 595124 - DNA, 111 bp, Homo sapiens
gagaatagtgttaatgtcattaaggagagaaggaagagaagtaagccgagggcgtctttgattgtgtagtggccccaggttgtgctggttgtgctgggtccggttgtgctg

SEQ ID NO: 595125 - DNA, 510 bp, Homo sapiens
acaaggacacctctttatggctgtaaaaaaaggggggtaacaagttcccgggacagtggagaagggacactatccctaaatccagagggaaaccagaaaaatttatagttatcaaacagaaggaaaggcgggggcagaaacagaagcgtgggcctataagaatcagaaaaattttcttccgtgctcataacccaagcccagaagtttcttggccccaagtttcaacgtgccaagaaataccaccctttcacccgcgacatccttccataagcataccaaaaatttcaacaagcgggtgcgagggtgcaaaatttcagggggggaagggggtgcagggaacgcaggggcgtggtgcccaagcccaggtgcccatcgtgctatacaccctgtgagaggataaccacagtgtgcctttcaccacttctgtgacacagctgtgaataccttccagggggaaggggccgggaacacagtgctcaggcgtgcgggcagccagcccacctcgtgact

SEQ ID NO: 595126 - DNA, 166 bp, Homo sapiens
agaaagggctgaggggtgctgctgaaatacataatcactgaagtggccccagataacatggctttggtatggcgggattacctaagagtaggagtaggcgatggggagggaattaggacagctagtgatatcatgactgtaaatgaaaggaagctgggaagtcctg

SEQ ID NO: 595127 - DNA, 759 bp, Homo sapiens
  misc_feature (242)..(242): n is a, c, g, or t
  misc_feature (271)..(272): n is a, c, g, or t
  misc_feature (280)..(280): n is a, c, g, or t
  misc_feature (307)..(307): n is a, c, g, or t
  misc_feature (317)..(317): n is a, c, g, or t
  misc_feature (392)..(392): n is a, c, g, or t
  misc_feature (430)..(430): n is a, c, g, or t
  misc_feature (434)..(435): n is a, c, g, or t
  misc_feature (468)..(468): n is a, c, g, or t
  misc_feature (476)..(476): n is a, c, g, or t
  misc_feature (485)..(485): n is a, c, g, or t
  misc_feature (509)..(509): n is a, c, g, or t
  misc_feature (519)..(519): n is a, c, g, or t
  misc_feature (594)..(594): n is a, c, g, or t
  misc_feature (596)..(596): n is a, c, g, or t
  misc_feature (623)..(624): n is a, c, g, or t
  misc_feature (627)..(627): n is a, c, g, or t
  misc_feature (648)..(648): n is a, c, g, or t
  misc_feature (660)..(660): n is a, c, g, or t
  misc_feature (666)..(666): n is a, c, g, or t
  misc_feature (671)..(672): n is a, c, g, or t
  misc_feature (684)..(684): n is a, c, g, or t
  misc_feature (687)..(688): n is a, c, g, or t
  misc_feature (702)..(702): n is a, c, g, or t
  misc_feature (704)..(704): n is a, c, g, or t
tgctaaggggctgttgaatacttggtgcagtgaagcgtttacccttggtttatgtgattatcatggcattcccgaaagaagaatgtatttatgtatggttgcagatcaaagagacagtgtggcataccaatgataatgcaacttcatgtgatgtgtggaggatacgggatacaggacatgcctaagatatgagccatatcgccccagcatttgcatgagcagtgtagcttcgtagtgaaaantctaaagaatccacagcagtgtggtagtnngagggaantaggagtacaaagaagttataccatgnagagtacttnatgtggctgtgatcagggaaaatacaagggtttacagatggtacccgagaactgaagagatgggagcaaaatttngtgtgggctttaacgtttgaaaagactgacctctccanttgnngtataatctgcttccagctgttgactttgaaantgatttanttgaatcangctgcaaagtaatagccctaccanttatgtctgngggatgaagatgaacctcgattccttgaagaagttgattaccagtgcagaaagtaatgatgagtagatatgagtngntgaaaatgtaggagattatgaaccttnntgntcagaagagacttctgatcgnattatcaagatnctactngagcnntgcactctgtanggnngataatgaatttgntnattccgaagttggacacggtcaacggcggcaaaacaagactggcggtggtcaaaa

SEQ ID NO: 595128 - DNA, 789 bp, Homo sapiens
ggcctccaaagtttagattaaaggaatacctttggggtgggcgtggccttttcttttttcccaaagtggtttaatatctggaatccagtgaagaaatttgggggtggtttctctctcttcaaaaggacccctcagggtctaactccaaagaaaatagagaaaaatgcctaaagcccttcgagaagggggagaaaagagaaccaaaaagggcagagggttctaaagctctaataaggaagaaagagggtttcaaaataggggccaagggtgctattagaccccaatgtcttggtgtccaacaatccttcctggcttctttgcttcctcccttttctttcattttgagacatgtattgggtgcctattgtataccaggtattgtgctaagggctttcatattctttatttatccttaatgaaacagtagtgtgaataaaggtgtgtagcaagaagaacttcccatgggatttgtgagaaaaagacagaatgactctaggtctgagcgtggtggctcacacctataattctagcactttggggaggctggggcaggaggatcacttgatcctaggagttcgagaccagcctgggcaacatagcaagacgctgtctctacaaaaaaaatttaaaaattaggtgagcatcatgatgcatgcctgtggtcccagctatttgaagggctaaggtggaaggatcacttgagcccgggaggtcaaggctgcggtgagccatgatcatgccaatgtactccagtccaggcaacagagtgagaccctgtctccaaaaaaa

SEQ ID NO: 595129 - DNA, 239 bp, Homo sapiens
  misc_feature (177)..(177): n is a, c, g, or t
actctagatggatccctcgaagaggaaggtggccacgttcagccctaactgaaacggtaaccagccctaggaagcccgaaggagcctcagtggtggcgtccgatgcgctgagagttgagggtgccccgcttcacctgcagaggggccgttcctgtgctcgaacccggcaccttccgnaaaatggcggctagcagagccagcgctaggcgggagtctccgcaggatcctctgtcctgtac

SEQ ID NO: 595130 - DNA, 772 bp, Homo sapiens
  misc_feature (44)..(44): n is a, c, g, or t
  misc_feature (61)..(61): n is a, c, g, or t
  misc_feature (70)..(70): n is a, c, g, or t
  misc_feature (78)..(78): n is a, c, g, or t
  misc_feature (88)..(88): n is a, c, g, or t
  misc_feature (93)..(93): n is a, c, g, or t
  misc_feature (95)..(95): n is a, c, g, or t
  misc_feature (111)..(111): n is a, c, g, or t
  misc_feature (122)..(122): n is a, c, g, or t
  misc_feature (126)..(126): n is a, c, g, or t
  misc_feature (160)..(160): n is a, c, g, or t
  misc_feature (168)..(168): n is a, c, g, or t
  misc_feature (172)..(172): n is a, c, g, or t
  misc_feature (177)..(177): n is a, c, g, or t
  misc_feature (186)..(186): n is a, c, g, or t
  misc_feature (193)..(193): n is a, c, g, or t
  misc_feature (204)..(204): n is a, c, g, or t
  misc_feature (233)..(233): n is a, c, g, or t
  misc_feature (242)..(242): n is a, c, g, or t
  misc_feature (304)..(304): n is a, c, g, or t
  misc_feature (364)..(364): n is a, c, g, or t
  misc_feature (441)..(441): n is a, c, g, or t
  misc_feature (443)..(443): n is a, c, g, or t
  misc_feature (453)..(453): n is a, c, g, or t
  misc_feature (542)..(542): n is a, c, g, or t
  misc_feature (600)..(600): n is a, c, g, or t
  misc_feature (675)..(675): n is a, c, g, or t
  misc_feature (702)..(702): n is a, c, g, or t
  misc_feature (767)..(767): n is a, c, g, or t
accagttcttcactcttcttggctggctcaggtaagctgttggnggccgtggagggctganaaataagcngcccaggntggctaagtngagangnattcatgctatccggncttccactganaggnccacggaccttgctctaggggaaaaaataaaaanaaattagnagcnaagtnatgaatcanattttgnattcacgccanagtattttcttaggagaaaactggctggntgcaaaaanacaaaactaaccctacagcctaccagttggaacccccacctgcgggtcaactggtgcttcanatctggcttcaaaagtgtttctgtatcaacggagactttagaggaaaggattctaaattnaaagagacctgggtgcctacattaatttgcaggcttttttattttcatcagctttactgattgattatgattgaaantnttgctctgangcctggactgaagtgcgatgtgcgatcttggctcactgcaacctccacctccggggtttaagcgattctcctgcctcagcttcccaagnagctgggattacaggtgtgtgccactacacccagctaatttttgtatttttagtaganacggtgtttcaccatattggccaggctggtctcgaactcctgacctcaggtgatctgcctcagcctcccaaagtnctgggattcatgatccactgcatccanccccttaatgaacttttacaagaaaagaacaggaaagtattcttactgttttccaggtagaaganagaca

SEQ ID NO: 595131 - DNA, 882 bp, Homo sapiens
agcggggtgattaagcttgctgctgcgtgacagcggagggctatgaaaatggcgcagtggggcccggagctgtcacccctgactcgactgcagcttccgattctcctggtgacgtgcgcctacaggaaccaccccagtggtcagctgccgcgctgttgctagtgcaacatgcgtgcgagctcagatcagcgtggcggtggagggagaacgtggagttttggaaggttcagtggtgctacagtggtgcacagtgcccactgactgcatgctgggactgagaccatgtactcgcgatcctggagccgctatctggggcagtggcagccctacggctatcgtcattcgagtgccatagcacagtggaggacttggctgatgaataagtttgctcgctcaacgaacgcgtgtgccactaagtgcgcgtgtggagatgacgtgccttcccgtagaccagtgccctgtccggggagacttaagtgctctgtcaggacactggagggacaactcaggtattgtggtacacactgacagtgcttgtgttccctaacacggatggagagctttgtggctgtgcctttgcacgttcattgctgtacggcatcttggccggagggttggtgctgcccattgccccagactggcccacgtaagccccgaggtcacagtgtctacagagcataccttggcagcactgcctgactcaacgcggtgtccgcctttcttgcacagtgccaagcaacgattttggtacattcgaggagccttgagaaccttgccaagccttgactctatctagcagccttcaagcgccagactcgaagattagctggacttgtggacctggggtccgagtcattgacacccagaacggcagcgcgacca

SEQ ID NO: 595132 - DNA, 586 bp, Homo sapiens
acatagtgatacgggtacggtacacttccgtgaagaacatgctagaccggattgttcgttgactggggtgctatacgtctgaccatagtgagtaactttgctaacgaatcaacactgctgagcgcaaggatgtcgtcactatactccctacgtaagggtactctgctaaagactatcgtgattatgtcagctgcattcatgaatgacattcgaattcagagaagattaccagtccagtagcgttatcatcttatacaagactgcaagaaggaagagaaggaggacgggccggaagcagaacaatatactgcttcgcatggaggctcttcaggcctaggcgtccacgcgcagactttatctgagagtagatctcgtggaccacctatagggtagaagtgcgtgatagctaaggggagcgtacggggagctgctgtccaaccatatcgaggtcgacctcgaggcctcaccaggtctggggcatgggggtatctatgagaatcgccttcgggcgcgtacctgtcttgtagattgtgcacctgtagtgcgtgtatttatccttccaagtagacatctaggggccctcgaa

SEQ ID NO: 595133 - DNA, 232 bp, Homo sapiens
  misc_feature (22)..(22): n is a, c, g, or t
  misc_feature (45)..(45): n is a, c, g, or t
  misc_feature (187)..(187): n is a, c, g, or t
  misc_feature (231)..(231): n is a, c, g, or t
ctcctaacctcagcctcccaantagctgggattacaggcacctgncaccatgcccggctaatttttgtaattttagtagagacagggtttcaccatgttgcccaggctggtttcgaactcctgacctcaggtgatccacccgcctcggcctcccaaagtgctgggattacaggcttgagccccgcgnccagccatcaaaatgctttttatttctgcatatgttgaatactnt

SEQ ID NO: 595134 - DNA, 108 bp, Homo sapiens
aaccatgtcgtgactggcacacccctgccggttcatcagggacaaacggcattgccgccgcctgaggcgccgccgtataaatcaaaccaaggggaattccattatgtt

SEQ ID NO: 595135 - DNA, 217 bp, Homo sapiens
attcacagcccctaacagaaaatagctccactaagtccaaactctacacactaggcttagagctgcaatcaccacatctgtacgcagcagtctgcgcccttacacaaaatgagctcaaaaacgactcgtagccttctccagttcaagtcacctaggactcataatagttacaatcggcaatcaagcaaccacacctagcatgcctgcacatctgtcc

SEQ ID NO: 595136 - DNA, 721 bp, Homo sapiens
  misc_feature (103)..(103): n is a, c, g, or t
ataccatgaagaggagctcagacagctcttaccacatgatacaagagccggctggtggaagagtggggaccagaaagagaatttgctgaagaggagaaggaanaaaaaaaacaccaaaaaaaaaattaaaaaattccacacacacaaaaaaacctgcgcgtgaggggggaggaaaagcagggccttttaaaaagggcaatcacaacaactttcggctgccaggatgccctttgcttggggctgagaggatttctgtgggcaagtggctgggatcatagtgagagagttcccccaccccaaggatcccgaaggggcgccaagcgcggggccccgaatggtccgctccgtgtgcgctggccgccctcccaaaggattgtacccaactctcagccagagatggtggaggccgtcaagaagcacatttttaaaccattgctgcccttgaacgaagagacccgattgtcacccagccggtacccaaggacggcgcttctgaacgcgatcagaaagcttcccgtgggccaaagctcggggacgcaccgggctcctgctggagcacagcaggctgccctggcccggagggcccgcctcttgccctgccctcctgccgcgcccctcggccactcctcacgtcgccgcctcgtgccgcccgacgaccctgcctcccagattccaggcagccgtgcccgcccgccgcccgtgcagctgccccctaagcccg

SEQ ID NO: 595137 - DNA, 214 bp, Homo sapiens
  misc_feature (90)..(90): n is a, c, g, or t
  misc_feature (107)..(107): n is a, c, g, or t
  misc_feature (176)..(176): n is a, c, g, or t
  misc_feature (189)..(189): n is a, c, g, or t
gaaaatacaaggattagccaggcgtggtggcatgcacctgtggtcccagctactcggaggcctgaaacgggagaatcgcttgggcccggnaggcggaggttgcagtnagcagagatggtatcacttcactccagtatgggcgacacagcgagactccatttaaaaaaaaagtaaantaaaattgaatgnaaaagatgcaaagactggaaagatt

SEQ ID NO: 595138 - DNA, 141 bp, Homo sapiens
aggtcgactctagcagagatcttactgacaaccacagcagcaacacggatagtaatgatagccattgctagcatctatggcaaagcttgctcagtgctaaattaattatgttacatcctactcaacaaccctaagaggtct

SEQ ID NO: 595139 - DNA, 209 bp, Homo sapiens
actttaaaggatccccaatcgtcaggctctagggctcagataaaggcccattgaaatggtcaacgtccatccgtgatcagccccatcgcctcggcccgcgtggccgggttgcgcataatcccgcgcaccgcggaggtcaccgtccggtcccccggcttgcggacccctctcatttccatgcacatgtgctcggcctcaacgaccacgat

SEQ ID NO: 595140 - DNA, 180 bp, Homo sapiens
accaccacaaaacaaatacttcccacgtctcaggagccaccccagtgtggtcgggggacctccagtgttaacagctggctgcaggggccacagcccatctgtagacacagacccctgctcctgagacaccagccccaggagagcctccgtctccagctgtggggggtgggtggagagcgg

SEQ ID NO: 595141 - DNA, 489 bp, Homo sapiens
  misc_feature (24)..(24): n is a, c, g, or t
  misc_feature (127)..(127): n is a, c, g, or t
  misc_feature (172)..(172): n is a, c, g, or t
  misc_feature (278)..(278): n is a, c, g, or t
  misc_feature (310)..(310): n is a, c, g, or t
  misc_feature (320)..(321): n is a, c, g, or t
  misc_feature (327)..(327): n is a, c, g, or t
  misc_feature (337)..(337): n is a, c, g, or t
  misc_feature (355)..(355): n is a, c, g, or t
  misc_feature (374)..(374): n is a, c, g, or t
  misc_feature (382)..(382): n is a, c, g, or t
  misc_feature (386)..(386): n is a, c, g, or t
tgtggggagcgggttgatgtccancctcagaacttctggaactgcttcttggtgccggcagccttggtgaccttgagcacgttgaagcgcactgtcttgctcagaggccggcactcgcccactgtcncgatgtcaccgatctggacgtccctgacgccgggggacaggtgtncagacatgttcttgtggcgcttctcgaagcggttgtacttgcggatgtagtgcagataggtctcggcggatgacaatggtcctctgcatcttcatcttggtcaccncgccagatagggtccgccctcggatgggcccntttcccgtgnnggggcntttcttgtcnatgtaggtgccctcaatngcctccttgggtgtcttgnagccccgnccgntgtcttgttgtccgcgggacttctccttgcccgtttctccccgccggcccctcttcttgttttgtagtatggtcggctgcttttggttggcacgctctgtctg

SEQ ID NO: 595142 - DNA, 325 bp, Homo sapiens
  misc_feature (242)..(242): n is a, c, g, or t
gtctccgcagccaccagcaccaacgactccttcgagatacggccggcccccaagccagttatggagaccatccccttgggggacctccaggcccgggcgctggccagcctccgcgcaaactctcgaaattctttcatggtcatccccaagagcaaggcctccggggctcctcctcctgaggggaggcagtccgtggagctgccaaagggagacctgggcccggcctccccgagccaggactncggatcccagccgtgctgaggggaaatggggtgcgcctgcctcggggaagagccctgggggaggttcgagcacatggggcagt

SEQ ID NO: 595143 - DNA, 175 bp, Homo sapiens
agatgctgaagacctgtgagcactacaggaggaaacgcgagacgtggtgagactagactccaggcacacaggcgaagaggcaagagggtaggacacgaagccacaaagctacttgggttcctccttcttctcgtaaggctttttctgcttctgctgcatgatctccgagtccctc

SEQ ID NO: 595144 - DNA, 401 bp, Homo sapiens
atattgttactttaagtcacaggaatctgtgttgaaatgactgtccctttatctagttcccatcagaaagtatttactgagttctctttggtggcatattactctactagattaacagaataaaataatgaagaataatcaacatattttctcctctataggcattaacggtttaatagttaagatagttatgtaaattcatccacgtaattttcaggatcctatgtgtactcactcttcccacgatttgttatctacttccgttccttccgctatcctggccaagctcccttcacacactttcacctttttgtcccacaaattcacaaatagcgtacattagttatgtgcagtttttttgtgtataaataagacctcattgaagctgggaacaatattaa

SEQ ID NO: 595145 - DNA, 125 bp, Homo sapiens
gttcatgtgaggggatggcggtgctggaagaggaagatctaggtggatggaaagtgaatatgtttccaaggatatccaatgtctcccacaagaaggttgttcttccactcgtgcagcgccgtcag

SEQ ID NO: 595146 - DNA, 406 bp, Homo sapiens
actggatatcagagcccagatgctccaggtctctagagaccacacgttggaatcactcagaatactgcctgaccaggcgggctctgtggtactgtctggggagtcaaaaaagccttcagtgcctggccgctgtggttcacacctttactcccagcacttggggaggccgaggatgggcggatatgtggtcaagagatagagaccactccgggccaatatggtgacacccccatctcgacctaaaagtacaaaaattagggccgggcgcggtggctcacgcctgtaatcccagcacttggggaggccgcggcgggcggatcacgaggtcaggagatcgagaccatcctggctaacacagtgaacccccgtctctactaaaaactacaaaaaaattagccgggcgtgg

SEQ ID NO: 595147 - DNA, 101 bp, Homo sapiens
aaacatctccgccttactcatttacgccaaccacccaactatctataaacctagccatggcccatccccttatgagcgggcgcagtgattataaggctttc

SEQ ID NO: 595148 - DNA, 444 bp, Homo sapiens
cagccatctgtgacacagaaaccctgggggaaaatctccataacagaacgtatagagcgaggcatcgatagacagcatcacgggtcagaggctactggaggctcaggcctgcacaggtggcatcatcaacccaaccacgggacagaagctgtaactttaggacgcagtatcacagggtgtgattgaacaagacatagccaccaggttagaagcctgctcagaaagccttcataggcttcgagggtgtagaaggggaagaagaagatgtcagcagcagaggcagtgaaagaaaaatggctcccgtatgaggctggccagcgcatcctggagttccagtacctcacgggaagtctagtagaaccggaagtgcatgggaggataagcaccgaagaagccattcggaaggggtaaatagatggccgtgccgcacagaggctggaagac

SEQ ID NO: 595149 - DNA, 381 bp, Homo sapiens
gcatgaaaagcaagcgggggccgcatggtgagatggctgaatggctacgcgtgtaacgagccattacccacctcaacaacaacttacatgtgtgggcagcagctgaatgtctgtgtctccaagcagccagccatcatgcctggtcagtcatacgggttggcagacgggtcttgcagttaccaagacttcagtgaatcccggaacaatcggttctccaccccagagcaggcagacaagaaccgcatacagaaccccagcaacgtgctgcacttacttcaacgccccgctgggggtgaccgaggacgaacttctttgagatctgcgatagagctgggagtgaagcggccatcttctgtgaaagtattctacaggctacaagtg

SEQ ID NO: 595150 - DNA, 436 bp, Homo sapiens
actccttgtaaagactgtagaagaaagcgcaacaatccatctctcaagtagtgtatcacagtagtagcttccaggtttccttaagggacaacatccttaagtcaaaagagagaagaggcaccactaaaagatcgcagtttgcctggtgcagtggctcacacctgtaatcccaacattttgggaacccaaggtgggtagatcacgagatcaagagatcaagaccatagtgaccaacattagtgaaaccccccatctcttactgaaaggtgcaaaaaattaagctggggtgtgttggcaacatgcctgtagtccccaggtaactgagaagggtgaggcaggaaaattgtttgaacccgggaggcaaagggtgcagtgtggttaagatcatgccaccacaatcccgcctgggggccaaagcgggattgggttaaaaaaa

SEQ ID NO: 595151 - DNA, 140 bp, Homo sapiens
ttcaccggcctgatcctgtcggtggcgccgatcgacatccaggtgcatgacacctattacgtggtggcccacttccactacgtgctggtggccggctcgctgttcgcgctgttcgccggcacctactactggctgcccaa

SEQ ID NO: 595152 - DNA, 317 bp, Homo sapiens
aaacgtcgtcatgtgtcatggcatctgtacatgtacatattggcagaacaaagcctgcactgaaatacagcaaaatttcagaggggttacttctgggtggtgggatactggttggtgatttttcatttcttcttaagttttactgtactcttcaaaatgtctaaaatacttctgagctctttttccaagcagagcaacagtaataaatatcattttgtaaaaaggctgagtgcattggcaggagactggacttcttatcctggtttgactaccacttgctattagaccacaggcttgtcaccttagatgtcgagagt

SEQ ID NO: 595153 - DNA, 262 bp, Homo sapiens
tggttggacactagtttggaatagaacgatagctattggggaggggaatcatatcggaatttaacatcataaacctacacatattgtagatgaataaaagattaattataaatacaaaaccataaaggtggaagaaaatatgaacattgagaggactttctaaagattaaagataggaagataccacaaaacaaactcaatatatttgactgcataaaattaagaacctctgtgctgtaaaacataaaatgccaaaagaaaa

SEQ ID NO: 595154 - DNA, 810 bp, Homo sapiens
ctgaggattagggagacacagatggagagaaacaaagaccttagaagctgaagggtgaatgctgggagtggatgcccagggagagagagtcctcagtgaaaaggccccagaggacctgaaggagaagaaggagaagtgtgtgatgtgagaatgtgcaatgcctggaaagagcgaaagaaagaatgtgtgtgtgatgtgctccatgtcccatttggtggtgatggtggggcaaggcatgcagccagcctgaggctactccctctcctggtccccacaggatggatgtgagaactggggctgatggagtgaagaagaagaaacttgcctgatgtgatggagagtgagtgaatgattgaatgggtggaagaagaagatgagtgaagaagaagaagagtgatgatgaatgggcccgcgctgaatgagatgctgcctgaaggagtgagtgatgaagcggatcccaaaccggagaaagacagaaaatggggcatcagtgcagttgaagaccccatgccaaagcataggcttggagagttgaggagggcctctactgaggcctgggagagttgagggtgttgggggagcagcaaaaggtccaagacaagtccattcaaccttgggttcccctgcgtcttggagaccctgacagcaaaaagattggcaacacactatattaacgtccccaagcacatctaaatttccagacatctacaggacagaatgggcacataccagcgttcaagtatgacagttagtccgactccagagcttgtcacgatataagtcttcaatggacccaatagtcgagataga

SEQ ID NO: 595155 - DNA, 216 bp, Homo sapiens
  misc_feature (113)..(113): n is a, c, g, or t
cccgaccgcctcgagggctgaatgacgcggggggccgtatacatgtaacctcacaattctgtaaaacacgatttcttgaaggtaaagtcatggggttttgcacgcattcccgntatatgctgtgtccccccctacaaggagcacttacgtcatagtgccagtcttccgtcctgtctaagcaccgcgcagtaacagacaacctcgcccgctggcgcc

SEQ ID NO: 595156 - DNA, 176 bp, Homo sapiens
aaaagggggtggccccttggggggggggggggacccccccccccccgttgccgccctttttaaagagcccctcccgggggttcccccttcccagggttcctttttttacccccccccctttggtttttttcccccggggtaattttcccccaaaaaaggggggggtttttttttta

SEQ ID NO: 595157 - DNA, 248 bp, Homo sapiens
cctttttaaggcagttccgttaagggtttttgtttttaaacttttttttgccatccatcctgggcaaaatgcggtgtaaaatatttgttttaaaattcaaggccccaaaaacaatgtttgggggaaaaaaaagaaaaaatcatgccagctaatcatgtcaagttccctgcctgtcagattgttgaaaaaacccttttgtaaataactttttttgagaaggaaataaaatcagggggaattgaccccta

SEQ ID NO: 595158 - DNA, 444 bp, Homo sapiens
gcgtcgattgtgcatagaatattatactgatattaacagtcacgtcctcttcaactttaatcagaattgctgaaagctactaaatatcaaatatgtctaaataaatccagttttattacttgcagacataaagaaactggaaataagccaagaagaagttgccccatgaaggccctcagcagtctggtttcaggaatggatcagaatgtgttctaggccgggcgcggtggctcacgcctgtaatcccagcactttgggaggcccaaggtgggcagatcacctgaggtcaggagttcgagaccagcctggccaacatggcaaaaccccgtctctactaaaaatacaaaaattagccaggcatggtggcgtgcgcctgtaatcccagctacttgggaggctgaggcaggagaatcttgaggaaggagaatctctaggaggcagtgg

SEQ ID NO: 595159 - DNA, 347 bp, Homo sapiens
atcaagacaaataagaagaccggaaaagcaatgataaatctaatacagcaaggacacaggacagcaaagggtggaggcaacagtgtcataagatgaccctccttcagctaaggcagccatggactggctggctggacaagaattccagggcaccttcattacagtgtccttggccactagaagacctgcattcatacacggcggtggacgtggaggtgggcggcgcggccgtggcggctatcgcggtcgtggcggctttcaagggacgacgtgacgaccccaaaagggggggatggggttggccctactccgtcctgcggaaatatgatcttggccgcaacggtcac

SEQ ID NO: 595160 - DNA, 396 bp, Homo sapiens
tgtacaccaatgcttgtagcaacatttattcataatagcccaaatgtccatcaacaggtgagtagataaacaaaatgtggtatatacatgcaatggaatattagccttaaaaaggaaggaaatcctggcacatgccaccacttggatgaagttgaaaacattatgctaagtgaaacaagtcagttacaaagggcaaatattgtataattccacttacatgagtacttagcgtagtcaaattcacagacacaaaaagtataacagtggtcccaggggctggtggaaggagagactggggacctattgtttaatgagtagagagttttaaggtgatggttgtagagcaatatgagtgtatttagagccactgagctatacacattaaaaacagaaaat

SEQ ID NO: 595161 - DNA, 798 bp, Homo sapiens
  misc_feature (135)..(135): n is a, c, g, or t
tctgttgggccccgtccgtattttcctcgggttcattcccccgccgcgtgggtggccccaggtcgtcgttcccggattgcgctgagtgtctgctgacgccctcgttgcccccccccgttcgctgcagggccctgngtttgcctcccacaaaccgcgggtaaacgtcccgtcggtccgcccccatagggccgctcactgtgctcgtccgtgcgccgctatctgaatccgcgatagtgtctcgccccagctttatgaagacaacggggtgtgttgttcttccgcccacagcggggcgatcccccaatctgcctgccactttgatgtcgtgagcaatatgcctctcccgcggggtgtctgccccccaagcatggatcattccacacgattcttctggccacatctggagcgaaacttcttctttagagaacaactagttcgtgaacccccacttgttctgctagacaatctttccactgctgtctatcgtccatctctgttgacaccattcaaattctgctcgtccccttcttataaattaccgcagttgatacattttccctcccccagtctgcaaaaaagtggtcacccgtgtctcgtccccagatgtcttgtcccagatgccctcttgtgtgtctttagagagttggaccccccccctctctctgggtgttacacatatggtttgggacgctcacataggacgtagatgtggcggtggtgccaaacaccagactgggtggggagaccccaataaacccagggcggatatcacccccagattttcatcaaacatgtacc

SEQ ID NO: 595162 - DNA, 125 bp, Homo sapiens
gggagttggaggctgcagtgagctatgatcgcaccactgcactccagcctgggttacagagcaagacgcccgcctcttaaaaataagtaaataaactggccgggcacggtagctcacgcctgtaa

SEQ ID NO: 595163 - DNA, 363 bp, Homo sapiens
gtcgagatacggaagaacacgatcgacagaaagttttcacaaaaggaatggcacaacacaacccaggacctaatcctcttatgagggtcaccaactggctaggaactctctggattacctccccacctctgtccttctatctgccctttacatattgaatcaggtctaaagaattagcactgccccttacaggggtagggatggggacaagctggagggggaatgtgagtcatcagaagctggctatgttttctaactggtagatggtcttcaaaccttttaagccacacaacccatcagtaaaaactgttagacaatgtacccctgaaatatatgtatttatttttaaattatttacatgta

SEQ ID NO: 595164 - DNA, 84 bp, Homo sapiens
gcctcggacaccgccatatattattgtgcgagaggttcgaagtccggtggtttcttgccatactatgactactggggccaggga

SEQ ID NO: 595165 - DNA, 237 bp, Homo sapiens
caggaggctaggaccccagtattgaggttgggtgcctgggaggaccccaccacctacagcccttcataccagctctgacgctagaagtccccttcctcctatttttggcaagccgtcccatgggtaaagggcaaatggggctaggtgctcttggcgggttccctggtcctcaactctaccacccatccgtctccccaagtggctggcagctagactaatgtacattccgtggatttc

SEQ ID NO: 595166 - DNA, 134 bp, Homo sapiens
tagccgtatatagactcaaaatctattctcaaaactaagcttttagtcatcgccatatgctttcagttacatcctgtttatctgaaatgttacttaaagtttagtttgtctctccgtacagataggctcctaga

SEQ ID NO: 595167 - DNA, 257 bp, Homo sapiens
  misc_feature (251)..(252): n is a, c, g, or t
gctccgggccttggaatccctacgcgtcccttttggtttagcacgatgagctcaatcggcactttggtatttccctttcagcctctacattctcttctgacggaagagtttttaaagtttaatattctattaaggcttttgaaaatagtagctatttgggattcagataacaaagattgggttgtcccttggggagaaaaattaggcctctaaactttattaaagaggggtccaacaaaagaccttttaanntttta

SEQ ID NO: 595168 - DNA, 128 bp, Homo sapiens
tgttgggattacaggcatgagccaccacacccagccaagagatacttcttgaatagttttattctgtaatctacttgaaatataagtgaactttttgtttatttggaatgcttttcttgggaatattt

SEQ ID NO: 595169 - DNA, 358 bp, Homo sapiens
acagagacatgaatacatgaacactcataccacttcatactcacagaatgacaccctgaatagccagggacacacatacgcaatccgtatccaccaatgaagatcactgcatgttgccccgatgctggcagaggagttgagacgcacactcatcgagttgctcctcacagataactcccagatatagcccagggggcactgacagtaatgcgtgttgccagacattgatgcagacacctgagtgctggcacaagtgtacaacaagcacacctctcctggaggctgctatgtcacaagagacatagggcacgtcacaataggcaccagcccatccagatggaggcacccgcgaagtaga

SEQ ID NO: 595170 - DNA, 470 bp, Homo sapiens
  misc_feature (96)..(96): n is a, c, g, or t
  misc_feature (147)..(147): n is a, c, g, or t
  misc_feature (154)..(154): n is a, c, g, or t
  misc_feature (161)..(161): n is a, c, g, or t
  misc_feature (177)..(177): n is a, c, g, or t
  misc_feature (184)..(184): n is a, c, g, or t
  misc_feature (191)..(191): n is a, c, g, or t
  misc_feature (256)..(256): n is a, c, g, or t
  misc_feature (276)..(276): n is a, c, g, or t
  misc_feature (278)..(279): n is a, c, g, or t
  misc_feature (311)..(311): n is a, c, g, or t
  misc_feature (314)..(314): n is a, c, g, or t
  misc_feature (320)..(320): n is a, c, g, or t
  misc_feature (323)..(323): n is a, c, g, or t
agcgggttcaagggggtacggaaaagccggggaggggactcggtccggggccggagaccgacggcaacagcggctcaggacccacgctgcccccancctcccgagcaggcgcccccatggccgacccgctgattccttcactcggcnatgctcncgctggnccctgcggctgctttnggacacngagcccncccagggggagtcagtactgagcagcttccgaagccgggaccccgaagagggtgggggcccaggnggcctggtcgtgggcggggngnnaggaggaagaggaggaggaagaagaagaggcnccntgtgtncgnctgggatgaggaggaggatggtggcgtgttaccggccacaagccgacaaggatcgacctcttgatcccttggtccctatgactccacccacgttccatcccgagcggcctccgaccatggcacgctggaaggccctggctcaacgac

SEQ ID NO: 595171 - DNA, 1554 bp, Homo sapiens
  misc_feature (1041)..(1041): n is a, c, g, or t
gttctggttgtgtgcttggttgtgtctcttggcaccctattgggtgctcttctctcttttttttgctcccgcccagcgtttgtgtggcccccctccttttgtgtgtggtatctcatctgctggtttcccagggtggtggcccccccccttttttggggggctcccctcttggcttgtttcttctcgacgctccttctgtgtgccactatgtttgtccctctgccgggaccacctttttccaccgtgttgttctacctgtggccctcttggttttccccccccttttccccgtggtgtttcgtgtgttgttgtttcacccggggggtgtcgtcgctcttacagattctccgttgggtgacctcgggttttgctccccccaggtgtctggagtcgcgtgttccccccacggtggttcccccgttctccagttggtgtgtcccccccgagaggtgggccctcttgtggacttttctctcttctggctgtgtcccccactggcgtggtgaattcacgcgggccctttttctttgccctatcccccacctaggggcccaagttttttggccccccttgttcgttttctttgggcaccagagagccccccccgacgcccctcttctggggcccacctatgtgggcccggctgtcgcacactctaggcgcggcttttgatagagccccccacaatagttgtgtggtggtgctcccccgtgaagtgggcgcacgcgcagcacccctctggtgtgatacgcccttgtgcgccccccccttgtctcagagagaggggtgtgtccctctcgcgcttgggagagccccccccaccctttgggctttgtctccacactctgggcgcacccccccccctcagaggtgttgtctttgtgcccttcgagcgcccccacacactctgagccgtgtttcttgtggcccacactcgagtctgagagagacctctgtgagagctcgtcgttgtgctctctttttctctctcacgcgcggcgagagaaatatataagagagtggtggagagacaccgcgcgnaaagagtgttgctctgtagctctctctctaaagatagtgttgtgctcgcgctctttgtggctctttttgcgcgctctgtctctcctcacaagagcgccccctcgtcccgcgtgtctcccacaggctgttcacgcagctctgctctgtggctctatgtgaaagctctctcgtgtgaggaaagctcctcgcgggtgtttggagagcaccacacctcacctctcttctgtggcacaccacttcccgcactctctaactctctggccacacacatcacggcccacacgtccacaccccacgccctcaccacattgccacgcagtgtttgtgcacaaaagggcttaatatttgagcccttttgaactggctggagagccctttcaaagcccctgggagatgttccccccggcaccctgggtcccctgagcccgctccccctttccctacaggggtaggcctttcacctggtttatgaagctcgagtttcccttataaaaatgttatagaatccccaaa

SEQ ID NO: 595172 - DNA, 338 bp, Homo sapiens
tctccgacaatttgaagcttcaccaatacccttcactctaaaatagagggcctgacattccaagttttatataagcagacaggatatgacaggttggctcctccacaggaagagccttgttggctggcaaggcaagccgaggaactcctgttgccaaaataatcagtcaataaaaaatatctagcaatgacaagagatgaaattaggtttttaaagtccttgtttgttgtcataatcaggctcaagaatttaaagaaaaacatgaacataggaaggaaatgaaagaaagatacggtaactatagacctcaatgtaaattttagttaaaatgtcgacgc

SEQ ID NO: 595173 - DNA, 973 bp, Homo sapiens
  misc_feature (627)..(627): n is a, c, g, or t
atcccctagccgcccattctatgtgagccccatttcgccccacatatatattcttccggccaacacccggtttccactctgcctgtgcccatccccctatggtcaaacgctcttccctctatgcacgttctccgtgtcttattccctcctatggcatttcctatggcttcgtccacataccttaagagcgctttccgtacaatacccacagaacagaactcagttaaaacagctttggactatctccggccagtgtaatacccctctggtggttactcctccccccagatgatcttgttgactgattgcgaccaccctccatcctcgatgcacgtccttattactaaaccgccgcgcgtgtctctactacggggatgctcctccagctcgacgcgtaccaagcatactggggccccccacatggtgcgccgtgaacatctagtgggatacatccgcggttatacggggcgcgcgtaagaaaatgtttgtcaagactctacgcaacacgaccgttgcccgccgctcgtattctgctttagatcccacggcagacacacttggacagtctcctctgtgcactttgcaccgcactccaggggtaggtcatcccgcggttcgtgcgccccnctattgttagaagaaatagtcatcactgtcacccaagagggtgctgttgaaggtactgagggatgtctccccccccactagggtgtgtttcaacacgatagctctatctctccggggagctgtcttgcagcaggccccacttattcacgccgcagtcacacccgcccggggggttaatcacacgggcgccaatactgtgaaaaattatgcgagcacaaacaccacacaatgtttcaatgcccgcgctgtgctcaatgaatagttcccccgctcaatacttatgtataaaagggcgcccgcgttttcccattacccccccttcaccccctttgcgccccaacatgca

SEQ ID NO: 595174 - DNA, 909 bp, Homo sapiens
  misc_feature (896)..(896): n is a, c, g, or t
agcgggtcagcgaggagtgaggaggaggcgtggcatgtgggcctatggttgcttggcgagtgcagtccggcccggtactttatgatcagtaggatagcctgtgatcgctctcattcccttgaaccactcatgggttcagggctgctgctcgagagggacatgcgcgcgggaggaagtcacagtgcacgttgctctctgcttcgacattgacaacgctttttcaatgaacatgtccggtatgtcagagcactcgaaggccagggccgcaaccttgtgagtcacctaccacgctgtgacacaatgccgccagctggcggcgggaatgccggcgcggcagaagcaggtttaactcttagcttcgatttatctgtgagttagtgggcttgttcgctagatctcagcggtgactggacagcgtgcacatttattttcagaatgtggacccgaagaagcttgctgagacgcgtatggggttctcccctgtgcagggctagcccatgactgcaagaccacagggactctgcggggagactccttccggcacttattccccaagggattcttgaccgtggggaccatacctttgtgaacgcgatgtgccaactgtttcacatcatacacgttgtgcaccaaaaacgtgacagagcatggaagctttatggtacctcatgtgacgatgtagccatggttgtggtctcccaaagaaggaccgttctcgatttgtgacagaactcttgttgtgtacccagccgctcttgcttgacaagcactggtgtatccccgtggttgcaagcgttggctaaggggaattcacagctggagctttgacctcacattcaagagcgttcctttgaatccttcggtaacgacattctcgatgagagcccttcctcacncaagtgtgtaccc

SEQ ID NO: 595175 - DNA, 147 bp, Homo sapiens
atggcgtgagaccctaataactcagggagaatgcaaggaagagtctagatgcacatttgtaattttctctgagtcctccctaaaagctttgtttagttttgtttctgtttttggccaccctgcgagatatggagttcccgtcccagg

SEQ ID NO: 595176 - DNA, 424 bp, Homo sapiens
caggggcctaatgtagagtatgtggctggttgaaatacatggctgtgtgttctgctattgaccaaacctctatgtacagggctcaataatgaacatcatatgtaaccctggcaactcaaattataaacgcgtaataggaggacaaatataaagatgtctggtttgtgtttttataatgtacctgacattatacttgtgctttatgtttatacccatatgaggtgaaagtaatgtcatagatctgtctgtaaacaatgaaaagagcagaaaatgaaacatatgatgataatgtcactaaagagctagtgatggagggtacatggctgttagggtgtgtgagctcaccgttgccatgtcgatggatgcagtggcttcatccataatgaggagtcgacgcgaccgcgaatttagtagtagtaggcgg

SEQ ID NO: 595177 - DNA, 1052 bp, Homo sapiens
gcacgcctgtaatcccagctactcgggaggctgagtccggagaatcacttgagcctagaagttgccgtgagctatgatcatgccacactgtactccagcctggatgacagagtgaaaccctgcctctacaataaacacgacacacatacgacggcagactgtggtggctcacgcctgtcactcccagacactttggtaggccaaggcgggtggatcacctgcagatcaggagttcacaaccagcctgaccacgcatggtgacaccctgtctatactacaaataccaaaaacttacgccacgtgtggtggtacacgcctgtaagtcccacgctactcgggacggctgacgtcacggacgacatcacttgacacctgggacggcggaggtcgcacgcgagctgagcatcgtaccacgtgcacatccagacctgggatgacagagcaccaaccctcatctcaacacaaaccacccagcaaggcaccaacacatagacaaagccacaacaggaccacacccgaacggccatgcatcggcgcaaccacacatgcccgcgagcacgccgggataccccgggaataccacgttggcaccagagacgacgtgcacgaggcaccccgtgaccacactcgccactggcatggccatacgccaatggctgaggatggcggcacgaaccccagagaaagccggagcgcacagggccccaacaacggcagggcccacgacaccttggggacgcatcacgggacccaacaccagggaccccacggcccaagcgacaatccgcggacaaacccacggacggaccgggcgaacggagcactcgagccagagccatacacaaacaagggaaaccagtccagcgacaccgctgtgaggacgagcggacaccgaacaaccccgcgaaggggaacgaggccaccgtagagcgagaccggcctgggaccagaatcggccctgccgcgcacagacacggcacccgagagggtacaggggaagtcggaggggggacagaggagcgacgaccgagacaggcacggcgacaagccac

SEQ ID NO: 595178 - DNA, 1054 bp, Homo sapiens
tacacattgccagcatgtcccgttgagttttaattgcctcatgtggctgtggactttatgagtcaatcatttgtaggctccagatatatgcacgctagattttatttttttacaaagtgcatttacacgctttatggtagtcctgtatattatcaagaatccatggagggtttgggtcagtacagctggtgcaggatcctcacggcagaaacagtggagttatcacatttgagttaggtttgaaatggcaccccaggacttatgggccatgcctataacttgtatagcctacgttcagtgagcaaagacttagtgacgcagactctgtgtatgccacagtactataggctacagctctggacaaagagataacagcacaagaccagtggtttactgtgcctactcaacggagtgtgtacatatctatatagaccagatactggaaacctggaccctgagatgggagacacggagacagatgaaaggagtccgtgataacgtaaccaagagctgcctgcatggttatgcagtatcactgatataaggagacgccccacagagctaaagcaattagatagtaatcacgagacggacctttagtgacctccatatgacgttcatcttctagctctgcagatagcaacaacagctcttagcaatctgaacgtaagcttgagggcatccactcctctactgatacacactgtacattgcatttacccaaacattggcaaataagcgaagaacatatgaacacaagaatggacattgagatatctatccctgaaggaaacaaagtacggaagtacctgacacatgtattttgaacatacgtagacacatgcatagagcaaaattagggccctaggccacagagtgggcaacgagaaacaagacatgggcacaacaaggcgaaacacaaacagcaagcaatagaccgaaaggaagagccatagaccaggagaggcgaaaaaaagacagagaacacaaacacaaaaacagagaacaaagtgcaagcgagaaaccaacagaagagacgaaagagcacaacaag

SEQ ID NO: 595179 - DNA, 152 bp, Homo sapiens
gtgcacatcagcttaaaatctgtcatcccatgcagacaggaaaacaatattgtataacagaacacttcctgagtagaagagtttctttgtgaaaaggtccagatttagactaaactaatgttaccaaaagtattcaactgttgggatcttgt

SEQ ID NO: 595180 - DNA, 314 bp, Homo sapiens
tccggtgctgtgcgtgaacacaaatacagatatagtccctcgtaggacgtgaccaatgcaagtatatgacgctggactcgacaacacttcagcttatacttagaactcataggctcttgatttgcccccaaaaatatttttccttgtccttatttaaatgcccaactaccaacacaaaaagggaaaacatacacggctttaaatgtacatgtttcaagtcagtgtcttgttaacaaaaaaggtagcattttcttcactttggccattgttaaagatgcaggcatagagccggacctgttagactagcatgtatt

SEQ ID NO: 595181 - DNA, 343 bp, Homo sapiens
  misc_feature (150)..(150): n is a, c, g, or t
caaactcaaagatccacctgcccctgctgggtgctgggactaaaggcctgcaccacacgcctgactggtgaattgtcttctaattctaaatctggtactaagtgctctaagaaagctcaagaggctcactggtgttgtggtggcccaggncgtcagtagtgccgtgacctccagcaagcgtatggcctggcagtggagactgactaaccctaaggaactgtgtttcttactggcctggaactcactacatagaccagactggcctgaagaatcagagatctgcctgcatgtgcctccagaggtttcccctcgttgatgtgctcatagatcgcgtctgcgcccc

SEQ ID NO: 595182 - DNA, 386 bp, Homo sapiens
cccctccccccaccccacaacagtccccagagtgtgatgttccccttcctgtgtccatgtgttctcattgttcaattcccacctatgagtgagaacatgcggtgtcaaacaagactttttaaaaaattgtggtaaaatacacataacataaaatttactgtcttaaccattttttactgtacagttcagtagtgttaagtatattcacattattgtgtactatattttcagaacttttacatcttgcaaaactgaaactctgtacccattgaataattcctcactccctctccccaccagcccctggtaaccactattctacttcctgtttttgtgaggttgactacactgtatatctcatataagtaaagtcatatagaatttga

SEQ ID NO: 595183 - DNA, 104 bp, Homo sapiens
tgctgccaagtgttcaatgccctggacaactacaagcaccactaccacacactgcacagaaatgtttgctccttttgcaaccagaccttcccttccagacacct

SEQ ID NO: 595184 - DNA, 886 bp, Homo sapiens
gcctctagcctcccaaggtagctgggactacaggtgtgcaccagccacacccagttaattttgtatttttagtagagacagggtttcaccatgttggccaggcgggtcttgaactcctgacctcaagtgattcgcccaccttggtgtcctaaagtgctggaattacaggtgtgagtcactgcacctggccttgtcgagtctttaaaagatcattattttgaattgctttttctggtaaataggtaggatttccatatcatatctatgtgtaatcggtaaagttattcgtgatttccttatgcatagtgtggatcaacaattatcactgtgtcctgttaacactcgttttcatacttggtactcctggcattcgatgtcgtgtagcatcatggatgagatactaactggcgtacttcccatttatatctacgagtgctaacttctcatagtaggctttcacctgcacgtgtggtccttagtgtgctagttgagaagggtgtagtaattctgtttccagataatgtgaagatggtatagtctctcgttcagcgttgtatcaacagtatttaatgttgggagtaactttgtttaacctcagtggcctaggtatgtgaaagtttgtagcagtaatggataggttgtaatggcgaagggcttttttggagtcctcctattttcattgtgtcccacaatgaagttacttagcatgagataatgcttgtgtagtatgatatggctataggcggtacaagggtctgcgttcaagttgcagtgctaaaggcagtgggcgctggggggttaaagccaatgatgaactattggcctgggtttgagaataatgtgcaggtggaattgggggggttcagacatttatggttccctatga

SEQ ID NO: 595185 - DNA, 112 bp, Homo sapiens
gaaacggccatctacaatccaaggagagaggcctcagaacaagccaaccctgcagataccttgatctaggcatccagaattgtatgaaaatacatttttggtatttaagcta

SEQ ID NO: 595186 - DNA, 292 bp, Homo sapiens
tccttggcgtggagggctgagacttggctccctggtggcttgtccggggcctaaggcacaatgcgggctgcgctcagtatgctggcaggcaactcatcggcctgtgtgcggtgcaaggagggttccgaggcactccgctccatcttggcgagtgaccgttgcagcagctcaattgtcgcctggatctgggggaagaggggccgctcctcccgctgtaacttgaggctgtcagacagcaggcgccgcatgcccttggtgcagctgctggccattttgctgacgtccggggaca

SEQ ID NO: 595187 - DNA, 307 bp, Homo sapiens
  misc_feature (75)..(75): n is a, c, g, or t
  misc_feature (271)..(271): n is a, c, g, or t
  misc_feature (288)..(288): n is a, c, g, or t
  misc_feature (296)..(296): n is a, c, g, or t
gcccaaagctgcatgacactgatattatttcccccttaaatcagctcacattttaatgttaacatttttaaaagnaaatatgtcaataacttaattggaaaatcactaataagtagaaagtaacaaaataagataaataaaaacgttactaatttttagctaaatactcttgtctgctggaaacactaggcctgaacctttttatttggcccccccggcttttttttaatttttaaaaaggcagttagcaagtgttagttgaagacaagcnccaagctgagaatttgncctggctntaatcagaatt

SEQ ID NO: 595188 - DNA, 149 bp, Homo sapiens
tggtcattcagtgtgcctcctttataacactcactatattgatttattgactgtgcatcatttgaagatgaaaatttgttctgggtcactgggtagtttcaacattttgtgtcgacgcggccgcgaatttagtagtagtaggcggccgc

SEQ ID NO: 595189 - DNA, 954 bp, Homo sapiens
  misc_feature (310)..(310): n is a, c, g, or t
  misc_feature (421)..(421): n is a, c, g, or t
  misc_feature (502)..(502): n is a, c, g, or t
ggtgacaagtagggtttcatcgtgttgcaacggcagctctgtgtgcgttgacgtgcatctagcggtgtccgcttagtactgggttgccaatttgcagcctcgtcgtggaaagcagcaagtgtcacgacgtggccatcacacgaatgagggatggtgggtgcaagccaccaagactggaggaagtctgcgtcgatgagcgagatgccgtgatccattcagcgagcttagaggaaagtgctatcttcacgaggtcgcgtcaccctgagcccccacccaagccaatcaagcgattcgaatgtcttgggagtcntcgtgttatatagtcctcaaagtgcaaagagtgacgagatccagtgcgaggcaataagatgcagtctcctcgtcctgccgctcggatgggctcgctaggatagacaagctnttacactccgaggttcattggatgtctctcaattacctttaacgcgacgcgctagcgtttcttcatctagttatccatgcnactacctctgagaacgtttgggggggagtacaggcacgacgacccttctcttcgtgtggtcttgtaaggcaccctcatccactctcgacgtgcttcgtacgcctctgtttgatcgcttgctccttcggacgccttcatgaagacctccagtgctcgttgcctcgcgtgggaagcacgacggccgggctcagagatgtagcgcggtggaggcagcagtgtggcgtgcctagcttctcgaacgaattggaagctcccctctgtggggggtggcttgctttggcgctgagtgcgtaggtgcatagggaaagcgagtcccgcgtcttggtccgctttgtgcgcgggattgagctggttgtgggtgttgggcggttgccctccgtccccatgcgttgctttggcaggcctttgtgggcgttgcctgtggcgtgggggccgagccctgttggtgggga

SEQ ID NO: 595190 - DNA, 334 bp, Homo sapiens
ctctagacggatcaccctccacgtgcgactatcgaaaaattgatcccatagagataattactgtataggcagctctggaaaatgaaaagaggcttgggctttgttgctttcgatgaccatgatcctgtgcataaaatcgtattcgcaggaataccataccatcaatggtcataatgcagaactaagaacggctttgtctacaccagaaatgcaggatgtcccagagttctaggactggaacgaggagcgcaactttggctttgggcgattcacgcggtggcggtggaaatttcggaccaggaccaggaagtaactttagaggaggatctgatgg

SEQ ID NO: 595191 - DNA, 326 bp, Homo sapiens
atagtacgcgctcaatagatacttgattgttgaatgactactctctctttccactctgggaaacctaggcttctgacattctgcgtgaccctgcatttctttctggagcccattccatttgtccagttaatacttgctcttaaaaatctccaagaagctgcgtctccagaacccatttagaaccaaccagatgctgagcacacatgtagatcatggccatcatgctaagcccgtagtggcagaaggtagtgggtagacgtcactatctagggggggccggtattttccattctgtccatttcccatcccagctttcacgggggtgc

SEQ ID NO: 595192 - DNA, 411 bp, Homo sapiens
cacgagggctcgcgcatgcttttcaattttgcggtgcgtttcatcaggctttccacaagggaaaaatcatggctttcaaaagccttagcacccgcttttgaaaggttatcgagctctttgtcgatcgactgcgccagcaagtcgcaagctgcggtcatgctcaggtcgcccgcgccagcgcctttgtctggaggcgggacagtccctgaggatggtgtcagtgctggacttgctgccgggttttgcgatgaagcagatgatttggttgatacaggtgttgaaggtagcgcttgcgccggcgttgcagctgccggacttgcttgtgttgatgcaggggcttggttttgacttgtggcccgtctcatgcgcccgcttgtactctgttgcgggcgcggtgcttctgtagcaagg

SEQ ID NO: 595193 - DNA, 138 bp, Homo sapiens
tgattctgacggatcccagccatcgaggacagtgatgattcttccaagcccgcaggagtcgccgttaaacacctactgaaaaagttgaaaagaagccacgtcatcaaactgtgactaacggctgaattaaaccaactt

SEQ ID NO: 595194 - DNA, 1005 bp, Homo sapiens
  misc_feature (9)..(9): n is a, c, g, or t
  misc_feature (63)..(64): n is a, c, g, or t
  misc_feature (86)..(86): n is a, c, g, or t
  misc_feature (99)..(99): n is a, c, g, or t
  misc_feature (179)..(179): n is a, c, g, or t
  misc_feature (234)..(234): n is a, c, g, or t
  misc_feature (278)..(278): n is a, c, g, or t
  misc_feature (291)..(291): n is a, c, g, or t
  misc_feature (299)..(299): n is a, c, g, or t
  misc_feature (371)..(371): n is a, c, g, or t
  misc_feature (383)..(383): n is a, c, g, or t
  misc_feature (387)..(387): n is a, c, g, or t
  misc_feature (394)..(394): n is a, c, g, or t
  misc_feature (435)..(435): n is a, c, g, or t
  misc_feature (439)..(439): n is a, c, g, or t
  misc_feature (448)..(448): n is a, c, g, or t
  misc_feature (454)..(454): n is a, c, g, or t
  misc_feature (479)..(479): n is a, c, g, or t
  misc_feature (508)..(508): n is a, c, g, or t
  misc_feature (522)..(522): n is a, c, g, or t
  misc_feature (574)..(574): n is a, c, g, or t
  misc_feature (598)..(599): n is a, c, g, or t
  misc_feature (601)..(601): n is a, c, g, or t
  misc_feature (649)..(649): n is a, c, g, or t
  misc_feature (806)..(806): n is a, c, g, or t
  misc_feature (913)..(913): n is a, c, g, or t
  misc_feature (941)..(942): n is a, c, g, or t
  misc_feature (944)..(944): n is a, c, g, or t
  misc_feature (999)..(999): n is a, c, g, or t
ccggaaggngtccccttactcccatggggcacctcgatacgcgagctgccctgccctgactcnnttctcagcacccatcttacggnagttggccctggnctcagacccttgggttcagatcccaggccctcctcctactcactgtgagaccctagcgcgagtcccttagctcgggagcntaattcctgcttcattaacatgggggtaagtttaactattctagctagatggttncggaagggatcagttctactaattctcaatgttggcagtgcatnacattgcaaactncctgcctntggctccagagtctgattagaatcaataagggtggggcctgaaaatactacatcctaaatttcgcgagaagnacagtgtctagnatanccctatntctccatctggggttactgtcactctcaggaagaaataatnagcncattattcnttcaancaggaaaagagatgtccaggtgcanagcttggggccccagaaagtaaccacggnggtcaagatgcagnaacccgtcagtgtccagggcatggcctcacacacatccgaggttttcaaggnccatgaagtgccatggcaagcatnntngcctgagggttaggagagctggatctcaggctgcaactttaggctganttcggtgcgtcatcttagacaaatctggtgagctctgagggctggggtaaggttgagaaactgtgggctcctcagggtgggggggtgcttagagaagatggggcctctgagtcctcagactggggggtcttcatcgggttcagcatcctccccaggnccaagccctgccagcctcttgctggcctcccatagccgatgggctgcccggtcgtctcgggcagctggaggcacctcttccacatggcagtgggcaaaatatctccnactgaggggctcgatgcctcttgtaganncnatacaggggtgtctgggcacccctcttggtgccggaggacagcaaagccaatggntgaaaa

SEQ ID NO: 595195 - DNA, 372 bp, Homo sapiens
  misc_feature (304)..(304): n is a, c, g, or t
tgagatggagtctcactctgtcacccaggctggagtgcagtgtcgcgaccttggctcactgcaacctccacctcccaggttcaagcaattctccccacctcagcctccaaagtagctgggattacaggcatgcgcaatcatgcccagctaatttttgtaattttagtagagatgggttttcgcttagtagagatggggtgtttgccaggctggtcccgaactcctgacctcaggtgatccgcccacctcggcctcccaaagtgctggggttacaggcataagccaccaagcccggccgaccttnttctatttttccattctcctttccaaagccatggccatgcgttcctgtgttacagtggcataaacaca

SEQ ID NO: 595196 - DNA, 306 bp, Homo sapiens
tggagacggggttctcacattcatcagaggatgtacgggctgcgacgttggggccggacggggcgccttcctccgcggttatgaccaggacgcctacgagggcaaggattacttcgccctgaacgaggacctgagctccgggaccgcggcggacaccgcggctcagatcacccagcgcaagtgggaggcggcccgtgtggcggagcaggacagagcctacctggagggcctgtgcgtggagtcgctctgaagatacctggagaaggggaaggagacgctgcagcgcgcggacccccaaaagagata

SEQ ID NO: 595197 - DNA, 652 bp, Homo sapiens
tcgcccacgcgtccgcggacgcgtgggtacaaggactaaagtgggctctaagatctaagatggcccggcgcggtggctcccgcctgtaatcccagcactgtgggaggccgaggcgggcggatgagtagaggtcgggagtttgagtccccgtctctagctaaaaattatcaagaattaagccgggacaaggtggcgcatgcctgtaatcccaggtactcaggaggctgaggcacggagaatcacgtgtgaaacctgtgggagggcacgaggggtttggccaaggtgggaacgccccgggaagcacttgtgtggccacgtgtgcgaccttcccaaaggccctgtgaaggcaaaccaagaaaaggtcaaaagagtcctaattctttaaacacagacgaccagcaacgaccgagaagaggagaccgtttaaagtgaatgccccccaaaattcccgttttagcgggggcgcttttggggcgccccaaggagtgaagtgggccacagcgggccttttcaacaggcaaagaacaagccaggggtgtgggggccacccccccacccgctgcgtgggggaaggacacaccccccaccatgtggggggcgaggctgcgactaacataaacaccgcggggcgaacgttctgcggccgcactca

SEQ ID NO: 595198 - DNA, 117 bp, Homo sapiens
gaaaaacgtggtaggcatagctatgcatgcttcaggagcatttgctggttattcagcagctatgagtggaggtttctcttctgaagagtaaacagaaccacaggttttcgctattaa

SEQ ID NO: 595199 - DNA, 574 bp, Homo sapiens
ggtaccgtcacgttgatacaccagtagcatggcacatgtatacatatgtaactaacctgcacaatgtgcacatgtaccctaaaacttaaagtataaaaaaaaaaaaaaaaaaaagacaccaccattcaaaacacaaaaagctacagagggtccgggcaacggaaaagcatcaaaaccaagcggtggtatgtcaaccgggttttatgatggcatttcttggatgaagacaaccccagaaaaagagagggtcatattcctttacctcaaaggggggggaatctggtgtcggggacctacattattcaccaccacatacaaacctggagaaagcaaagtcttcaccagcagatgccaaaggggttccttggtctttacagactagctcggtgcttcacaagagtgggggctgggtgtcccacttggggaacctggttaaaccaagaacccacgagggagccatcgggtgtcaataccctttcctacaacctggcttttttacaagggtcaggggagtctggggcgcagaccaggccgggagatggttcccgggttcaaaaattcaggcaatttctgt

SEQ ID NO: 595200 - DNA, 390 bp, Homo sapiens
cggaagatggacctctgcaacaagtaacactttaatatgggcttctttaactttgtaatatgcatttaagtttcctccatatcttttcatggcttgatagctcatttcttttcaacgcggaataaatttccatttcctgaatataacacggtttatttatctactcactattaaaaaacacttggggctggggcatggtggctcacgcttgtaatctcagcactttgtgaggctgaggcgggtggatcacctgaggtcaagagtttgagaccaggctggccaacatggtgaaaccccatctccactaaaaatacaaaaattagcaggcatggtggcgtgctcctgtaatccaagctacttgggaggctgaggcagaattgcttgaacctg

SEQ ID NO: 595201 - DNA, 681 bp, Homo sapiens
tggagaggagaagaggaggaggaaagggggaaaggagagaaggaaaaggggcgaaagaaggagggagaagaagaaaagaaaaaggaaggaggaggggaagggaaaggagaggaaggagaaaaagggtgagggaagagagaaaggggagggagggaaggagaagggggaaaagaaaaagagagagggaggggagagaggaagaaggggggagagggagggaaagggggagggagggaaaaagggagaggggaaagggggggggaaagggagggagagagaaaggaaagggaagaggaaaaggagggggaaagagaagggaagaagagggagaaaggaggagaggaaggcaaggggagggaggggagaggaaggaggggaaggagggggagaaagagaagggagaggaggagggaagcagggaaaggaggggaggaaagagggagaagaagggagaggagaaaaagggaggggggagaaggggaaaaggaggagagaagagcagagaggggtaagggggaaggcgggagggggggaaaggggaggagaggaggaggggagaaagaagagggaggagagagggggaggaggaggtggagaagtagggatgtctagctcacacaatctctactactctactactactctactactatatatactatatatatactatactatata

SEQ ID NO: 595202 - DNA, 180 bp, Homo sapiens
aaaccttatgcctgtgccctcatccagccagacctgcgagtctacaggaatacgtccagcagatagcggatgccctgcactatctgcagaacgtctctggatacctcttcgtcaggttggttcagccagccacccctaccttatcagagcgccatccttgtcctgcgcactccagtcata

SEQ ID NO: 595203 - DNA, 890 bp, Homo sapiens
  misc_feature (29)..(29): n is a, c, g, or t
  misc_feature (126)..(126): n is a, c, g, or t
  misc_feature (140)..(140): n is a, c, g, or t
  misc_feature (142)..(142): n is a, c, g, or t
  misc_feature (148)..(148): n is a, c, g, or t
  misc_feature (331)..(331): n is a, c, g, or t
  misc_feature (339)..(339): n is a, c, g, or t
  misc_feature (344)..(344): n is a, c, g, or t
  misc_feature (347)..(347): n is a, c, g, or t
  misc_feature (376)..(376): n is a, c, g, or t
  misc_feature (409)..(409): n is a, c, g, or t
  misc_feature (424)..(424): n is a, c, g, or t
  misc_feature (453)..(454): n is a, c, g, or t
  misc_feature (470)..(470): n is a, c, g, or t
  misc_feature (501)..(501): n is a, c, g, or t
  misc_feature (507)..(510): n is a, c, g, or t
  misc_feature (514)..(514): n is a, c, g, or t
  misc_feature (517)..(517): n is a, c, g, or t
  misc_feature (553)..(553): n is a, c, g, or t
  misc_feature (580)..(580): n is a, c, g, or t
  misc_feature (585)..(585): n is a, c, g, or t
  misc_feature (591)..(591): n is a, c, g, or t
gcccgctcctcctccccagccatggcgtncaggttcgcgggcttctgctacatgctggcgctgctgctcactgccgcgctcatcttcttcgccatttggcacattatagcatttgatgagctgaangacgtgattacaangnaatccntatagaccaggtgtaataccctgaatccgcccttgtagctcccagagtacctcagtccgacgctttcttcgtgtgtcatgtttccttgtgcagcagagtggcttacactgggtctcaatatgccccgtcttggcatatcatattggaggtatactgagtagaccagtgatgagtggccaggantctatgancctanaancatcatgaatgcagatattctagcatatngtcagaaggaaggatggtgcaaattagcttttnatcttctagcatttnttactacctatatggcatgatctatgttnnggtgagctcttagaanaacacacagaagaatggtccagttaagtgcntgcaannnngccngcnaaatgaagggattctatccagcaagatcctgtccangagtagcctgtggaatctgatcagttnctttnacaaangactccttattgtcacatgtttccacattgttgtcgtggacacgatggtctcatctgtacatacctcagcataccacgatttctcacccgcgcattacgtatactttcctctaccgctgcctcccctggcgtcgacaggtcgaacttgcccctctcacaggacccgccctatcccccgaatgatgcattatttacgacgtctactacactcggcccctgtcctcgcaactgtcgggccacccgctcccgcccagcactccatcacactccgcccaaccggccacaacccgcacagttcc

SEQ ID NO: 595204 - DNA, 765 bp, Homo sapiens
  misc_feature (29)..(29): n is a, c, g, or t
  misc_feature (126)..(126): n is a, c, g, or t
  misc_feature (140)..(140): n is a, c, g, or t
  misc_feature (142)..(142): n is a, c, g, or t
  misc_feature (148)..(148): n is a, c, g, or t
  misc_feature (206)..(206): n is a, c, g, or t
  misc_feature (214)..(214): n is a, c, g, or t
  misc_feature (219)..(219): n is a, c, g, or t
  misc_feature (222)..(222): n is a, c, g, or t
  misc_feature (251)..(251): n is a, c, g, or t
  misc_feature (284)..(284): n is a, c, g, or t
  misc_feature (299)..(299): n is a, c, g, or t
  misc_feature (328)..(329): n is a, c, g, or t
  misc_feature (345)..(345): n is a, c, g, or t
  misc_feature (376)..(376): n is a, c, g, or t
  misc_feature (382)..(385): n is a, c, g, or t
  misc_feature (389)..(389): n is a, c, g, or t
  misc_feature (392)..(392): n is a, c, g, or t
  misc_feature (428)..(428): n is a, c, g, or t
  misc_feature (455)..(455): n is a, c, g, or t
  misc_feature (460)..(460): n is a, c, g, or t
  misc_feature (466)..(466): n is a, c, g, or t
gcccgctcctcctccccagccatggcgtncaggttcgcgggcttctgctacatgctggcgctgctgctcactgccgcgctcatcttcttcgccatttggcacattatagcatttgatgagctgaangacgtgattacaangnaatccntatagaccaggtgtaataccctgaatccgtgagtagaccagtgatgagtggccaggantctatgancctanaancatcatgaatgcagatattctagcatatngtcagaaggaaggatggtgcaaattagcttttnatcttctagcatttnttactacctatatggcatgatctatgttnnggtgagctcttagaanaacacacagaagaatggtccagttaagtgcntgcaannnngccngcnaaatgaagggattctatccagcaagatcctgtccangagtagcctgtggaatctgatcagttnctttnacaaangactccttattgtcacatgtttccacattgttgtcgtggacacgatggtctcatctgtacatacctcagcataccacgatttctcacccgcgcattacgtatactttcctctaccgctgcctcccctggcgtcgacaggtcgaacttgcccctctcacaggacccgccctatcccccgaatgatgcattatttacgacgtctactacactcggcccctgtcctcgcaactgtcgggccacccgctcccgcccagcactccatcacactccgcccaaccggccacaacccgcacagttcc

SEQ ID NO: 595205 - DNA, 156 bp, Homo sapiens
  misc_feature (14)..(14): n is a, c, g, or t
  misc_feature (125)..(125): n is a, c, g, or t
atggctcccactgncacaactggtacatggtgggcctggtcgcgcaggaggcggtgaagaattaggcggtttacgagcggtgaaacattacatgcagcgaaccgctgttcagggtagtccgacgntgcttgccgctatcagtaaacagtgggtgcg

SEQ ID NO: 595206 - DNA, 334 bp, Homo sapiens
tgccaattgtttgtgaccagacaagacgattttactacagcaccctcgagtctatctatctagagaagtagaatctagatccgaatcgtttattcttaatgcttctttgattttgttcttttatccttttctcctctccaactcatcttttaaataatcatgttcgtatactagtcatacagttacattagtaatatatatagagatttaccataaatacgtggtttagtttgttagagggtgggtgaagtgtgccttcacagcctgctctactgagtggacatcatgcaatcaatacttctgttgtccgcgtgctgtaggccaatcaaagctt

SEQ ID NO: 595207 - DNA, 268 bp, Homo sapiens
ggccgcttttttttatcgttttttttattgggtgttcttataatttttaatgatcaaaacaaagcatctaaaaccgcattttctggaataaccacttgttcttgcctgtcttggatctctcttcaaacttgaccttggcctcccgacgggccttgcgtttaaaagcaggatctctgaagacatccttattgacaacagttttttccaaggggatatccacagagtaccttgtgggcattatgtgattgtagttttacacttttacaaa

SEQ ID NO: 595208 - DNA, 278 bp, Homo sapiens
  misc_feature (23)..(23): n is a, c, g, or t
  misc_feature (64)..(64): n is a, c, g, or t
  misc_feature (73)..(73): n is a, c, g, or t
  misc_feature (88)..(88): n is a, c, g, or t
  misc_feature (91)..(91): n is a, c, g, or t
  misc_feature (97)..(97): n is a, c, g, or t
  misc_feature (145)..(145): n is a, c, g, or t
  misc_feature (157)..(157): n is a, c, g, or t
  misc_feature (166)..(166): n is a, c, g, or t
  misc_feature (171)..(171): n is a, c, g, or t
  misc_feature (175)..(175): n is a, c, g, or t
  misc_feature (227)..(227): n is a, c, g, or t
  misc_feature (242)..(243): n is a, c, g, or t
  misc_feature (265)..(265): n is a, c, g, or t
ttctcctttttttcctttttggnactctctctttttccttttctttcttccagatatctgagtntcttacatntttcgggtttctcgngcnccgggnggtcctcgcgggggcgttggcccaggtgatcgtgggggtttggggggnttgggctggggnaactgtggngtgcnaggnccgcttttttttggtcttttcccttgtggtctgtgtttggtggtgggttgtnaaatgggggttagtnntgttgttttttcccttgttgcnaatgttccaaatg

SEQ ID NO: 595209 - DNA, 126 bp, Homo sapiens
gttctgcgaggcttcaggacgcctgcgtggtcgcccttcaggtagcgcccgcccaccttggtggccaccgttgtgtagtcgcagaatcgaagaagaggtcacaggagtgcgcgttgctggaaatgc

SEQ ID NO: 595210 - DNA, 128 bp, Homo sapiens
gaccggattaggcgtcaactcagtgacctgtagactaggtcagaaaacagtcagaaagataaattactctatctctttaaaattggaataatctagcactctctcactgaatcagactactagtcttc

SEQ ID NO: 595211 - DNA, 227 bp, Homo sapiens
  misc_feature (16)..(16): n is a, c, g, or t
  misc_feature (57)..(57): n is a, c, g, or t
  misc_feature (88)..(89): n is a, c, g, or t
  misc_feature (92)..(92): n is a, c, g, or t
  misc_feature (94)..(95): n is a, c, g, or t
  misc_feature (113)..(113): n is a, c, g, or t
  misc_feature (150)..(150): n is a, c, g, or t
  misc_feature (158)..(158): n is a, c, g, or t
  misc_feature (180)..(180): n is a, c, g, or t
ctcatggtaccttttnatgtatgctaaatgatgcttagagtatgaatgaaacatcantaacaatgtaaatattaaactcagtgttgannatngnngacatacttgcatatganttggttaaaattgtgtggttaaccttatcattaaaantgtatttnttctgataggtagaaatttaanacattggttacagtgaaattgtaagactgcccagatgattgtgtaag

SEQ ID NO: 595212 - DNA, 191 bp, Homo sapiens
caggcagtgacaacctgaaacctaagggtcacagtcagtcacgacttcccttttctgaggggcctagcaggaagagaatatagagactgatgcttagtgtaagaaggaatgtagtacaggttaaccagcaaccacaaagacatatccaccacagcactaataggtcagaagaataacataccacaccaaaa

SEQ ID NO: 595213 - DNA, 572 bp, Homo sapiens
agcggggattgcaggtgtgagccaccgcgcccggcctattttattttttcaagatggagtcttgctctgtcacccgggctggagtgcagtggtgcagtcttggctcactgcaacctccacctcccaggttcaagcaattctcctgcctcaccctcccagctactcaggaggctgaggcaggagaatcacttgaacctgggaggcagaggttgcaatgagttgagattgcaccactgcacttcagcctgggcaagagtgagactcggtctcaaaaaaaataaataaaaattaaaaataaataaaatgtcagattggccagtttagtgctctgaggtctggttgccaatgagaatgtgtggtgtgagccttgggccctggatcccctctcatcgactcattatgcacctcacaccaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgt

SEQ ID NO: 595214 - DNA, 141 bp, Homo sapiens
acctggcacacgtcatggtgtagagtcagtatatttgggatttagtagtggtgtgagctgacgcttcttaattgtgtgtagtgtcagtcagtgttatctgacgcgctatcggagagatggttcatgtactatactacatag

SEQ ID NO: 595215 - DNA, 188 bp, Homo sapiens
  misc_feature (71)..(71): n is a, c, g, or t
  misc_feature (90)..(90): n is a, c, g, or t
  misc_feature (100)..(100): n is a, c, g, or t
  misc_feature (118)..(118): n is a, c, g, or t
gctcggctcccgctgcgagcggccgccctgcccgcgcaccgcgctcagcgcccaccgccgggcttcccgcngccggacccatgtacctcnggctccccgnggtgccggaaccgaggcncgcaaggccagcgctctgcgggggtgttgtgggcggacctcaggagatgaaatgacaacgtcaaccctcc

SEQ ID NO: 595216 - DNA, 587 bp, Homo sapiens
  misc_feature (439)..(439): n is a, c, g, or t
gcagaatctactgccaaaactgcaacttactttcaagtttgattaacagagggattttgcatatgttgcatgccaatgcatgtattcatgaaaaaaaaagttcggagatgagtggctaagacgcttaaattcacacctgattaggaagactgatcaaagagaggcgtgtgacttgtcctactcacatatttcatgcctcatgaattaggagtgggtgtcaagagtgcatagggactgctgatattcactgagtaccaaccgttacctctacagcagttgttaaaatattcagtagataaaagctgccctagtgttctctccttctgcacctacttccccaggactcactggagctccacaagacccagcaactgaagtgttcacacttggcacagaagactatccaacagaccctgctggtcctctggctggccacagntccattgggagtggcctgcctccagtacattgtaagtatttctcctatcacccctgggtactgtgtaacaaacttggctttgaaaaaagcttaggacattgctatgacatagcctaattcccaactcttgctatggagatgaagcttc

SEQ ID NO: 595217 - DNA, 614 bp, Homo sapiens
  misc_feature (23)..(23): n is a, c, g, or t
  misc_feature (100)..(100): n is a, c, g, or t
  misc_feature (179)..(179): n is a, c, g, or t
  misc_feature (277)..(277): n is a, c, g, or t
  misc_feature (350)..(350): n is a, c, g, or t
  misc_feature (441)..(441): n is a, c, g, or t
  misc_feature (464)..(464): n is a, c, g, or t
  misc_feature (479)..(479): n is a, c, g, or t
  misc_feature (515)..(515): n is a, c, g, or t
  misc_feature (528)..(528): n is a, c, g, or t
  misc_feature (543)..(543): n is a, c, g, or t
ggagacggggtccaggccaggangtcatcagagaatattcaaaggaataaataaaacttgggctcaccaaaaacaaaaaccaacaacaaccatttggatnattcatatggtgtagggttctttttttcaaaaaagtattcatcatttcactatgcaaataaggaatcaaacttttactngactacctcagagggaataattacccgggttaacggttcgggcggggctcaggggctcacacctataatcccagtacttggggaggcccaaggcgacnggatggctggaacccaggagtctaagaccagcctaggcaacatagggggatgtaatctcttctaaaaatgagngggggggtgcaaaattaggggcacatgccggtgatcccagctactcaggaggcggaggtgagatgataattggagccggggagatggaggnggcagtgactcaggatggtgcanggcactccagccggngtgacagagccagattctctctcaaaacaaacacanacaaaaaatactngaaatatgtggggtntgaagatatttcaacattaaaagacacagagtttagtgtccttattactcaagttctacaagagggcagat

SEQ ID NO: 595218 - DNA, 111 bp, Homo sapiens
ttgctctcgacggatctcgacgtgtctccctacctgaccctgggcaacacgatggcttgttgtggatactagagggaggcagctaatcccatgtaaaccaggcgagacact

SEQ ID NO: 595219 - DNA, 342 bp, Homo sapiens
tatcatttatttaatctatcatacccaggtttttgtcttgtttcatatagtagaactactccatcattcataaaattgatatctggcaacctactgcttacagtcagataatgccactttcagttcaataaggcaagtcacaccttttatagctattctctctcacagtcctacgagatattgtttcacttcaatttcacagggacacttcatgatttatctcatataggtaataagacaatcctaagttgtaggattcctattaagttgttgcttttcttgatggaaccctttacttgaattttctcttctcctttctgaaatttgtttctttcattatgt

SEQ ID NO: 595220 - DNA, 1355 bp, Homo sapiens
aaactgatgattctacttcaggagcaagaagctcctaccacgtatccagtatcaaaaccttactctgaggtcctggctgcaaaaaaaacatcggcagcaggaagcagagagacgaaacaagcacaagacggatacaacttgcatcaagctacagattgatagtgacacttaacaaaacagtagtttgtgccacccattgttgccagcagaggacaatcagcaggagcctgcaggtaacaacaaagtctatgcaggaggtgcacatcaagacgcaggaagacattaaactggagaaggcactgagggtgcagccgagctctgagagcagccaccagctccccagtactcaacacgaggaccaatccaggggcacaggcgagctgctgcgaatcaccaaaacgaacagggctcgacaggaagagaagaaccttcagagaacggaactgcaagttgatatctcagaagccagtatccaaaacagaagctataagaggctaacaaggtgagaaccaacaggaagatgacatcaacataacacttcacagtcaaagagcatgatgagacccactgcagaagagaaagcaacaatgcacagaaaaccagacaaggcagaaggggaacaacaatcaagacctaagaacacacatacatacacgagcagaatagtagcccgacaaggcacaaacaccaaaagatggaagaagacaacccacaagcacacaaggcaagagacacaagaacaccaaacaaggggcaacaccatggaaccaaaggacgagaatacaccaaaaacagaacaaacccacaaacagaaggcaaggtagacaacaacacaaggcaaaggcaaacaataaaaaaataagacacagcagaaaccagtgaaaagcaaaagacacaaggccacaaagaagcgcggctacagacacaagaccacacaaggagagaacagaaaaagacacccaggagggaaacacagagatgaagcacaagccaccacaaagatgagagcccgacacaggaaacaggcaaagataaacacccaccaacgagaggaaaagagacacgaatgcatgacgcagatcatctacacaagacaagaagattataagacaacgcaccaaatcgcacaccagcgaatacatgtcgtactagaaaaagcaacgaagacaagagcaacaccgaccaaagatacatataacgcacatctacaatgacgcgagagcatcaacaaccacaaaatagatgaaccaaaagcaaagccatctaaacacacaacgaacagaacacacgaacacatacaaacaatgtaccaaatgataataagaagaaactatgactcaataactatccagtca

SEQ ID NO: 595221 - DNA, 277 bp, Homo sapiens
  misc_feature (188)..(188): n is a, c, g, or t
  misc_feature (231)..(231): n is a, c, g, or t
acgcgcggttcaagtgctggcattacaggcatcagccaccacgcctggctttcttctgtgtttttttactgaagtatttaggccattaacattgtttgtaatctattgatatatttcgggtttgtaacaactcatcttgctcttttattcgtgtttctctctatctatcctttaattctttattctanattttctcgcctcattttgtgtatttctttaaacttatattcntattttacttgctactaactggctaagatattacgcgcacttcttt

SEQ ID NO: 595222 - DNA, 206 bp, Homo sapiens
agaatacggctaacgaccaccctacctactttcctaggaccctaacatcctactacttgccacatacactcaggccccagacccagctattagccaaagcactagcctccaagcgaagttaaatcaacaatacataaaaacagtaacaatcgaccagacaagagaccccaagttctctccacttagctcagttcgtgtcgatctta

SEQ ID NO: 595223 - DNA, 477 bp, Homo sapiens
tcttattggactttagttgaaacatgccatctgatgacaggcattgtccctaggcccaatctagcttcgatttagcgttgttaaaagtgaatttcaaacaaaaactaatgaagcataaccgaaacataaattgttttcttgtgaaaatacattttttcttaagatacaaagatgattttcctttattgtggtcacactgactttactatccccatgacagcagtgagcatattgtcaaagtcactgtaatagcagatttcccatgcctgaataacattgattttactcttaacattctatttttagattaccacagtattttactttaaaatagagtaaggtgagtggggaattagaagaatgtttgggaactaagctgccaaaagctttcattaatttcctattctcatttattagacaatattgattcatcaaagcttgtgtagcagtcagtgacaaagctaattggaataaaaa

SEQ ID NO: 595224 - DNA, 158 bp, Homo sapiens
gatctagaggatcccaaatcaggtgggcgcgaatcaggtcggtcgcgaatcagagttcaaggcattatgttgctatcggaggactacaatggaccacgtcggtctgggtgttaagtgctccaagagaggtggccaccgccatccagtggggccatcat

SEQ ID NO: 595225 - DNA, 261 bp, Homo sapiens
  misc_feature (12)..(13): n is a, c, g, or t
  misc_feature (31)..(31): n is a, c, g, or t
  misc_feature (242)..(242): n is a, c, g, or t
tccccccccccnnccgagcttctcccgtagntcccaaatatctggttttttctgcttagcctccttctttatatgctggcctttcctttcccagaagcagtgtacaggaagaactctgctttttcatacctgttgctttgaccctgagtacaactgaaattgttccaaaggtcacaccctctgcccacagaatctcagctggctttgcaactgagttctctcacctaacagtgtcctttggncaggagtaggttacatgcc

SEQ ID NO: 595226 - DNA, 210 bp, Homo sapiens
ttggcccgggggttaatttccgggaggaaaactaagtggaggcaaaagaagggtttgaaatggggtttttccgactttcggggccatttttttgaaaccccttaaccccgctgcctttgggtcactttgtaaaccgcattttaccctttagaaagtcctttataaagttccctgtgctttccctggggttacaaacccttggttttgtta

SEQ ID NO: 595227 - DNA, 295 bp, Homo sapiens
  misc_feature (121)..(121): n is a, c, g, or t
  misc_feature (214)..(214): n is a, c, g, or t
ctcatctctttctcatagtaactcccttactggagtcacatcttccctagctgcttctctttcctggcaagcttctttgaggataaggtacatatacagtcacctcattttttcctcaaanatgacccacctgaaactgtttctgcccaggacactaatgatcaaagccaatgaacacaattcagactttcttgtatttgttctttatgtagcnatggactcaactgagcatccactgtttctggaatctttttttcctttgacttcaccaactccacacttcaggcttttcttc

SEQ ID NO: 595228 - DNA, 858 bp, Homo sapiens
agcggggcggacggtctaggcggggctggaggcggtggctgcggttgcgggaccggtggccgtctgcccggccagcaccgtgcacacagcttgtggtcttgagctacacggcaggtgctgcatgtgcacagccagctgcctgccaggcccgtgcccagtgctgccaaggcgaacgtcttcccaccatgctgttcacaggtggccttccatggaccaaagaatgacagtggtacttgcgacgagttgggtactacacagtgggccattcccggcttgcttcacgtttccatgcaagaatgctgacaagggagtggtgcccaccaggggaagccagttgcccttcctggcaagcgaccgggatcttggacaacgtggaggaaagccttgcagaggctttgataaattcacatggcgagcgcatggacttggaagcccgggggcagtgccccaggtaaacgcatccagggaaggcacctggagagagggcactagggcacagcaatgttaggagcccaccagtattagcggggcaaaagaggaaacgcgcacattagaaaatggcagatacacaaggcggggattacgacaatgaggcagatgaggacacatatgagacgccggcagtagaagacacagccaatagagagagcgaagactacaacacatcgggggtcagaggcatcagaagacaaacgcaatgggcaaatcaccaatggggagggcaacaagttagggaaaaggacaaggccgcaagtaatggctagaggcgacactctttgagaagccaagggcaaaagaaccgcggaataaagaatatcccaaccgggagagaaataacgcaaaatggctcgacagcgg

SEQ ID NO: 595229 - DNA, 302 bp, Homo sapiens
gcacgcggagtgtgtggctcatcattgctcactgtggccacctcctaagcttaatgtgagcatcccaccttagtctcctgaggtagctcggactataggtgtgtgctaccacacttagctattttatttcttattattttggtaaaaattgggtcttatattttggcccaatttgttctcaaactctgggactcaagcgatcctcccacctcggccccccaaagtgcggggattccgggcttaagccagtgcacctggccttagaacggtctgtttgaggcagccaggtggcctactccagc

SEQ ID NO: 595230 - DNA, 147 bp, Homo sapiens
caagatgaacatcaacaaacacaatctatatgcagttttgacgactgtaagaagacctttaagaaccatcagcagctgaaaatccatcagtgccagcataccaatgaccctctattcaagtgtacccaggaaggatgtgggaaacac

SEQ ID NO: 595231 - DNA, 193 bp, Homo sapiens
tctacggaatggaccttgctgaatctcatcatggtcagtcctgtgccatgcttgtcactcagaagttttctcatgaggagattgccatggagacgtctacagcgctgcgccgcacagtgtcccccgttgtcactaggatctccttcctgtctggaggccagagtgaggaggaggcgtccatcaacctcaatgc

SEQ ID NO: 595232 - DNA, 460 bp, Homo sapiens
cctggaggatgcccactaaatttgagaaatatgcatctgcgtgctgctacccaagataacagtgcatagtaagtccagaaataaagaaatctccttaactttaagtaacagcatttttcaaatgtatagccacaataaaaaacttatttgtccatgtgacacttaactaatgctatagaaaggctctattgagaagtgataaatgactaagtgatatatcgggctaacaagtagatttcttataattcgaattatagaatctgttctgatatctcctaatttaatcgtatttcctaatgtcctagagaattccaaatgcttatttttcttctaactaaaggtaatggtagtactacttgagcacatagaattgtaggagactgtcattcaacaggtatttgtagaatacttagtatggccttattaaaggccagatttcacagtgattctgtgactaaaa

SEQ ID NO: 595233 - DNA, 334 bp, Homo sapiens
tctgtaagacatgagggaactgaggattgaaaagctcatacaatctctcttagacaacacaatataagcaataagagcttaacaagatgctcattgcaaattccagactctgcccactgtagaccattctctttattggcataaaggggcatgacagccctcagagccaccgagctgagagaagatgaagcagtggcagatctcagaggaaagacagtttatttggtgagtcacatgaagaacaagcagagtgtgagcagaggaaaggcagcagatactgaaaaagaatagaccatgtctggtaatggctataggaggtaagtaaggtcgacgc

SEQ ID NO: 595234 - DNA, 411 bp, Homo sapiens
catagctcgatttctccattttcctctgaaatagctccatccgcccttctcctatgtcatagcgccatccgcaattctcctgtgacagagctccatccgcaattctcctgtgacatagctccatcctcccttctcctgtgacatagctccatcctacattctcctatgacatagctccatcctcccttctcctatgacatagctccatcctcccttctcctatgacatagctccatcctcccttctcctatgacatagctccatcctccattctcctatgacatagctccatcctcccttctcctatgacatagctccatcctcacttctcctctgaaatagctccatcctcgcttctcctatgacatagctccatcctcccttctcctatgacatagctccatcctccct

SEQ ID NO: 595235 - DNA, 129 bp, Homo sapiens
acggcaggtaaagaatggaaagtctgtcaggcgcggtggtcacacttggaatcccagcactttgggaggccaagacgggcagatcacgaggtcaagagatggagatcagccaggcgcagtggctcactg

SEQ ID NO: 595236 - DNA, 305 bp, Homo sapiens
  misc_feature (65)..(65): n is a, c, g, or t
aaagaagatgctttcacaatataacaaaaagtgagttcttccatctaaactctgaaagaaaaganataaacagacgttctactgtgatacacctgtgcttttggttaacttcaaatggttttcagatcttgacttagtatttccagttactctgcttccagaaatagggttcctgaaaatcagagcttacacacacagaccttccatgtatgttttgggaaaaagaagttgactctcaattatttgtgattatggtaactattcatttaaaatttcacaaataattgagagtctccgtcgaactg

SEQ ID NO: 595237 - DNA, 833 bp, Homo sapiens
cgcagtggctcacgcctgtaatcccagcacttcgggaggcagaggtgcgcagatcacgaggtcaggagatggagaccatcctggctaacacggtgaaaccccaactctactaaaaatataagaaattagcctggcgtggtggcgcgcacctgtagtcccagctactcaggaggctgaggcaggagaatggagtgaacccaggagacagagcttgcagtgagccgagactgcaccactgcactccagcctgggccacaaagcgagactccgtctcaaaaacaacaacaacaacaaaaagtccacctgtctggggcaggcaccatgagtggagctggcgggactggcagttgctctgggtgagtcagtgagtgagtgatgggtgaatgtgaaggtctaggacatgactgtacactaccatagactttataaatacagtacagttaggctgcattaaatttataaacatatttttatttttaaaaagtaattgtgctacattagatggcttctttcactcatgaagtgagaaatttttcagctccattacaatcttatggctgaccatcataagtggggtctgtcagtccgtcactgaaggaaacttctttttcccaagatggaatttcgctctgtctccaaaaaaaaaaaaaaacaaacaaaaaaattgtggggccgcggccctgaaaagtttttaacaacctctgttggggcggggcccgggtttgacaccggcaacgggtcccagaaaccgggcagacagggggggtctcccaaaaaaaccgggggccgggtttgaacacccgggtcgggcccggtataagggcagtaaccgg

SEQ ID NO: 595238 - DNA, 466 bp, Homo sapiens
aaggggggcaggcacggggctcacacctgtaatcccagcactttgggaggccgaggtgggtggatcacgagattaagagatcaagaccatcctggccaacatagtgaaaccccatctctactaaaaatacaaaaattagctgggtgtggtggtgcaagcctgtagtcccagctacttgggaggctgaggcaggagaatcctttaacctgggaggcggaggttgcagtgagccaagatggtgccactgcactccagcctaggtgacagtacgagactctgtctcaaaaaaaaaataataatgctaccaggtagcacatagtaggcccagacatgttctaaccccttcacttcacacacttaccatgcaggactgtgtgaagtgggtttctcctatgaaccgctctctataggtggctcacatatggacgagctgtacaaggggtcgatttcgagagtcttggccaag

SEQ ID NO: 595239 - DNA, 248 bp, Homo sapiens
  misc_feature (1)..(1): n is a, c, g, or t
ntggcgcgctgcgccggcgaggaagaggaggaacgccttaacggcggcgacatgcatatcgaagcgcgcgccgccggggaggatgaagcggaagacaaacgcccggcataataggttaaaaaacgccccatcttgttgcgccatacgcaacacctggctatgatgcgtatagcgcaacactcatggagccgtcaggatgataagaagcttcaagcataagggactcaaaaagtttttcgaaaccggtt

SEQ ID NO: 595240 - DNA, 232 bp, Homo sapiens
agcggatccccctcccttggcagagctaattttttatttttttgagtcagggtatcactctgttacccaggctggagtgcagtggtgtgatcacagctcactgcagcctcaacttcctaggctcaaccaatcctctcacctcagtctcccaggtagttgggactacaggcacacgccaccacacccagctattttttattaatgttaggggacaagaagctctgccaggggg

SEQ ID NO: 595241 - DNA, 382 bp, Homo sapiens
tgtacagttcagtggtatgtggccattttttaaaaatcacaaagtttttaaaaagcaagatgtgcgaaatagtgtgtataaatacacacaatctatttgtagatctttcgatcttcaaatgtgaaacacttataatctttctcctactcccgagctcctcagttatgtcttatcaaaacgtaaagtgtttttctcactgattgcacattgaagtattagtccccagaagagatataaaaagattttctttttttttgagacggagtcttgctctgtcgcccaggctggagtgcagtggtgcgatctcggctcactgcaagctccacctcccgggagaattgcttgacacccaggtggcctgggcaacagcaagactatctca

SEQ ID NO: 595242 - DNA, 141 bp, Homo sapiens
gcaggtgtatcaggatcccctcgtctatcctacccttcctcaccacttccgctcagtcccgactccttttccctattatcctatctcctcctgtctattaaagcctgcctcttccaggtaagacccccctaattagaactg

SEQ ID NO: 595243 - DNA, 739 bp, Homo sapiens
  misc_feature (42)..(42): n is a, c, g, or t
  misc_feature (61)..(61): n is a, c, g, or t
  misc_feature (69)..(69): n is a, c, g, or t
  misc_feature (116)..(116): n is a, c, g, or t
  misc_feature (125)..(125): n is a, c, g, or t
  misc_feature (139)..(139): n is a, c, g, or t
  misc_feature (162)..(162): n is a, c, g, or t
  misc_feature (195)..(195): n is a, c, g, or t
  misc_feature (198)..(198): n is a, c, g, or t
  misc_feature (235)..(235): n is a, c, g, or t
  misc_feature (246)..(246): n is a, c, g, or t
  misc_feature (256)..(256): n is a, c, g, or t
  misc_feature (260)..(260): n is a, c, g, or t
  misc_feature (301)..(301): n is a, c, g, or t
  misc_feature (310)..(310): n is a, c, g, or t
  misc_feature (316)..(316): n is a, c, g, or t
  misc_feature (319)..(319): n is a, c, g, or t
  misc_feature (323)..(323): n is a, c, g, or t
  misc_feature (327)..(328): n is a, c, g, or t
  misc_feature (350)..(351): n is a, c, g, or t
  misc_feature (362)..(362): n is a, c, g, or t
  misc_feature (365)..(365): n is a, c, g, or t
  misc_feature (384)..(384): n is a, c, g, or t
  misc_feature (397)..(397): n is a, c, g, or t
  misc_feature (407)..(407): n is a, c, g, or t
  misc_feature (448)..(448): n is a, c, g, or t
  misc_feature (715)..(715): n is a, c, g, or t
atttgttacattaactccttttccctcttctactaaatttcngttcctaatcatggttganccactttnttacacagcagattcaaccatttcaaatgaagtcagccagtcttggntctgttgtntatgggtgtatgtntacacgtgtatctaacatatttntttaaacacacataaaacacatacaatctgggntgngggaaattacagataatttagtctgatattatatgcnactcaattttnccactgtggnttgngtcctgggctttgggtcaagattttattttaaatcactggnagtccatcngcggcnggntggnttgnncagatgaggcatgcgcttttcnnaaggcaatggnacngacctcagggcatgggggncttggggcgtacngtgggtgganccctcaggtaggacttctgtaggtgagacgagggggcggtnatggcttgcctatcccagccgggggcactgaatctactaataacacaagcaattcactctgggaattctgtcaaatatggtggtatctgttaaaagcttggaagtagaaaagggccagttcatcttgatcatacaaattagggaatgcacccacaactgcaataccctcaggcagtatgccaacattgaaatagaaagcatctctaaaaagcactgttcctccatgggtgaagactggtattaggaagtgccacacaatttttgggnattgttgcacaggacacgtggatt

SEQ ID NO: 595244 - DNA, 496 bp, Homo sapiens
  misc_feature (42)..(42): n is a, c, g, or t
  misc_feature (112)..(112): n is a, c, g, or t
  misc_feature (211)..(211): n is a, c, g, or t
  misc_feature (225)..(225): n is a, c, g, or t
taagaggtgataaggaggatgatttaaagattaatttagatntaagttgtaagaaaaattagtatagaatggagtgtattaaattaataattaggagagtggattttttttngttattttggattagtttttatgaaaggatttttgaaatgaaatttatatattttatgtagattggaaaaatttatgttttaattttttttgtattgtngaaattattttatnggatatgttgtaatagtaaaatttttagttagattagtgtttatatatttttttagttatttaatatttaatgttttttttaatatttaagtgatgtttgtttttagtgttttaatgtagtataaattttatgtaaaattatattatgtatttttgatattaatgttgaaattaaatatatgtataagtttttaattttgtgtaatgtgttaagtgttgtttatttaagttattgaaaatgagaataaaatgttgagtttttttaaaagta

SEQ ID NO: 595245 - DNA, 765 bp, Homo sapiens
ggcaggattgcgccactgcactctagcctgggcagcagagtcaaactccatctcaaaaaaaaaaaaaaaaagttcttcgacctactttgtttgactgtagttcataaaacccccgattccaaagggtcctgccccacacccaggaaaaaggaattgctacctcagagaggccaagaaggattctagaacagacaggccttgcttgggttttccccactcagtctatcagcaattcgatcaggccctttttatatcccgtgtttctccacagctctccattacttttgttaagccttaagcattaaaaagtggacaattttccccgtggattcttggggtcttcatgctgaagtttaaattacattgttaaattacattttgcattgccttttctctcatttaatcagcctcattgcaggtgaatttttcagcaaacctccaggggccaaggggcctttggcccccacacttttatttgtttgcttacatacctagtacatgggattggtttcttaactgtgtgtccctttaatccatttatatgatccatgctggtgaactgtgggaatacagaacctaagctttattgaaattactgaaggctgctgggggtggtggctcacacctgttcatcccagactttgggaggccgaggcaggtggatcacctgaggtcaggagtttgagaccggctgccattgtgtgggaccgtctctcttaatccaacgtacctgggtttgtggtgtgccctgtgtccagtgctcga

SEQ ID NO: 595246 - DNA, 1002 bp, Homo sapiens
gaccgtacccagcaaggtcgatcgcgtattacgaatcatagaccatgaggaagccgaagatgaaatgagaagcacattcagcaagagaataactgtctcgagtcaatgtgacagctcagtatgtaacaaaatactatgggtcatatttaacaggggtctaacattatggataataatggaatacctgggtcggaggttcagacagctggactcttcttcgagctgggtccgatccgatggagtgtgcagagtaggctcaccaatgctatgaggcatagagtgccaaaaggtcgggtacctatcgtgcgattcagcagaatagacaccagtgtcacctgagacataaacagctgccaatgtcgtcggtctcagcaccgaaggagatgttacaacttgctgcatatggagctagctggtctcgctgtacagaaatacaccaggattacgaacagacaactacgctttgccgcgtgaacctcccactgatgcgatgggcgtccttgcacagtgtgtgcacacaggtcatgcttatgactcaaaaaatctgaccaattgggcgtccatggaggaaatatagctgcctgattgtgaaacgtaagacaaaggggaggaagccgaccgttacagctgccggattatggacgatcgcaaaccggagcaggttcctggtcttgccttgaagttccccaacaacagacaccgaaaattcccctcgcaaagcgtccgtttgggctccgcggaaagcagctttcaatccttacagagttcccgtattcttgaaaaaggacgggaacgtgttcaacctcggggagctggccgttggcgcctatggacgaagccaaaacacgcaatatcccacgtccacgtcgcatacgaacgccgttaagcaagccacaaatcggaaacaactttcttgggaacaacagcgaaagaatttccagtatggtgaacacaaacacagtatcacaacagcaaaagaaccattgcgtattgaagtctgga

SEQ ID NO: 595247 - DNA, 202 bp, Homo sapiens
atggaggactggaaggatatagccaagagcagtggaaagccattggaaggttctaggcaggagatgacacaatcccattcccattttgcaaaaatgactctggcaattgtggacagaatgagctgaggggtaagaggggaagcagggccaccacctcagatgctgttagttgtccaggccagaggtgacagaggcttggatg

SEQ ID NO: 595248 - DNA, 302 bp, Homo sapiens
cttttttaaaacgggggcccctcaggccagccccaacaaattttagggatggccagtgccctcccattatggggcaggcccaaccacccatgtaaggttcccccaaaggtttcaagtgggtcccctctttgttttttaaacttttaaggaccggccgctttgacctttgggaatatggtaaggggatggggaggcaggggacccaaatgttccccccccagggtccttaaaaaggaggggggtttggggttttttttaccggtccaaaaaaaagttaatttccaatataagatttaagtgga

SEQ ID NO: 595249 - DNA, 780 bp, Homo sapiens
gtggactaccgtaataaccgtagccttttctttatcttggcttattccagggagggagagtcgtctagatgcacactagagtaggggctgctttcgggtttaaagatgtggcacaaggaaaacactcatagccttacggtaacactgcctaagcttcacattatgaaccaagtgacatcagaagatcatgagaaccaagtgaagctatctactgatcagacgcacacatgtgcagctactaaactcacttgatagagctgctactagcactcaatactccttttgggaagacaactaatgcaccattgacactgtgggaacaccctacaggagaatgtgctgactggtgagccaagaacctaggagaactgaatgcatattgcgaacacacatatgacaatcgctaacctaaagaatatgtgagacatccagagctcacagtcatgcacactgctcttcatgaccacagagagacattcgttgactaatactgatatgacaccgtcagactagatccttacttatatgacgcggcactcctttgctatgctgtcctcccctatgcctaagctcgagcgaacttgaaggatgcacaggattgcttacgcatgagcaacatagactctatgtagtgcctttactgcacaaatgtcggtgaatgaacctttcataggctagggcaggaggttcacctgagccctatactatccggctcttgttgcctacattcccaagggtaagacgggatcttacccgacacccgggatgctgactcgtggg

SEQ ID NO: 595250 - DNA, 1528 bp, Homo sapiens
  misc_feature (86)..(86): n is a, c, g, or t
  misc_feature (99)..(100): n is a, c, g, or t
  misc_feature (120)..(120): n is a, c, g, or t
  misc_feature (122)..(122): n is a, c, g, or t
  misc_feature (138)..(138): n is a, c, g, or t
  misc_feature (142)..(143): n is a, c, g, or t
  misc_feature (145)..(145): n is a, c, g, or t
  misc_feature (158)..(158): n is a, c, g, or t
  misc_feature (181)..(181): n is a, c, g, or t
  misc_feature (198)..(200): n is a, c, g, or t
  misc_feature (523)..(523): n is a, c, g, or t
  misc_feature (1293)..(1293): n is a, c, g, or t
  misc_feature (1347)..(1347): n is a, c, g, or t
  misc_feature (1470)..(1470): n is a, c, g, or t
  misc_feature (1490)..(1490): n is a, c, g, or t
  misc_feature (1499)..(1499): n is a, c, g, or t
actatgttcttaagatcgagagtcggacgtcctattaacaatgagaagattgatatattgatgatcgacatggatggaacacaaantaaatctaaggtnnggtgcgaacgccattcgtgngngtgtcccttgccgtcngcanngntggtgccgttganaagggggtccccctgtaccgcanatcgctgacttggctgnnnactctgaagtcatccatgcgcgatgttccctctggcgtacaaatgtctaacaattggcgggttctcaatgtcctggcaaatcgagatgcttggccattgcattgagttcaatgatccgtcccaagatctggatgcatgacaatactttcagcggaagccaatgcagcaataaggagcagaggtttacacaactgaagaatgtcatcaaggagaaatatgggaaagatgccaccaatgtgggggatgaaggcgggtttgctcccaacatcctggagaataaagaaggcctggagctgctgaagactgctattgggaaagctggntacactgataaggtggtcatcggcatggacgtagcggctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgacccaggatgactggggagcttggcagaaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagcccttcggtcacctggttggctacacagacccctcccctcgtgtcagctcacggcagcttcgaggcccccgaccaacaacttgcaggggtccctgctagttagcgccccacccgccgctggagttcgtaccgcttccttagaaacttctacangaagcccagctccctggagccccgttggcagctctagctttgcagtcgtgtaanttggccccagtcattgtttttctcgcctcactttccacccaagtgttctagagtcatgtgagcctcgtgtcattctccggggtggccaccggctagatccccggtggttttgtgctccaaatnaaaagcctcagtgacccctngaaaaaaanaaatcaaaaactcgagactagttctctcc

SEQ ID NO: 595251 - DNA, 918 bp, Homo sapiens
  misc_feature (250)..(250): n is a, c, g, or t
  misc_feature (636)..(636): n is a, c, g, or t
catctttttttttgagacagtttcgctctgttgcccaggctggagtgcagtggtgtgatcttggctttctgcaacgtctgccttccaggttgaagaggttctcctgcctcagcctccttagtagtgggattacaggtgcccgctactatgcccggctaatttttcttttggtatttttagtagaaatggggtttcaccatgttggccaggctggtctcaaactcctgacctcaagtgagctgactgcctnggcctcccagagtgctgggattagtcgtcatcttttgttaaaccaggatttgatttttttcttttcttttcttttcttttcttttttttttttttggagacagagtctctctctgttgcccaggctggaggtgcggttggcccaatctcggcttcactgcagcctccgcctgccgggtcaagcgattctcctacctcagcctcctcagtagctgagattacaggcttgcaccaccatgcccggctaattttttggtgttttagtagagatggggtttcaccgtgctggccaggctggtctaaaactcctgactgcaaatgatcagcccgctcagccacccaaagtggttgggattacggggtgagccactgtgcccagcgtgattntttctttcttgaacgcccgcttggccttggggttgtgcggaacaagggcttgtccccttttatttggcccccctttttgtgggcctgtccacccgggctcagttttgcttgtgtgctttccccgtgcctctcttgggggggcgccctttcattactggcccgggcctagcggcgggggattggccctgtgtgaggagttcggcgcgatgactcggagtcccgggccgggtcccggggcgtccccttgtctggcctgccctgaatgtgggcgcgccttcgctg

SEQ ID NO: 595252 - DNA, 182 bp, Homo sapiens
gaggtgggacactgggtggcggttggcagtggttcatctctgggaggagaagccggtcagcctcaccatccatgcagcatgtgagaatgcaccccacccaccacagagagggtgccatgaagaagatgtcgaaacggacaaatgaactgcctttaatgcatgaatgcacaatgaatgctggc

SEQ ID NO: 595253 - DNA, 225 bp, Homo sapiens
atgaaagctgccctacactgtacaaccgtaggatgcggatcatgtacttgcattgaagtagctgttggtaacacaggattgactgtgttttcagacgagctaaaagtcggccgcactataaatggcacattctatggaggatgtagtgtacattctgtctgctggtcactgactatccgaatatggatgcattgcgactaatgtaccggtatagagcattcgtac

SEQ ID NO: 595254 - DNA, 1228 bp, Homo sapiens
  misc_feature (223)..(223): n is a, c, g, or t
  misc_feature (993)..(993): n is a, c, g, or t
  misc_feature (1047)..(1047): n is a, c, g, or t
  misc_feature (1170)..(1170): n is a, c, g, or t
  misc_feature (1190)..(1190): n is a, c, g, or t
  misc_feature (1199)..(1199): n is a, c, g, or t
atatggtctaggttgaggctgtgtgaatcggagaggctccagtggtgcagaattcagtgaagcatgcgcattggagcagaggtttacacaactgaagaatgtcatcaaggagaaatatgggaaagatgccaccaatgtgggggatgaaggcgggtttgctcccaacatcctggagaataaagaaggcctggagctgctgaagactgctattgggaaagctggntacactgataaggtggtcatcggcatggacgtagcggctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgacccaggatgactggggagcttggcagaaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagcccttcggtcacctggttggctacacagacccctcccctcgtgtcagctcacggcagcttcgaggcccccgaccaacaacttgcaggggtccctgctagttagcgccccacccgccgctggagttcgtaccgcttccttagaaacttctacangaagcccagctccctggagccccgttggcagctctagctttgcagtcgtgtaanttggccccagtcattgtttttctcgcctcactttccacccaagtgttctagagtcatgtgagcctcgtgtcattctccggggtggccaccggctagatccccggtggttttgtgctccaaatnaaaagcctcagtgacccctngaaaaaaanaaatcaaaaactcgagactagttctctcc

SEQ ID NO: 595255 - DNA, 322 bp, Homo sapiens
tgagaagatgggctcgcacctcgccaaggattaccaatgcaaggaaactcatgtctcgacaacagggatagaagatttccaaaggtcttttgagttaggaagccaaggcaattagaaaggtgttccggagggttgttgaaagggggttttaaatagccaaaaaagaattttttttaaaaagcccaaaattttagcacggagggaagaaggaaaaagggtgtctccaaacagcgggttgggaaagggaggtttccaaattaccaaaaagccccagaaatttttgggggcccaactgcgctgaaccaaaaataagggggacaaa

SEQ ID NO: 595256 - DNA, 1560 bp, Homo sapiens
  misc_feature (86)..(86): n is a, c, g, or t
  misc_feature (99)..(100): n is a, c, g, or t
  misc_feature (120)..(120): n is a, c, g, or t
  misc_feature (122)..(122): n is a, c, g, or t
  misc_feature (138)..(138): n is a, c, g, or t
  misc_feature (142)..(143): n is a, c, g, or t
  misc_feature (145)..(145): n is a, c, g, or t
  misc_feature (158)..(158): n is a, c, g, or t
  misc_feature (181)..(181): n is a, c, g, or t
  misc_feature (198)..(200): n is a, c, g, or t
  misc_feature (1325)..(1325): n is a, c, g, or t
  misc_feature (1379)..(1379): n is a, c, g, or t
  misc_feature (1502)..(1502): n is a, c, g, or t
  misc_feature (1522)..(1522): n is a, c, g, or t
  misc_feature (1531)..(1531): n is a, c, g, or t
actatgttcttaagatcgagagtcggacgtcctattaacaatgagaagattgatatattgatgatcgacatggatggaacacaaantaaatctaaggtnnggtgcgaacgccattcgtgngngtgtcccttgccgtcngcanngntggtgccgttganaagggggtccccctgtaccgcanatcgctgacttggctgnnnactctgaagtcatcctgccagtcccggcgttcatatgtcctcaatggcggttctcatgctggtgaacaagctggaccatgccaggcagcttcatgattcctcccaggatcgtgtgcagaaatacttcacgggcaagcccatgcgtcattgggagacagagggtttctcacgcacaaacctggaagaatgtcgactcacagggagataatatgggaagagatgcacactcagagtgtgggggatcgtaacggcggggtttgatccccggacattcggtgggaggaatactcgataggcttgtccgagtggaagagtcagtggtatagtggagaaggtagggctaatctgtgattaccgtgtcgtggcatctgatattgagacgtgactggatcgcgcgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgacccaggatgactggggagcttggcagaaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagcccttcggtcacctggttggctacacagacccctcccctcgtgtcagctcacggcagcttcgaggcccccgaccaacaacttgcaggggtccctgctagttagcgccccacccgccgctggagttcgtaccgcttccttagaaacttctacangaagcccagctccctggagccccgttggcagctctagctttgcagtcgtgtaanttggccccagtcattgtttttctcgcctcactttccacccaagtgttctagagtcatgtgagcctcgtgtcattctccggggtggccaccggctagatccccggtggttttgtgctccaaatnaaaagcctcagtgacccctngaaaaaaanaaatcaaaaactcgagactagttctctcc

SEQ ID NO: 595257 - DNA, 210 bp, Homo sapiens
tcctgtggcttggcagcccagtatgctgcagtaacactcattcccagtgcttcactatgtgccagtggcccagaccccagaatccagaggcgtgacactaaagacatcggctaatacatagcaagatgtgtgcaaagttctgtggggagcccagcagtgtggctccacactgactcccactctggagtggggcagtgtgcatgaagctgc

SEQ ID NO: 595258 - DNA, 1470 bp, Homo sapiens
  misc_feature (86)..(86): n is a, c, g, or t
  misc_feature (99)..(100): n is a, c, g, or t
  misc_feature (120)..(120): n is a, c, g, or t
  misc_feature (122)..(122): n is a, c, g, or t
  misc_feature (138)..(138): n is a, c, g, or t
  misc_feature (142)..(143): n is a, c, g, or t
  misc_feature (145)..(145): n is a, c, g, or t
  misc_feature (158)..(158): n is a, c, g, or t
  misc_feature (181)..(181): n is a, c, g, or t
  misc_feature (198)..(200): n is a, c, g, or t
  misc_feature (523)..(523): n is a, c, g, or t
actatgttcttaagatcgagagtcggacgtcctattaacaatgagaagattgatatattgatgatcgacatggatggaacacaaantaaatctaaggtnnggtgcgaacgccattcgtgngngtgtcccttgccgtcngcanngntggtgccgttganaagggggtccccctgtaccgcanatcgctgacttggctgnnnactctgaagtcatccatgcgcgatgttccctctggcgtacaaatgtctaacaattggcgggttctcaatgtcctggcaaatcgagatgcttggccattgcattgagttcaatgatccgtcccaagatctggatgcatgacaatactttcagcggaagccaatgcagcaataaggagcagaggtttacacaactgaagaatgtcatcaaggagaaatatgggaaagatgccaccaatgtgggggatgaaggcgggtttgctcccaacatcctggagaataaagaaggcctggagctgctgaagactgctattgggaaagctggntacactgataaggtggtcatcggcatggacgtagcggctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgacccaggatgactggggagcttggcagaaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagcccttcggtcacctggttggctacacagacccctcccctcgtgtcagctcacggcagcttcgaggcccccgaccaacaacttgcaggggtccctgctagttagcgccccacccgccgcagctccgtggagatcgtaccgcttcggataaaacattctacagaagccaacgacttcatagacggacatgctgtacagctgtagactatagtaaatcacgtaatttggcccaagtcatcagtgtctgctacgcgtcacggtactaccaaggtagttagactacacagaagcctcatgtaatctatgagggtagcgacaaggataaactcccc

SEQ ID NO: 595259 - DNA, 717 bp, Homo sapiens
  misc_feature (17)..(17): n is a, c, g, or t
  misc_feature (62)..(62): n is a, c, g, or t
  misc_feature (80)..(80): n is a, c, g, or t
  misc_feature (130)..(130): n is a, c, g, or t
gacacgaccctctcacnctagcgggactccgaagtggactctaacaggtcccagtattaggngctattcttaaatagttnaattgccttgaaaagtccttacttaaagtattatttagcaaatcctggancccttgactaaaaatcccatttttactcaacttgttaagggcagataagactttggcaatttgattaactgcacaaatatgttatccaaactgagtatttattgctggtctgaggcttgccttgtttacacttaagtagatttacgttgtttccacaatggcagatatcaactttaaggatttaatagtgacctattcaataaggcaatcatcttggtagcaaacttttatttaaatcttacataactcaagctttataaaaagccaacataattgaaaattgggttctccctctaaagccttaagtattcaaagctcaaaacagttaatttaaaaataagcaaacaaataaaacaaaaaaaccctgccagcagatcctgctgaaatactaaaaaaaaaaaaaaaaaaaaaaaacacccctaaaggagcttaatctttacaaaggttccgttggctcaaaagctttaaaatcaaagtttttttaattttacaaaaaagggagagggtcttcatgccaccatttccttaaagcctcatttttttcatccaattgggccacaaataaaatttttgggggcccctgtttt

SEQ ID NO: 595260 - DNA, 813 bp, Homo sapiens
ttgtgtgcgactaaaccacgtgaatgtctctgttttgtccacaccggcagggttgtgcattgttcggctgcaagacccgcttgtttttgccgggagggttgcatggccggcgctcgacgcattccgcacttggctctcacgcgggtgtaaggggtgcttgcctcccccgtagctctgtggttgaaaaatttgtcccgcctgtctcgttggtgggatgtctgttggatgacccccgcggttttcttccgcagacactggcacggggtaaaggtgtggttccacacccctttgggccacgtgctcttccctccggatggaaggcgtttgtgcccccacctgttgtggaggggacgcgatgccggatctgtgaccactgtgttcagcgtcacgttccggcctgtccgttgtcgccctgagcttgatcacatgtgctcctggcacattctttgggcttaacctggaggacttcccggaattcctgttcagggtgtcccctccattgcctggaagaggagcctggtggctgtccagccactgggggcccaggcacaagccgtgggcacttcctcccttccactcaagcccgggctccctcctcctgtcgtgggcgtccattgtgacccctggccctcttcttatccagcaccggccctgtggcctgttcaatggcagatacccctgacccttgactccccggtggggaggtggccacaggatgctggactgaatcagaccctgacagtttttcaggcatttttatttccccatcgaattgacaaccttggcccaataaagttgaattttacccaccca

SEQ ID NO: 595261 - DNA, 431 bp, Homo sapiens
cctggagggggttttctttatttccaaacaaggggagctgcttttttcattattgctgggacctgttaattgctttttgacaatgatgatctcatggctaaaagggctgaaccccgtatccttttggaataaatcaaagttgtttcaagtcttgaggaaaactaaaaccaggggggagtattattgctagccctggctttgggttgaaaagtgggttttcatccagcttccaaaaagctttttgtcaacgttgggggacctaaacgttttaaagctttatctaatctggtttctgggcttctcttggccccatgggtcattgttttttctgggacaacaaaaccctaattttgggcgccattctgctagtattggggcaggaacaattcatatccaggggacatctgatgggcatgttcctttaaagaaaa

SEQ ID NO: 595262 - DNA, 163 bp, Homo sapiens
ttccctttcaaacccccattttcaccctgttttttcccctcccccagttttttggaaatttgtgatcgggggattttagttgcttatttgttttgactcttgtgggctgtgggccctggagtaaaaatttttggagaaaaaaaaaccgtttttttcctcttga

SEQ ID NO: 595263 - DNA, 662 bp, Homo sapiens
acatgttttaagattatagccaacatgtccagtgctatcctgatgcatagtaatcgtccgttcatagggactgtcacgaatggtcatggtatctttctctcgaaaagcctgtatgagcacgctgtgcgctagtcagagctccatcctgcacagtgtcaccattgatctcaagtacttggtcctcaaatctcagaccatccaatgaggctgtagaattagcctggactagctgacctaatataccattatctattgatttaagcctgagtccaatgtttccatcgtgatccttcacagaaatgacttctcgaatcccgtgcttaatgtctgctctgcgaattccaacatcattaccagttacagtagccaccatatagtttatactgcaaggtcttgctagcatctgcccctgaagtggtgcaccagaaaccacggctacatttgcacgtatttcttcttcatttacactcagctccatgtattgagagagctctggatacagtctggcatacagatttccatcgtgagggataggagcagaagcttctgccataactgctggattggcagggtttgcagaaaaagcagtttgagcctgaattactttgtctaccttcaagtcttcgacagatggatagagagacatttttgcagcattcttc

SEQ ID NO: 595264 - DNA, 969 bp, Homo sapiens
gtttctacgtggtagcgaaattcactcaggcaaggtgtaagttgcaacacaggctgattggtaactgttgcaatgtaatttccgccttgtttttcatgggccacgtttcgccccttgttgcgtttacccctatgcgaatccaccgaggtttcctccccccggtggcttacctctacctcatgtggcgacgtcttgttcgcaggcccatctaacttgcgtgtgtttcgcgtttcgcgcgtgccaagcaaacgagtagcatgcaaaggccgttaaagttttcgatctttctcctgaaggattcctgcccaggctcgtgacgttgtgtcttggccctttcgcgtcgcagttgtatcctaggtgactaggcctgccccacgggtcactgaatgcttcttcccgccttttcggttggatctcagtgagacctactgttcccccgaggattgcgaaactactaggatatgcctcacgttctccctaggcccctaccacgttgaggagttctctttctctatgacgtattcttaacgtgtctatcgactatgtcctcataagcgtagttgcgaatgaagatagtaagcgttgagagaggactaatgggaacgctgcgggatgaggacgagagaaacggactacatttcttacgcaatagatgcactcgctcagtgatactctcactgatcggcagcgaatgacaggcctcggctgatctcattggcgtatcataggatgacgataccatgcttgtggttgacgagtcacgggataccccggtgtctatcagctcgcgcacttcgcttacgctccttactcttaatggagccaaggatcctgctgggacctttcaatccatgatccctttaagtcttccagtcttctcccagtgtcatgctcctatcgtttccctctcttcatggttcttctcccaggtattctcttcccaggccttaacccatggttgtatacggg

SEQ ID NO: 595265 - DNA, 1581 bp, Homo sapiens
  misc_feature (86)..(86): n is a, c, g, or t
  misc_feature (99)..(100): n is a, c, g, or t
  misc_feature (120)..(120): n is a, c, g, or t
  misc_feature (122)..(122): n is a, c, g, or t
  misc_feature (138)..(138): n is a, c, g, or t
  misc_feature (142)..(143): n is a, c, g, or t
  misc_feature (145)..(145): n is a, c, g, or t
  misc_feature (158)..(158): n is a, c, g, or t
  misc_feature (181)..(181): n is a, c, g, or t
  misc_feature (198)..(200): n is a, c, g, or t
  misc_feature (523)..(523): n is a, c, g, or t
  misc_feature (1346)..(1346): n is a, c, g, or t
  misc_feature (1400)..(1400): n is a, c, g, or t
  misc_feature (1523)..(1523): n is a, c, g, or t
  misc_feature (1543)..(1543): n is a, c, g, or t
  misc_feature (1552)..(1552): n is a, c, g, or t
actatgttcttaagatcgagagtcggacgtcctattaacaatgagaagattgatatattgatgatcgacatggatggaacacaaantaaatctaaggtnnggtgcgaacgccattcgtgngngtgtcccttgccgtcngcanngntggtgccgttganaagggggtccccctgtaccgcanatcgctgacttggctgnnnactctgaagtcatccatgcgcgatgttccctctggcgtacaaatgtctaacaattggcgggttctcaatgtcctggcaaatcgagatgcttggccattgcattgagttcaatgatccgtcccaagatctggatgcatgacaatactttcagcggaagccaatgcagcaataaggagcagaggtttacacaactgaagaatgtcatcaaggagaaatatgggaaagatgccaccaatgtgggggatgaaggcgggtttgctcccaacatcctggagaataaagaaggcctggagctgctgaagactgctattgggaaagctggntacactgataaggtggtcatcggcatggacgtagcggctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgacccaggatgactggggagcttggcagaaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctggagcatgccacaggacctaagtattgtccgagcaaggatagcttacaggaagatccgcctttaggccagaggtaacgcatgtgcggcaaggctaatgccactttcgtgtacgaccttgttggtctatcacatgatcgctcctccctctccgtgtcagtctcagtgcaagctcgatggcccccggacacaacaactttgcaagggtgtccctgtcgtagttgagcgcccctagctgcgcgtgtggagttcgtaccgcttccttagaaacttctacangaagcccagctccctggagccccgttggcagctctagctttgcagtcgtgtaanttggccccagtcattgtttttctcgcctcactttccacccaagtgttctagagtcatgtgagcctcgtgtcattctccggggtggccaccggctagatccccggtggttttgtgctccaaatnaaaagcctcagtgacccctngaaaaaaanaaatcaaaaactcgagactagttctctcc

SEQ ID NO: 595266 - DNA, 1450 bp, Homo sapiens
  misc_feature (86)..(86): n is a, c, g, or t
  misc_feature (99)..(100): n is a, c, g, or t
  misc_feature (120)..(120): n is a, c, g, or t
  misc_feature (122)..(122): n is a, c, g, or t
  misc_feature (138)..(138): n is a, c, g, or t
  misc_feature (142)..(143): n is a, c, g, or t
  misc_feature (145)..(145): n is a, c, g, or t
  misc_feature (158)..(158): n is a, c, g, or t
  misc_feature (181)..(181): n is a, c, g, or t
  misc_feature (198)..(200): n is a, c, g, or t
  misc_feature (523)..(523): n is a, c, g, or t
actatgttcttaagatcgagagtcggacgtcctattaacaatgagaagattgatatattgatgatcgacatggatggaacacaaantaaatctaaggtnnggtgcgaacgccattcgtgngngtgtcccttgccgtcngcanngntggtgccgttganaagggggtccccctgtaccgcanatcgctgacttggctgnnnactctgaagtcatccatgcgcgatgttccctctggcgtacaaatgtctaacaattggcgggttctcaatgtcctggcaaatcgagatgcttggccattgcattgagttcaatgatccgtcccaagatctggatgcatgacaatactttcagcggaagccaatgcagcaataaggagcagaggtttacacaactgaagaatgtcatcaaggagaaatatgggaaagatgccaccaatgtgggggatgaaggcgggtttgctcccaacatcctggagaataaagaaggcctggagctgctgaagactgctattgggaaagctggntacactgataaggtggtcatcggcatggacgtagcggctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgacccaggatgactggggagcttggcagaaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctggcgctacctagaggctaatgcttggccggtacggatacttcagagactcccctctgggtccaggtatgctgtggtgcagtgcccacgacccttcgggtcacctgttggtctacttcggtaacgccctccccttgcgttgtcaggctcagggcagcttctgaggccccctgatgcaaggggttgcacgtgggttcactggtctacgttgagcgctcccacctggccggtggggttcgtccccgtgtccttagaatctggcttacagaagcaagctcctgggagccctgtgtgggggttccaggcttggcggcctggtattgggccagtctttggttcttccctccctttccccattgttgaggctggggtccggccccggg

SEQ ID NO: 595267 - DNA, 478 bp, Homo sapiens
ggcacggtcttgcccagcaggagttgtcttcgaccgtccgcgctttcatgcgtacttccctagatcttccccatccgaattgcgccagttccaacgtatcactccgtttgttcgccggcacagcattttaaggagacccaccgcacgtcttcgaccacctcgataacacccccctcagtagtcactaggccagccgggatggtgacgctgcccgcgctggcctatccggcgctgttcatcgccttcgccctattcttcgttctgcctctgggcttccacggcctctgggtgccggatgaaacgcgctatgcacaggcggcccaggagatgctgaacacggacaactgggtggtgccgcacttcatggggctgcgttatttcgagaaacccataggaggctattggctgatcgcgatcgcccaggcgctattcggcgacaacctcttcggtacgcgcatagcctcggcgcccccggccg

SEQ ID NO: 595268 - DNA, 394 bp, Homo sapiens
ctgtcaaatcattcatcgtatttgtggtttatagctattgtaaatggattctgttcttgattcttttttagaaaattcgttgttggcatatagaaacattacggatttttgtgtttattatgtatacagcaactttactgaatttgtttattagttccagtagttttttggttgattctataggtttttttataattaagatcatgtcttctgcaaacagagacaacttgactctcaatttgacaattgaggagcatgtcatttaatttccatgtagttgtacagtttccaaagttcctaatgttattgatatctagatttttttcccttgtggtcagaaaagatacatgatatgattatgatttttaaaaatattgtgaagacttttttatga

SEQ ID NO: 595269 - DNA, 1152 bp, Homo sapiens
ggccaaggagggctcaggccgagacaacttggcagtctgccgccgtcggcatcgagctcggcgcttgtgctcactgatccgcctccatgggggccaccgtgcatgtcgatgccgccggtgggaacgaagaatgtccatcaagatgtccagtgtctgccactagtcaggaggtcatcctctcccccgcttgcgtgcgctgtgaatgctgctgcgctacatctaatcaaaggccactccacaagtatcatggattggagtgggcggcacccgtgctacgatggccgaccgctccttggcatactacccatgactggccgtgaagaattcatggcagcatgcgcctgttctcaatattgcatgggcagaggactatacaatgcagagggcacggtggtcacgagcctcccgagacactatccatgactggggctgtggcccaaatttcgatggaatgaatgcctgaccatcagccttgcttaacaacggaggtcaccactattatgcctagataggggcgcgcttgtgttaacgtcacaaactagttcaagctcccgaaggtttggcattacgtcgacaggaaacgtcggtgcggaattgcaaaatggtaaacacagttgggaaagtccatgcaattcaaactagaacaacgccccctcaaagtgtcataaaacacagttgcccataggtttctttcccatttcacctatgcagaagaaaaggccgatttgatacttcttagagagatacaccggcagttgacggagccaaaggaaaatacgggggtgggccccgtgtaagttaattccaatgaaaagtgatatgccattgggttggatagtccacggttaagcgggtcaagcctcaagttaggccgaggatagtaggctcactacacccttgaacgggaggctatcacacccagttgcccagaacggcggtttttccaccaaggtccacattcgttctcaaacgcaaaagtaatgccattcttttccccttttggtggcccagaggaacggcgtttgacacgccttttaagtttccaccaaatgtttgaaccgccaacggtacaggtattaaagccccgtggcgtttctagaacgcggttggggaaggggcccagttaaacgttcaaagtcccgttaaacacca

SEQ ID NO: 595270 - DNA, 117 bp, Homo sapiens
cgagcgaagggataggaagtatcgacgtgcgaaggataggaagtatcggcgtgcgaaggataggaagtacccagcttttgttcccctcttcgttctgcatcgtgttgtagcccttgc

SEQ ID NO: 595271 - DNA, 281 bp, Homo sapiens
agaaggatccccgcgaaaatgcggcggatagaatcataattctaatggtcaccttagagtatattatgctggcattctggaagcatctgctgctggtatttctatgttattaaagccatttacagaaagcccagcatctttctcatggagattcttattccacatgtgtcttccccgtgattccttttccacatgtgatggcctagagctccttctcaaattaccctgaggttgctgctccagagacatgtttgctgtcgccaaggctactggccctttgt

SEQ ID NO: 595272 - DNA, 752 bp, Homo sapiens
ttgggtcgttacccgccaattggaccattatgaccgctattattccagcaatcagcagagttcgaccaaacatggatcatcggtgttaacaagttatcgatatttgctgactactgttaggatcatttgactgtactagggagatcttactttctagctgatagtgcgtgtgacaggacctatgtttgtgattctgattacttattgagattatgtgaatcttaaagtgctgtatatatcacgtgaccgtgctgttatgacatgattcgtagatctagtactagatatttaattagtgagtctttagcgttttgagctgctgtccttgctactcgtgaggctgttacaggagaacgtcatgaacccatgtggaagagctatgagtgagctgagatagctccactgtactctagcctgggtgacctgagcgaactccgagtcatatagatcaaagttaactagccaggctggtgcacgcctgttatcccagctactcattaggctgaagcagtagactatctagaagctgacagtcagagcttgccagtcgagctgacattgttccaattcccttcgtgtgcacaagaatgaaactctgcctcgcaccatactacgggcccagccatctccccactaaccatgtaatttaagcgatacgtggccattatctaacttaggctgcttcggcggttcaaggcataactttctcgacgcccccatttatgccgtttaccgactgtctctatcaccct

SEQ ID NO: 595273 - DNA, 446 bp, Homo sapiens
gctcgacagggaggcctgggcacaagtaagctcgtgtggattagtgcagaggctgggtacagtggctcacgcctgtaatcccagcactttgggaggccgaggtgggcggatcacttgagatcaggagttgaagaccagcctggccagcatgatgaaaccccatctctactgaaaatacaaaaattagccaggcgtggtggcatgcacctgtaatcccagctactctggtggctgaaggagaattgcttgaatccaggaggtggaggttgcagtgaggcaagattgtgccactgtactccagcctgagtgacagagtgagactctgtctcaaacacacacacacacacacacccaccctgaccaacagtgtgaatccccgtctctactaaaaatacaaatgtgagccgggtgtggtggcgggtgcttgtaatcccagctactccgga

SEQ ID NO: 595274 - DNA, 1376 bp, Homo sapiens
ttcgcttctgggtgtctctgtgggtctgagtcgttcgaagttctttgtcgctcgtcgtctgggcgaggtgcgctttctgtttcgccttgtgggtggcctttctgtgcctgttctgtgtgtgcccgctttgtcgctttctttccttggcttgcttggtttttggagcgttttccccggttttttggtttatggcagtcacctcttgtgtggtttcttttcctcgtggggttctttgccacctggttccttgtctgagttttctccttcggtctgtgatctgctcgatgtatcctcggcttttttcccttggtagtcccctttcggtgtcggtatccctcgggctctgggggttctgcttccttccttttttctgtctcgctcctcgcagtgtcattggcagttttgtttactctgtgtcttttctctatgatggacttgtgcgctcatttggcgaggttttggccctatgccccttggggtgttgataggccccatctattcgctctcatctgtggtaattgcacaagctagcccgggcttctggctcggcgttttactccccgatttgcctctgacgtgagccgcgcgcggttgcttgctcctgggaccgttctccgggttctcgcgggcttggcctactgcgattcgttcgcccgtgtcgtggggtccccaaggtctgtggcgttgcatttgcgtgctttgggtgtccttgcaagcggctcgttccgatcgttagctaaggataccttctgggcgcttttctaggcgcttcctggagaattgtcccaacctttgctccccggagtacgtgtaacctgttttcctttctgtggttctctggcgtcgctagaggacgggcatagtcgtggtgtcaatgtatacgtcttgctggcctctgaggtgtacagggccctacccgtggcgcatcactatgtatagatgcctattaatgagcgatggtgcacggtggttattcgagttttgtcggtgttgcagcacaaactgcataggcacgcatcctggcggtatttcggctactaccttgtgcagagccagtgtgtctgtgggatatgtgctgcatcttgcccagtggtatgaaaacctgtgcagaactttccagacgagtatatcagaacacacccttccaaggtatgtatgactctgtggttcctgtcctgtcttcactgagcgcagggctggaggcctcgttagacagttctgccgttggtccgtcgcttgcagctgccctacctgtagtatccacagtgcccgagttctcgcatggttcttggcaagttaaacggtccttcctaagctggtttagactacacttacaacaaggaaaatgcccctcgtgtgaccatataattcacatg

SEQ ID NO: 595275 - DNA, 614 bp, Homo sapiens
cgggaagatggcggagctgcggtgctcgtagctgtcaagagggtcatcgactacgccgtgaagatcccagtgaagcctgacatggacctggtgtggtcactggatggtgtgatgcactccatgaaccccttcttgtgagatctgcgtgtggagtgagtgcttggtgctggctcaatggagaagaagcttggtgaaggaggtcatctgccgtcagctgtgggcctgcacagttgccatggagacgattcgtaccgccctggccatgggtgcatgacctgatggtgtccacgtggatggtgcccccagcagaagcatgaactgcttgggtcccctgcaggtgtgctcgggtcctggccaagctggcagagaaggagaaggtggacctggtgctgctgggcaaacaggccatcgatgatgactgtaaccagacagggcagatgacagcttggatttcttgacttgtgccacagggcacattcgcctcccagtgtgatgcttggagtggggacaagtgaaagtggagcgggagatcgattggggcctggagaccctgcgcctgaagctgccagctgtggtgacagctgaactgaggctcaaagagccccggtacgcca

SEQ ID NO: 595276 - DNA, 437 bp, Homo sapiens
  misc_feature (1)..(1): n is a, c, g, or t
  misc_feature (3)..(5): n is a, c, g, or t
  misc_feature (7)..(7): n is a, c, g, or t
nannntntacactccaaacattttttattgcaggaaacaaaaagcacacaacagcctgtacatacatacaaaatactaactatagacagacaaatgtagaacatgtcatcatgttccttagtgtaaaacctaaacgatctaaaaaggatcatacattaactgtacaacacagtgtcatacagggataatgctatcatatttaatatgaaacagtgttacgggcacaaattacccatttctacaaaataagtgtgcaagtgatgccacatattatccatattcaactgagctgtcatcaaaatacattttatttacaatatgtactatgatcagttggatattaagttctaaaatgatttacttcactgctacattataaaggtaaaagccatgtgtagaaaagtgtgagattatgtttttacatactgcttgtgtct

SEQ ID NO: 595277 - DNA, 383 bp, Homo sapiens
  misc_feature (141)..(141): n is a, c, g, or t
tgaggatcccctatgtctcgatcgttactagtctcgatcattagaattaaataaaagattagaaattagaatcaagtgtgcagcactgtggcaaagctctcattccccattccctcggttttcacagataccctggaaatngaacctgaaggataagaaaaggaaggcttgtactagttcatatacacagccagcactgagtccggaacttgaacccaggtctatctagaacaaaaacctatgtttctccactccgtaatgtagttctctcaggtagttctaagtgggagatacctgctcccagactttttttctaattttttacattagctaaacttaaatgacaatatgaaatgttacaaataactaacgatcgagaaggg

SEQ ID NO: 595278 - DNA, 517 bp, Homo sapiens
  misc_feature (1)..(1): n is a, c, g, or t
  misc_feature (3)..(5): n is a, c, g, or t
  misc_feature (7)..(7): n is a, c, g, or t
nannntntacactccaaacattttttattgcaggaaacaaaaagcacacaacagcctgtacatacatacaaaatactaactatagacagacaaatgtagaacatgtcatcatgttccttagtgtaaaacctaaacgatctaaaaaggatcatacactaactatagacagacaaatgtagaacatgtcatcatgttccttagtgtaaaacctaaacgatctaaaaaggatcatacattaactgtacaacacagtgtcatacagggataatgctatcatatttaatatgaaacagtgttacgggcacaaattacccatttctacaaaataagtgtgcaagtgatgccacatattatccatattcaactgagctgtcatcaaaatacattttatttacaatatgtactatgatcagttggatattaagttctaaaatgatttacttcactgctacattataaaggtaaaagccatgtgtagaaaagtgtgagattatgtttttacatactgcttgtgtct

SEQ ID NO: 595279 - DNA, 663 bp, Homo sapiens
agaacccgacgacggatttttgtggggtgaaccgaagtgagcgcccggaacttgttgctgtcgccgcgccgcgtggaccccctgcggacaggagggttaaaagagggggggcctaacccaacatacccctgtcttttcccctacctgggggacccaagcctgggtttgatacaggcgaagggcaggaaaagggtgaaacccacagaaccacatcgggaaaagggcttcgcggggaactcaaaataaggtcggacagggttgtacaagtagaatatctaaaaaaacaagaacgtgggatgaagcgaacaacacccaaggaacacgccacttgttggaaaaaaagaaaacaacggccaacggcccgaggtggccagaaaaggggaaacacacccctacggcggaaaagaaagggggggattattcgcacgcccgaacaagagaaacaagagccggcttggggagcgcgagttaccacaacggcaaaacaagcgggatacggacccaggcggtggggggacgaaaaacccagttaaaaaacgcaaaaacctagacagcccgcaaggaccccccacccggtccccgggaaacgaaaaagggaccggaaggacaccctccacctgacactcggccccgcgccaatgggcaagcaacacggcaacggcg

SEQ ID NO: 595280 - DNA, 249 bp, Homo sapiens
  misc_feature (18)..(18): n is a, c, g, or t
  misc_feature (77)..(77): n is a, c, g, or t
  misc_feature (231)..(231): n is a, c, g, or t
  misc_feature (239)..(239): n is a, c, g, or t
tcccaaaaatgctcgggnaagaggtcagcactaggagcccagagacaggctctgaggattcttgcccctgggggagncagaggcacctgccccatagccaccctacctcgttggaggggcagtgatactgtgtgttggggccactggactggctcccagtctcagcccccaccacacctgccctccagtccctcccctaggcttgctgctgccaggggttctgcgctgcanctggccgnatcccttgcc

SEQ ID NO: 595281 - DNA, 541 bp, Homo sapiens
tggccgggggggggaaaaaaaatttttttttttaaaaaaaaaaaaaaaaaaaaaaaaaggaagataattaaaaaaaaaaggaaagccccccccaaaaaaaaaaaacccttgtggcccgcttggcccaagccaattttaaattgaacaaagttaatgattgcgcccaaatttgagcttaattggccaaattcccctaaaagggggtggaataaaaataaatggcccgggttttaaaaacgtgggaattggaaaaaccttggggtaaccaaattaaatgcctttgaaaaaaatccccttttcccaagttgggaaaaaaaaaaaaaggcccgaacgaaacgcctttccaaaaatttgccaaccctaaatgcgaaaggaaaatttaaagcgtaaaatttttgtaaaaaaatcgggtaaaatttttttaaaaaaaactaatttttaaaccaaaaagccaaaaaccgaaaaatcccttaaaacaaaagaaataaaccggaaaagggttaaagtttttcccaattttgaaaaaaaaacccctttttaa

SEQ ID NO: 595282 - DNA, 955 bp, Homo sapiens
  misc_feature (67)..(67): n is a, c, g, or t
  misc_feature (69)..(69): n is a, c, g, or t
  misc_feature (228)..(228): n is a, c, g, or t
  misc_feature (232)..(232): n is a, c, g, or t
  misc_feature (286)..(286): n is a, c, g, or t
  misc_feature (332)..(332): n is a, c, g, or t
  misc_feature (377)..(377): n is a, c, g, or t
  misc_feature (388)..(389): n is a, c, g, or t
  misc_feature (418)..(418): n is a, c, g, or t
  misc_feature (420)..(420): n is a, c, g, or t
  misc_feature (431)..(431): n is a, c, g, or t
  misc_feature (487)..(487): n is a, c, g, or t
  misc_feature (509)..(509): n is a, c, g, or t
  misc_feature (544)..(544): n is a, c, g, or t
  misc_feature (595)..(595): n is a, c, g, or t
  misc_feature (633)..(633): n is a, c, g, or t
  misc_feature (822)..(822): n is a, c, g, or t
  misc_feature (837)..(837): n is a, c, g, or t
  misc_feature (852)..(852): n is a, c, g, or t
  misc_feature (858)..(858): n is a, c, g, or t
  misc_feature (932)..(932): n is a, c, g, or t
ccccccagcaacagcagggcggtgccacattggtcctgagccaggcctggccgccggtgacggccgnanctctctgggaggccggcggtcctcgggtgtagagggagacagctgcccgggggcacgggcgagcgcctctgggggtcctggatccgagacccgcggccccggggtgagggtgacgcctggagtcatgcgtggcttggctgggccgggctcttggggcanccangcgccgctgccggcgtctaggccacaccaccctgaacgcgcccgctcgcctctnatctgttgaagctaagcagggtcgggactggttagtacttggatgngattccgcctggtaatagcggtaccgtagcttttggcttcccgcnccctccttctnncccccttttttctccgtgcttcccaactncnccccgcctctnctccccgttgaccgcccccgtgccccagccgaagcccaggacctcctcctgaaganccgccactgcagcaccgccagncagcagcatcccacctcttccgactcgcggcagcnccacccaacccgggcgggacgggaccgaccccgagggtgcaggcgcgggtnccctgaggtcccgggtgtcttcacgctcctcggactcncaggcaattgtattcattcattcagcgtcactgcaaccgtccaagccggtggaaggggcgagcaggggcagcgggtgccacagaccccagccaagacctccgctccagaacccgagggctgctttccccagaggaaggacattttcttcgccagccacgaggaaatccgtgcttgtgcacctgtgttcncaatgccaccgactncgtgtaactccagtncggagnagtgagagagaccaggcttcgcccgtggacacgctcggcgcacggctccgccaggcacacgagcacatctacantctcggggccaacgcatcaagga

SEQ ID NO: 595283 - DNA, 249 bp, Homo sapiens
  misc_feature (9)..(9): n is a, c, g, or t
  misc_feature (36)..(37): n is a, c, g, or t
  misc_feature (49)..(49): n is a, c, g, or t
  misc_feature (199)..(199): n is a, c, g, or t
  misc_feature (228)..(228): n is a, c, g, or t
  misc_feature (237)..(237): n is a, c, g, or t
tttacccanatgaattcattatataaattttttccnncttagtgtttcntttacataatagtagcccagttaaaaaattgtacttcaggccaggcacggtgggtcacgcctgttaatctcagcactttgggaggctgaggcaggaagaccacttgaggtcaggagttcaagaccagcctggccaacatagcaagacccnggctctctataaaacagaaaacgcaaacnttaatattntcaacaatcaat

SEQ ID NO: 595284 - DNA, 135 bp, Homo sapiens
tattaaaaaaattaaggaacaacagtttaatttggtaatagtcccaaatcgggaaacaactaaaatatccttcaataggtacatggttaaaccacagggcacatcaatcaccagttaaaccagggggcacatcaa

SEQ ID NO: 595285 - DNA, 107 bp, Homo sapiens
caacacccgctaggtactggtggtccccgctcccgggaggctcaccatattgatgcgaacttagtgcggacacccgagcgccatagcgcactacagcccagaactcc

SEQ ID NO: 595286 - DNA, 156 bp, Homo sapiens
cagctgcagctcatgccaccctcccgtctgcctcctggttctcttgcctgcccagggccgtttgctgggtgaagggcatccccaccatcctcggcccatttccgtttggggctcagccgtgcgccctgggctccaatcgctggcaccccttggtga

SEQ ID NO: 595287 - DNA, 145 bp, Homo sapiens
gtcgtaccggcgactccgagggagaggagggaggcggcccagtgtgtgcacactgacacaccacaaacacaccaagaagcagcaggaaaccaggtgtgcacacagacaggacaaagaggcagttcacccttagccaaagttgcca

SEQ ID NO: 595288 - DNA, 627 bp, Homo sapiens
acagctgttgttggcctactgtacccctgtatcgacagtcacctcggagaaccccacaaatttaagagagaatgggccagtgtcatgcgctgcatagcagtttttgttggcattaaccacgccagtgctgtatccttaattttctgtgctacgtccagagtatcttcttaggttatatattgaagcgttttgttttgttatatactcaaatgactccatgtcataatacagacatgatggtggtacctacccatttcagattactaaaaagagaaagaagaatggggctatcgatgacttcatagtaaaatatattgttttatggtcaaaataaatatatatttatttatatttttatatatattatatatatttttaaatatatatataatatatataataaatatatatttatataaatatatataagcactttatatatagctttcagcaagtttattcttatggttaagtttttgactcagtgatggcagggagatttcaggtgatcttaatgattactgtaacctgtatccaacaaatcctttctttagctcattacacagtttttatggacagtgaattatctgtggtacaataataaaatacccaaattatttaaaaaaa

SEQ ID NO: 595289 - DNA, 166 bp, Homo sapiens
tgtgtagtagcatcagtattggcttgtagtgttttctcgttatttactgtgatttgtcgaattcacattatgtgactttcattgaagacttgggtactttttcaaagactgaaatttcaatataaagtattttgggttgtagtaaaaatatgttgtaggaatgaag

SEQ ID NO: 595290 - DNA, 277 bp, Homo sapiens
tccacccatcagacctgtgagaaagatagtgatatctgatcatgaaaacgtggttactatcacagagagggctcccagaaagttaatactgtggggtgaggttaggatagcgatgcttgctccaagtcatcaaaaagctatcagtgggagtagagttcgaagtccttgagagaggattatgatgcgactgtgagtgcgtacgtagtttgagtttgctacgcagactagtaatgagcgatgtaagctaccgggcgattatgagaatgactgcgccggt

SEQ ID NO: 595291 - DNA, 240 bp, Homo sapiens
tcataggatttcctaatataagcatgccacgtgaatgaaggagaatggccaatgtgactccctagtttgtctgcttttcatgctgttggggacagattatttagggctgctgcttagtaaaggctgcttttccatttggagcattttctaggaaagcaaagattatttatattaattcgatacacgttttttctccagactattcatatcaaaatttcttcttgtgcacaaaagtgtgca

SEQ ID NO: 595292 - DNA, 466 bp, Homo sapiens
ttgaagtgccacggggagaaaccaccgacctgtgggctggacctacagtacacttgccatacttgcttgtacctgtacttgcttgtatgttctgaggccttggagcccctcctgttgaggcagataccttagggcaggtttgtatggtcaggtagtaggaccaactgcttttgtctcccctcagtcttgctcctgctttaggggcttacaattaaggaatggctcccaggggtcataatgagtaagtacctttcacatgttagcttcgattcacagggcagaatttatccaaaatgtcattttaaagggcccaaatggccaccggtaatttgtggtcactagaatccatgggagtcttaaaacctttagaatacatgtactcagggtctcttctgagaatttgcgagtagatcgatagcagatgatgagaataaacgactgttgtctctatagggaaactcttccc

SEQ ID NO: 595293 - DNA, 343 bp, Homo sapiens
aactggaatttaatttccattcataaactactatatttcccctcttgcaaatcattttatgtttcatcggtttttcccttcgggtaaatctttggttttgaaaacccacatttaaaaagatggtattttatcttttaaacttaaaaattatttaaaacagctatatggcccttataaaattgattttttatttattattagcccttactactaaaagggacatctaactattcagggacatttttccctttccaaaaaataaaatttattatgctttaaaccctcttctggattttttaattttttcattgtctttgataaataaaacagttttgttttgcta

SEQ ID NO: 595294 - DNA, 340 bp, Homo sapiens
accccgtttacaacagctgggggtgtactggcttcgacatacaaaaggatataattgcagtggtcttgtaaaccataagacaatttctttactaagcggaaaagaaaacaaaaaagaagattattcattattaatgaatgcttcaactcaatcaaatctagcttttgcattttaaaaaactagtagaccaatttgcttctcacgaattgtaatctttatattagagaatagttaaaaatctgatcactttttaatgaatttatagatcacaggcttttttaatctttttgttattttagatcaagagtcttcttaaaaataactaaactgttgtaactgg

SEQ ID NO: 595295 - DNA, 582 bp, Homo sapiens
acaaaaatgagttccacaaagcatgtggagctttgatatatccttattaagggccagtttctgcgaatgcccttggacaaacacatggaaatggagaacactctcatcagatcttgactggttcttatgataagacttctcggatctggtccttggcacggacaacgtcaataatgacaatctgtgggacatacggatgttgtaaacgatgtggcctgggctgaaacaacgatagctttgtcctgcttacttattgacgtgcttctatggactcagactattctcttactgggagtggaatgtagagacgaaacaacagtgaacacgccctacactgctgtaccagcgtcatgctggacgctgtagcattctatacgctgcttgatggcgtcagcgaacctaaacttccgcagctggactccatgggcactacatactgcatacacgactctgcgtctacacgctcccataccagactgaacgaccgcatgcaacttgtcacgcgatctgacacccacattcgtagcacatgacaagcacacccagcaacatcagacacccagatcgaggcactacacaaac

SEQ ID NO: 595296 - DNA, 115 bp, Homo sapiens
ctagaggattccctcgctttgagctccacagccacaaaggtgcatcaagactgttgtgagaggaacgcaagcgaggagtacctgctttgcttcagccacatgggactgtacgtgg

SEQ ID NO: 595297 - DNA, 182 bp, Homo sapiens
  misc_feature (123)..(123): n is a, c, g, or t
tcagagctggttttctcggaggaacgttctgggctggagctttttactcgcggcggtgatctttttttgctggaactttagcagcagcagaacagcagcagcagcaactcccagttacttgtncagtccaggtgcaggtacagcaaaaaaagatcaccgccgcgagaaaacaggctccaggg

SEQ ID NO: 595298 - DNA, 597 bp, Homo sapiens
tatcctagccgcgcagtggtcctggtctataagagagtcgggggtgaaggctggtgagcaggcgcaggcaggtgcagctggaggagcagggagggctgcgtgtgggaggggaccaggacttccaggcctcagcctcagcctctcctgtggggcacccgggtccttttgagacagaggtggctgagctgccccggcaggccctgggcacaagtctcccttcagcccccaggcaggatgccaggctgggtggaggaggcaccgtggccttgacatggacttctaggctcacttccttctccaccagctgctgtcttgagaatgtgtgtttgtccatggctgaacatggtgagattcctatgcatttgcctgtcagagggccagtggggccagaagcctcctgcagaggctaaccccggtgctcccagtctcccccagtcgctggctgggcagggcagggtgctggttcccccgtgtttgtttgtggtgagagaagggccccaccaaggtggggtcagaacccccaggtgtgagtctgccgccctggcctgcggatggagttgccgccctgcctgcggatgggagctctcactccgtgaa

SEQ ID NO: 595299 - DNA, 204 bp, Homo sapiens
gtgaaccatgctgcagtggctgtcgggcattgtgtatactccttacgggggtaactgctctggtgaagactatgagacactgcgtcatatatgatgtgcacattttcaagtgcattgtccttgctgttggacaaatgctgcccccggatgaagtcttgccatcctgtggtgcaatgctcctgtaggtacccgtacagtgctgct

SEQ ID NO: 595300 - DNA, 272 bp, Homo sapiens
ccacgctcgccccctgtactgggaaggccgccacgctcgccccgtgatggggaaggccgccacgctcgccccctgtatggggaaggccgccacgctcgccccctgatggggaaggccgccacgctcgccccctgtagggggaaggccgccacgctcgccccctgtactgggaaggccgccacgctcgccccgcgatggggaaggccgccacgctcgccccctgtatggggaaggccgccacgctcgccccctgatggggaaggccgccacga

SEQ ID NO: 595301 - DNA, 949 bp, Homo sapiens
agtggacttttatgggtcatttacgggcttcgagtatgcctataacgccaacggcttaaccctgcgtatgtacttggactaagggttgctggttcattgtgggccgtccttgatgtgtattgcctaaggggcttttttcaaagcgtctgtgtaccaattgtcataggctaggataccattgaagcctgctatttctcgcgggttttgctagccgctccttctaggcagttcgtcgctttcgccgatgtgctgtggcccaagctattctagagtgccaattcctcaaggtagccaccatactgcatcgtttctcgtcgcgtccatggcacggagagacgcctactatacgcaatcttacaaggggccgtacttgcctaggtctcctacgcgtcccgcaacacgttccatcacggctccctgcgtctggtacttggcagagcacctgctctctgcagggttgccctgtccgtctacatgggctctccacagtcgtgccacctgctggtctccaggtagaagctaggggactgaattggcagtcacgctgccccgtgcacattacttgcttctgctgcgtctgcctagtaacgcatagtgtagcagccacaattgctcaaccatacagatcaacctgctgattgtgacatgcatgatggtaatcaccactggagcttgcactggttagcataaattaggaatttggttgcctccagtgttctatctctgagggctgagcattatagagaaaagtgacctgctgctccgtttcattgcagaaaattgcacaggggcttatttcagaacaagcttccacgtactgtccactggctctcaaagtactttaacttataagtgttgtgaacccccacccaggcaagtatccaggaaagcagcaagtgacgtagtcctagtgatgtaccaaaacctctatcggctgtgaatgatttcc

SEQ ID NO: 595302 - DNA, 185 bp, Homo sapiens
  misc_feature (171)..(171): n is a, c, g, or t
gccccaaggttcccccttaaaaggggttccccccccaaaacccgggggggggttaaaaaggggtgggggggccccccctccccaaaattttaaattgaaaaagggggccccaaaaaataaaaaaggggaaaaaggggggggggccccctttctggggggaccaaaaaacgnttttttttttttta

SEQ ID NO: 595303 - DNA, 109 bp, Homo sapiens
gaccagcctcgctcagcaccttctctcagaccctaggactatgaacgtgatgctacgctgaagtctctcaacgagcatattgagaaccttcttagtcctgatggctcta

SEQ ID NO: 595304 - DNA, 153 bp, Homo sapiens
ctgcaaaccctgcaacccatgacagagagccctcgaatcactatgcataaatgcaatggagatcttgtgcttggatgactgatccttgcttaaaacagaacagtgacaactagaaaagaaaaccactccaatatcccacgagcttctagtgca

SEQ ID NO: 595305 - DNA, 224 bp, Homo sapiens
aaggcgcacgatgggcgtccacctgagcccagacaccaatggaccggtgcgcagcatgactgtggtgcctgtacttggaggacctgcacggcgcggacgaaggacgaggacctcttcgacatcgaggatgacatcatctacactacaggacttcacggtgcccggacaggtcccagaagaggaggccatgtcacaagtggacgcgccatcgtgcggcttcgggt

SEQ ID NO: 595306 - DNA, 110 bp, Homo sapiens
actaatgcccggcactttagttatgggcggccatcttgcatcaatgcccggccatctttcactcaatgcagcggcatctttactaatgcccggcatctttgactaatgac

SEQ ID NO: 595307 - DNA, 622 bp, Homo sapiens
ttaggtggtaggatgtcttggcgttatgacgtctagtctgctatgaactgtgatctcaccactgtactctagtatgccagcagagccataacctgtctctagtcaaccggtaaactctggactccaagatctcgagtgagctgctctggtgatcagtattggcagtacttcgtgcatgttgtcacatgctactgtgagaatcaggtgctgcatatatggctccactgcaagagggcagatgcaagccgtcgcctcatctgtagtggaacgtgtctagtgcacctcctccctatgctgatcttaatctctgtccatgtactgtaataatctgtaactgtgagcctagcagctttcctgagtccagtgagtccttctagccaagaggtctggcacaggcacagaggctggtctctttgaagtgggtcttcatccattggggtcgggtccaactctgaaggcccacgtccttgccagctacagtctctctcccctctcagtgccgacgctgtcaccatgtgccctctgtctgtggatcctgggaaaagctgttctctctgctcacagctgcataggagacatgcccattagctgaggcgctggcatgctctgaactcgagggtca

SEQ ID NO: 595308 - DNA, 598 bp, Homo sapiens
gtgagatgttgccagctctggataggttcgtgagcatatgacaggcatgctccttagaatatcaaagatcagttaatacaattggccctgtgatgaatgaatgccaaatggacaaatataagaatctaagaacactcagagcactctcccatgatgagatttctacgtaagtttccattttaatcacaaattcaattcagttgcctagtatggaatatcttcatgccagagcaaagctgaattcatggtgactctaccaaggatgtatgaattgaggtgagggacaggcatggttgtgatgatgattgagttgactgaagtactgggtggggtaaagagaagaggacctgggtccaaatccccagtgttccttcttagctaagtgaccttgggtgtatggtacaaccctgcagagctcctgttgccttatctgtagaatgttggttttcatccttccctcccaacggctgtgtggatcactgaaaaagcacctaacacagtgtctgaccatgcactaggcatgctggaaatatgtgactcagaaatgcacggggttacaagaggacagatcacatacttgcgagggtccgagctcgat

SEQ ID NO: 595309 - DNA, 370 bp, Homo sapiens
gtcaacctcgccagtcatggaatgagacatgagtggaattaggttgccagcttctaggagctctgggagaccccaaccccctggcccatccctacctcccagaacctcactggctctgggcgtggctgggcactggtgattggagaactcaagcggcatgatgcagcctcccagaaatgatttctagaacagggcagacgtgatacttggaggctgggctttgagctcggtcacctttgcacccagcttgggagtgagagagtttaaggtcatcctccctcaaagccagtattccatatccagattatttctctccattccaggaagtttgcatagctccctggacttctgctttgcacttgcctgcagg

SEQ ID NO: 595310 - DNA, 404 bp, Homo sapiens
gatcagagtcatagtacagaagacatgtactgtcataccccagtacggtgggcacagcaggaccagcaactcagagcataaaaatcaaaatatactccctgtgaagtccaaatcagtgaggtagttcggcacacacatttacgggatattctacgccaagccaatgaaattcaagcatttgaaagtttccgagttacccatcttttttatggtaatacttgtctttttccaaaaaacaccaaacaaacaaacaaaaaaaaacaaaaaccaaacagcatctcactctgtagcccaggatgaagtgtagtgatgagaccagggctcactacagcctcaaactcctggactcaagggatcctcctgcttcagcctccctctaagtagctcgagctacaggtgcaagc

SEQ ID NO: 595311 - DNA, 1062 bp, Homo sapiens
gcatggttccatcatggcgtcaatgcagacaacgactcacagcacaagcaactgttggctttgcaacatgcacccacctccgtgcgcaattgcaccttcaacatgcagcacagcagtgttccaacacattcgaattaccaccagtggcattgtagcaccatggcacaggtgccaccaggttaccgttatcatgcacaggggccaacacacattctccaagcttcgtcaatttcaacatttcagtcagtcggcatcatccgtttttgcacctctccctccaggtcaatggtttacatgtgtgcaccaactattccgtgtttcaatcacatcagtgtttcatagcccaatgggtccactatcgtgctattatcgcaagtttcctaaaccgcacagaacgtgggtcccccaagtcagcttcttccagtccaagtccaggctcatgaggtcataccaggccactatacatgacaggccattggccttatatcccgaagacaattggcccacggggcacaccccagactgtaacggaacccaaagcgcggggaaacttaccagttgtccatatctgtatcagtggttgactgtcacagacgaactgggttaaacgcacaccgggcaactttccgcgatagaagtgaaacgcgcgcgacacacactcggggctggggatcattcccacttgcactggcaactaccgtctgggtctcggacaatgaccccacttgggttctattcaagttctcgttaccttaaagccgcggacacaggcaattacaggttcccttacctctggggcagcaacacaagcagttgggaacgcaccacacccttggtcggggcacattccaagttgtccccggggatcactattatgtgcaacacgcgttcgattatcaacacgcgctatattgcgggcgcgtgtgtgggcaacacgagtggggataccccgttaaaattaccagcggggcagcacaatgtggcaacatgggaacgctgtaaacggtgttcacagctgtatactctacacccttgtgggcacagttttgtggtgacaaacac

SEQ ID NO: 595312 - DNA, 802 bp, Homo sapiens
aatctcatctagtcgagacgctgcatagtgaagcagaaatcgcgtggacacctcatgcgagctcgtccgtgatatgagttggggtatgatcgtgctcgaattgccaggtgcacgccttgcgataaacagcatgccatacgatatctcatgctcaacaataaccaagggaacaggtaacgcgagaataaccactgtatgcgactgccgaatcgctagggcctatagaagtagtagcagtatcacactaacgagtctaaatcgatctacaactcctgtgttctgtgataagtggagcgtcgacacgtctagtttgcagaacaatgccttgaagttctcccatgccacttagacagtttgtagatctgctttatcaacttagtaatgaactatggggaccattattcgtattggtctcgaagaatcacttctttgtgacgaacatcaccttaatgtccttctggataattcgttttgtatagctatgatcatgctttatgggaccatgtagaggtcgacgttataagcttgtcatactattaacaagattgtaaacggctgggtgcagctgggtcacacgctgtatatcccatgtcactttgggacggtcgaggcagagtggatccacgactgtgcaggagtgcaaatgacctatccgtggccagcatgatgagaacccgtttttaacaagaaatacaaaaaattagtcaggtatggtggtaacgcacctgtagtcccaggtacgtcgggaggggtgaggagaagaatcgttgaaccctaaaggggaggttgacgtgaggcagat

SEQ ID NO: 595313 - DNA, 383 bp, Homo sapiens
aggttgtgctctccttctccatcctaatcagaacgcaatctatagagtcctaagtgtggcataagagcaacgtttctaagtaatatgttgtaagttctcgagaagtatcatatgataggagaaaacttagtgcagatctggatccagagactgctcaatatcttgatgtactcattcaactcctccattaagtataagacattgctgatctttataatcagcacgtatatgagataataatgagagcagatcacatgtgcagggagcacagcacaggatgaaagtgggatcacagggtgaggctgtggtctctctcgtctcctacactagacagcgggcttcctcttgcacacggtcctctatgcttctcttcctctcgtgcc

SEQ ID NO: 595314 - DNA, 387 bp, Homo sapiens
ccaaggggattcaactatcggcacactccctctatcgagttcgcacgccagctgatagctgatggtcgcctggggacggtgactaatgctagggcatggcttatcgcggactacgcgtctgatccgcacgggccactgacgtggcgttatgacagggagcgggccggtgccggcgtcagcctcgatctcatgggtcacggagaggacctcgtccagtagctactcaaagggggattcactgatgtgtcctccgtgtccgagacgttcatccttcagcgtcgcaaggcacgcaaggaagggatcgttttacacaggttgggtcgtctcggactagctcgggtcggtgggcaacgaggattattgcgctgtcatcgcccgttttgaata

SEQ ID NO: 595315 - DNA, 354 bp, Homo sapiens
ttcattaggcaatccatggagacagaaagcagattatatggttgtaagaagcttatagaacggagtgtgggagagattgctaaaaaggagtttccttctagggtgatgaatatgttctggaactacttattggggatgcttgcactacatagtgtatgttctcaatgtctctaatgttaaatttcacatactttttatccattatttttaatataagctattattacctacattatgttatgatacttatatgtcataacaataacattctgtacgcttcactatgataaacaacttcggatttatatgcatctggaagagatattttttcactgtaatttgccttaattaagc

SEQ ID NO: 595316 - DNA, 244 bp, Homo sapiens
  misc_feature (77)..(78): n is a, c, g, or t
gttttgatgcccaaagtcctttttttccttttttagaaaaccccatgggaccaaacagatcgaccagttttgaagcnnctggggggggggaatgacccctcttgctttattccagaatgctggacatttattttggattgtaaattgggtttgggtatttacgctttgattcatagtaactttttatggaattgatttgccttgacccccacctgtaaataaaaaaaaatggttgaaagggcca

SEQ ID NO: 595317 - DNA, 419 bp, Homo sapiens
acttggtgggatacaatcagtttggcataaacagaagtgaatttgtctgaattacatcatatctacataacatgatgaatatggatccacccattgtagcagtctccactagtaggttgaattccagcagacttccttcatataggagctggaggacacagcacattgtaaatcaagaagaaaataaaagataaaacaggaacttctaatgtcttcccatatgactattacatagtgccactttaaacatgagctggaaatgacgttaagagagtgagcatgacttcagattaatcctctgataatgacagtgattcagaggaacccagcaaatacatcaatgcatcttttctaatgagctactggaaacctgaagtgatgattgctgctcatgcaccattgatgggacgaatactgcg

SEQ ID NO: 595318 - DNA, 285 bp, Homo sapiens
  misc_feature (170)..(170): n is a, c, g, or t
aaaactcataatttaaaaaagataaatataaaaatatcaatgagtcaatcaataataatttggcatcacgagacacatcacagaggaatattatgagcacagaaacaattgaaatattcaataatagtgatgaatgggcaaatcaactaaaacacgcattatcgaaaggngaaaatctggcattactacatggtttaactcctgatatccttgatagaatatatgcatatgcattcgactaccatgaaaagggtaatataacggacgcagaaatttattataaat

SEQ ID NO: 595319 - DNA, 111 bp, Homo sapiens
ctgttgagcgcacctaaccactggtcatgcccccacaatacagactcaactctcccacaatacagactcaattctcccacaatacagactcaactcccctgcaataccgag

SEQ ID NO: 595320 - DNA, 142 bp, Homo sapiens
  misc_feature (56)..(56): n is a, c, g, or t
gtgacgaggatagcttgactggcgtcgttttacatgtgctgggaaaacccggagantatgtaatcagtgtctagtatataaaatgtaaaataggttgtatatatctatgtatgatgtaataatgaaataatgattaaagaga

SEQ ID NO: 595321 - DNA, 91 bp, Homo sapiens
  misc_feature (12)..(12): n is a, c, g, or t
  misc_feature (80)..(80): n is a, c, g, or t
ccacggaaaganggcctgggccccgtggagcctcagtgcccgtttggcctggctgtctcgctgacaataaagagcccttngttgcactgaa

SEQ ID NO: 595322 - DNA, 150 bp, Homo sapiens
tagaagagtagatgttaaagtataagcattaggaagacttaatggaaaggtatctggcactgaaaacccctgacagaaacacagttactctcttaggataccagtcatgcaggctcaaacatagtcatggtcttatactacgctcaactc

SEQ ID NO: 595323 - DNA, 139 bp, Homo sapiens
aatagtctcccctactcttaaaggctgagtgggagaatggcctgagccctggaggtcaaggctgcagtgagccatgggcagtgagccatgggtgctccactgcactccagccggggcgacagagtgagactctgtcttt

SEQ ID NO: 595324 - DNA, 104 bp, Homo sapiens
gggtcgacacggccgtgtattactgtgcgaaaggactggcagctggcggcggtgggggtgcttatgatatctggggccaagggacaatggtcaccgtctcttca

SEQ ID NO: 595325 - DNA, 175 bp, Homo sapiens
aattatatttggtggatttctccatttggttttctggtataaaagtggggataatgggtagccacttcggatttggggaacccattgtaataattgtggaaatgttttgtctttaagtgtaaatattttaaaatttgacataccctaatgttaataataaaaagaactatttgca

SEQ ID NO: 595326 - DNA, 143 bp, Homo sapiens
ggtcgactctgcggatccttaagatcctgactcttcgggctgtttgaggatacggctgggtgccttcctgtcctactgccccggcatggacgtggccctgcgcctgtccctctcaagcccagccgtggtggtccgagcggccc

SEQ ID NO: 595327 - DNA, 1204 bp, Homo sapiens
  misc_feature (152)..(152): n is a, c, g, or t
  misc_feature (380)..(380): n is a, c, g, or t
gtctatagatgtggaccattcgtcctgtacccgggctcatcgtgggaccttaggctcagctacgtgtcgagtggaagaaagctcagtagtgctagagcagagtaaccatgttaaataatcaatggactataacagaaacatactactagcantgtaatgcttcttcactccggtgaaacaaaaatttggcccatgtagtgttacttcctactgttgagttatgccaacgaactaggtttacttcaggagtataatctgggatatttagattgcaatttcgagtcaataattttagatagatctacttcgggaacatgtgtatctacaacaggagtttatggagaaaaaacataaatttacacctaataataaatagaaantaatcttagatggataacacgttcatttttggggtaccaaagaacgtgggtttgagacgattgggcatccgaaggaggaaagcgactaacgtagatattggagatgtctaactcccatgacaatggtgttgccgagataagtgtggcataatattagaacaacgatgttataacgctatatcgaacagtgaatttaattgtgaggtccaattaggttaggtcgtctcaaagtgaacaaaggtcgacatatatcagtctcttgagcaaggagaggaaaccaaaacaataaatgatatcggttggtgccaaagacctttgatggtggctgggttccgccctagaatgggtctctttcccaagagaacgaattaggtaaaaacttctccaggaggacatactcttgcactgtggggtaagttgatccaaggatcacggtgactcacattgggtggcactttccaaagtatcctccagtttgaagacacctaaatagagtttcataaaacacatacagggtttgtcaaagggaggatttaacacatttaatatcggacatgtcaacaaggtgcgaaaagatggggcttatgttttcttccaataggagatgatgatgaaaggtgggaggtaccaccaatagagatgggtgggggtggtgttgaggcgaaagtcttggctatgggtcgggcgcctagtatataaggattatgtaaataaatggtctggcagggatatggctattattcattcgtctttgccaataggaagtctagaaaagttcagtgaagagctttgtggtgaaaaaaatttcggccacttgttaattg

SEQ ID NO: 595328 - DNA, 214 bp, Homo sapiens
aaatttaataaagtgctttgtgcactggagtaatcagaggctctaataaaaataaaagcttggtagaaggaaagctggattgtaataaaaaacatcatttgagtataaaagatgggaaaaggtatagaaggtaggagatatgggtgagagcacagaagtaggaatgatttaaaatccacaaccgtcgtggctcagtgggaggtgtcgcagaatt

SEQ ID NO: 595329 - DNA, 315 bp, Homo sapiens
gtcccttgccttcttaaaagcccccccctttttttttaaggagaagggcccggtcttttcccaagtccccccagggggggggaaagcattgtttttgggtaaattatgtaaagcaaaatttttttaattttcccccaaaaactttttttttttgttttttttggaaagaagggccttggggcccccccttcccccttttttttcccccaacttgaaaggtatgaggggttttggtttccctgggggggggggggggcagccggggtttccctgtccctttatttgggcccggttgaataaaaggggcccccttta

SEQ ID NO: 595330 - DNA, 243 bp, Homo sapiens
tagtggggcagaggtaggatgcagtgctggggaaatgggcctttccacctgagaaaggcgagtgtgtctagcgtattgataatcctttgatatttgcgtatctgctattttcaaggaattcacattttcacatgtagaacagccagtggtgacagttttttaaatttacaaacaacaaaaggttaaaaattctccagagaattttgtgctttataggttatttctactgtgccatgcttcaca

SEQ ID NO: 595331 - DNA, 317 bp, Homo sapiens
  misc_feature (26)..(27): n is a, c, g, or t
tgttcccaagctggagtgcagtgganntcttggctcacgcaacctccaactcccggcttcaaggcctcttgagtagctgagactacaggcatgcaccaccatgcccggctaatttttgtatttttagtagagatggggtttcactatgttggccaggctggtcttgaactcctgaccttgtgatccgcctgcctcggcctcccaaagtgctaggattacagacatgagccaccaagcccggcctcatcccagccattctttagggaacttcagacatatctttttttctccttaggcatggatgcccaccccaaggt

SEQ ID NO: 595332 - DNA, 189 bp, Homo sapiens
  misc_feature (95)..(95): n is a, c, g, or t
aaatctaccactgtcgaagacaaataaaatatagcaaagacaagaatgtggtatttaggcaaaattgatacgaggaatgtctattgaccaggctntggctcaggtggaatgcaatgacaaaaaaggggccaaaataattaaagaggttctgttagaagcacaagatatggcagggagagaccataacgt

SEQ ID NO: 595333 - DNA, 312 bp, Homo sapiens
  misc_feature (5)..(5): n is a, c, g, or t
acccntaataatgaaacccctgtcgcagttatgccgctctcgctgggctgagtgtcagcaggttaaacctcctgaactcgaactcctgaccggggtgatccacctgcctcgggctcccaaagtgctgtgattacaggcgttgagccactgcgcccgtcaaaaaaaaatcttttttaattagccatggcggagtgcacttgtagttccagctacttgggagatacgcagaaagactacttaagccccaggagtttggggctgcagtgagctatgattataccactatactccagccaagactctgtctccaaa

SEQ ID NO: 595334 - DNA, 219 bp, Homo sapiens
atgacttcaaatgggcccagtgcaaggctgtgtgtgtggaggcgggcatgatcgcacctgcgcagggtgccacggaggctcaccccccgaggactacatggaaggcatcctggaggtgcaggccaaaaaaaaagccaacctccaatactacgcctagggcacacaggccagccccagtctcccggctgaagtgcccaataaaaaatggtttagggtcca

SEQ ID NO: 595335 - DNA, 174 bp, Homo sapiens
cagcaagggaggatgaggcctcgggcacacagccggcgcccagtcacccgtcccttctgaatttaatttgcactaagtcatttgcactggttggagttgtggagacatgccttgagtctcggtgcgagtgtgctgtagtgtgagccaccttgcgcaagtgcctgcgcagaggga

SEQ ID NO: 595336 - DNA, 933 bp, Homo sapiens
tggggactcatgcgcgctgggctggcaggagttgcttccggtcgtgttgttgtgtctgatattgagaagtccgactactaagggaacgaatggagacaagtactgtgcagggcatcctgccgggctatcatgaggagaaggaacaggctcatggacgtcatggcataaagagtagtgctcacactaagaagtgcgatccgctccgggacctaccatcgaattcttgatctaccgtagcatcggggtcgcatgctagagaataggtatatggaggtcatgatggtcaatccgtgagggatttgtatcgcatgatagatggatgtgtttactgataagtgtaggagcctcaatgccatttcaggatcccaaatgagttagctgaattctataatcattactcatgcaagtacaggacttccagcggaagcagccaaatgagatctgtgtgccagatgttctgctggagaatatgaggaaactcctgaaggctcgacgagaagtccaagtgaagaggcacaaaacttggtggagttcacagatgaggagggatatggtcgtagatctcgatttccatgaagtgttagccttcaagtacattaggactgaagggcattctgcgaagctggactaatatcaggatacctgtccatcttttgacccaattatttttgacatttcctaacagaaaggctaagaactgcagagtattacgagatacctagagatgctgcttgaagtaaccttcagggatttccccacatatgagttgaagcctctcccaaggattcacaactgacgcttcttgggaacaattcagggcgcgttcgcgaaagcatgcggcgaaatgggcctttccgcgtggtcccagcaacaatccacggccgcgccactgttgggcccttggcaccttgatattccccctcgggaacggtt

SEQ ID NO: 595337 - DNA, 388 bp, Homo sapiens
gcagaagggttgtggagcgggggtgcagcaagttgggttccagatgtagattcaaggccatgtgggctgaggatgaggcttgcgctatttgagctcagatatgcaggtctgctctgggccagagaggctcacaagagacccactgtgagctgagacggagcaggccccgtagagctgtgtgagccagggtgagctcatatgaccagacctttattccatggaaaataataggaagattaagggggctaggctgggagctgtggctcacgcctgtcatcccagcactttgggagatggagatgggaggattgcttgagcacaggtggtcgaggctgtactgggctgtgatcgcaccactgcactcaagcctgggtgagagagcaagatc

SEQ ID NO: 595338 - DNA, 89 bp, Homo sapiens
aagccacaaagagtagctgagttactgggcccagaggatgggcccctggacatgtacctgcagaataataaagtaaaaaatccctcaaa

SEQ ID NO: 595339 - DNA, 1074 bp, Homo sapiens
agtgtgggaaattttcagaggtttcagttaattgcacaaatacatggtgcaggccaaaacttgtgtggagagattataacaaaggccatgcagtcaggttcaacgtttggatgaaaattgtagggatttaggaataataagggaaaagggtcaatgtgcgtaaagtaataattaggcattggtttaaaagcagggaaatgtaaggacttagaagtaaggcatttcttcgctgtcgaactttcagagattgtcttggtattaacgcagcgtgtactttgcgaatttccgtatcgactttgctacgttacctgcctttgtggcaatcctgtaaatgtttagtacaacaggtttatccctaatagatctaaatgtaaaatgaaagtttctattaatgaatgtcgagaatgtaaggtgtgtccaaagaagtctacctagggtactgagttgaagttttaggaaagaagcaatgcatagccctgaactcctgctagactagcaacttgtctgttacactgtgctatcatcattgaagagaatagtgattgagaggcaatgctatgtagtggagagatcataggcgtcgaagcctagtgctttctacttactggttgtataactttaggtaaattacttaacctcaggccaggcacggtggctcacacttgtaatcccagcactttgggaggtcgaggcaggaggatcatgaggtcaggagatcgagaccatccgtagctaacatggtgaaaccgtgtctctactaaaaatacaaaagttagccgggcgatggtggcagggcagctctgtatgtcccagctactccgggaggctgaggcaggagaatggcgtgaacccgggaggcggagcttacagtgagccgagatcgtgccacagcactgcagcctgggcaacagagcgagatctccgtctcaaaaaaataaataaaaaaataagtaaataaaaacttaacctctctgtgcctcagttttgttatctataaagtgggtataactcccttagtaagattgtgcctggcacatggtaggctttcaaatgtccagatattgttttattaca

SEQ ID NO: 595340 - DNA, 368 bp, Homo sapiens
atgttacacaaggaacagagcactacagcatggacacaagcctttatacattcatgccaaataaaagcatactgaacacatagctgtgtattattaaaaaaaaaaaactgtataaaggccaaagacataggattatgcctagcctttaatacactgctctttaaatcatttaaattcactgaaagaaaatgctagcaggatcctacacacttggcctcccaggctcctaaagttcataccaagatggacagtaatgtattctgcagaacgtacttcccagagatcattaccttctgttggcttattgagagcacagagataaaaacctccagaactcttactctgtagctttggtaagttcaataagc

SEQ ID NO: 595341 - DNA, 119 bp, Homo sapiens
ccgttcgacgaagcgtgaaatgctcctattttaataacagaaaaatgcaaaactagggaagagaaccctagatattcactagggaaggtaccaaaatttccagaatcaaaaattccatc

SEQ ID NO: 595342 - DNA, 179 bp, Homo sapiens
tggtgctcgctggtttagcggacgacgcattagcacgatctcggtcgtgtcgggatgccttcctgtacgaggggacgaaggtgggtatcgctatgccttgggcatgccaagtacaacgagaaggagatcttgaggctacagaatggcctggaaatctaccagtacctgcgaacctataa

SEQ ID NO: 595343 - DNA, 745 bp, Homo sapiens
  misc_feature (225)..(225): n is a, c, g, or t
aacgaagttttatttgtcattttttctgcttatacactctgattcctataatacagtgctataagctatgcagcagaaaataaagatgtttgaaatccaagaataagtgggttcttactgctatagagggagtaagtagttattactaatgattttgattagggttgcatttgttggttgcaagtgttatattcgcagcttgcagtttagaaataatgaatatgntttttatcaggtagtgtggctaagagtaagcacaaagcaatttgtgttagaaaagaaaagaagagaaaaaggcacatgtaattatacattgtggttcggtgtgaaatagtttcttaaggcatctggcgccctatagatgaagatcacgagtctttttagagcaagcctgtggtaaagtattggattgattggaacaatcctggttggtctttaatggatgggacatgtggctgtgtttgagggttactcgacgcactattctgtgtgggacaatcgagtgggtatataaaacatggtgtggggggtataacgaaaatgagctccattgtttgggtgggaaacttttaggggtgaaaagttatgggaagcggtttagatcgtcgatctacatgtagtttttcatatttatagatggtccgggctacatatattgccgataggtatgaaacctgggtggccatttatgtgaatcttcaggagtaagctcttgagatgatcaatgtaaggttaaagcttggtt

SEQ ID NO: 595344 - DNA, 388 bp, Homo sapiens
  misc_feature (24)..(24): n is a, c, g, or t
  misc_feature (30)..(30): n is a, c, g, or t
  misc_feature (32)..(32): n is a, c, g, or t
  misc_feature (50)..(50): n is a, c, g, or t
  misc_feature (78)..(78): n is a, c, g, or t
  misc_feature (85)..(85): n is a, c, g, or t
  misc_feature (169)..(169): n is a, c, g, or t
  misc_feature (178)..(178): n is a, c, g, or t
  misc_feature (184)..(184): n is a, c, g, or t
  misc_feature (187)..(187): n is a, c, g, or t
  misc_feature (219)..(220): n is a, c, g, or t
  misc_feature (249)..(249): n is a, c, g, or t
cgcgaagcgagcactcagcaggtnaaagcngnagctcaacacagatatantgagctctgtgggcacttataatctggnccagaangctctcaagcctcctccaataaagctctatcgggaaacaaatggaccagtggaaaccaagacccggacctttaatacaaggcangcgggttgnttctgnctngcgataccaagagggctcagatctatgggagnnggcagattataccggagaaagagggaacnggagagcttaaaccggttgatgatccaaggttgatgctcaagggtttcaaggcgcgggtaccgtggagcaccattacctgagggcctccctgttcgtgtacccacaggagtcgcttgtgattggggctcccctgttcgt

SEQ ID NO: 595345 - DNA, 749 bp, Homo sapiens
cgaggtctcgcagctcatgctactccttgacaaaactgcacactattgaccctgctctggtgatagctctaccatggtggatagtccaaatggtgctttacagtatctagtgctgcaggtgcagagggcctcaaagtctcacctctctatggataatactgtctgctcatgcactaaccaattcttgatactcccagcgatgcgttcccaagtctttgtcttgggtcagtacccactgatcacatacttgctgtgagatgatacacgtacctcggttgtcattgcaagaaataactatcttctgtgcatatcactgtcgctagcaactgactaggacaggatctattcacccatattgctacgtgagcactctaggcgttctattctgtcatcaccaaatggccatagctgttcttataataaaagatgaggatatacagtcctttcatatgacgtgactgtcttgcacacccctacctgtgaccacctgaacactctgaaataattgtgcataggctacaaaagtagaatgctatgagtatatcatagattctcggtgaggcacctgtgcagaccctgatctagcagacttgtgtatcaagtatgtggcgtgccacatacgagccaagaacctgtgatcacctggccgcacactcacctgttgcctggactactatatacatgtgaacaggttgctgctggcctgtgaagagctgctatattctcttcacgatggtgtgttttctgtg

SEQ ID NO: 595346 - DNA, 488 bp, Homo sapiens
  misc_feature (32)..(32): n is a, c, g, or t
  misc_feature (48)..(48): n is a, c, g, or t
  misc_feature (89)..(89): n is a, c, g, or t
  misc_feature (91)..(91): n is a, c, g, or t
  misc_feature (96)..(96): n is a, c, g, or t
  misc_feature (102)..(102): n is a, c, g, or t
  misc_feature (132)..(132): n is a, c, g, or t
  misc_feature (156)..(156): n is a, c, g, or t
  misc_feature (158)..(158): n is a, c, g, or t
  misc_feature (166)..(166): n is a, c, g, or t
  misc_feature (171)..(171): n is a, c, g, or t
  misc_feature (189)..(189): n is a, c, g, or t
  misc_feature (203)..(203): n is a, c, g, or t
  misc_feature (206)..(206): n is a, c, g, or t
  misc_feature (221)..(221): n is a, c, g, or t
  misc_feature (228)..(228): n is a, c, g, or t
  misc_feature (233)..(233): n is a, c, g, or t
  misc_feature (246)..(246): n is a, c, g, or t
  misc_feature (279)..(279): n is a, c, g, or t
  misc_feature (281)..(281): n is a, c, g, or t
  misc_feature (315)..(315): n is a, c, g, or t
  misc_feature (323)..(323): n is a, c, g, or t
  misc_feature (338)..(338): n is a, c, g, or t
  misc_feature (369)..(369): n is a, c, g, or t
  misc_feature (372)..(372): n is a, c, g, or t
  misc_feature (401)..(401): n is a, c, g, or t
  misc_feature (447)..(447): n is a, c, g, or t
tggttgagcacagggtactttattgagggaanatgacaaggggcggcnccctaggccccccccctcttcaagggggctacagggcaacngngaggngggganattcagtgtggggggggactgagtgtggcngggaccccccagcagtgagggtcncnctcttccncttgngctcttgctggggctggnggtccaggggtctnacnccttggaggccatgngggccangaggnccaccaccctgtngctgtagccaaattcgttgtcaaaccaggaaangngcttgacaaaggggccgttgagggtcaatcccanccccaccntcaaagggggaggantgggtgcccccgttgaagccagaggagaccnccnggggcccagtgtagcccaggattcccttnagggggccccccgacgcctgcttcaccaccttcttgatgtcatcanatttggcaggtttttctaaacggcaggtcaggtccaccact

SEQ ID NO: 595347 - DNA, 149 bp, Homo sapiens
  misc_feature (3)..(3): n is a, c, g, or t
agnagggttttcaagcatacaccaaaaacacacacaaaaacatcaaccaaaaaacagagacaacaacaacacaaaaacaaaaactaacaccaaacacacaaatacacaacaaacctcacaacaaaaatacacaccacaaacagaccaaa

SEQ ID NO: 595348 - DNA, 514 bp, Homo sapiens
gtgtatataattgcaccatcagctcccaggatcaaaaggaaaagtaccagccgggtgctgtaatcccagcactttgggaatgccatggcagaaggatctcttgatgctagcctgggcagcctagcgggaccctgtctctacaaaataccaaaaaaacaaaaaattcgccggatgtagtggcatgcacctgtactcccagctaactctggaggcggaagccggaacgataacttgagccccagaggtagaggatgcagtgaacaatgatggtagccattgcgctccaagcctggcatcagaatgagaccctgtcacaaaaaacaaaagggaaacttactcagagtctggtgctgggaaccacggagcagagcaagctgcccagggtaatcaggtgcaggaaaagcagcgccaaggaccctgtgcagggagtcaggaataggaccccagagaccgtgtgaagtaggctaaaagccaatcatccaagccaaggctgaggggctcatgcagggagacg

SEQ ID NO: 595349 - DNA, 101 bp, Homo sapiens
tacgcagtccgacctctcctatctctcccaggtctagctgtttcctgttgtaaaatactaacagaccgcaactcaacaccaccttcttcgaccccgccgga

SEQ ID NO: 595350 - DNA, 893 bp, Homo sapiens
acaggccggagttatcggctggctgcacatcgacggtgcaagctgtccgtcctgcgggtggagcacgcgctctccaaggtccacttcaccgtcgaacgcgagctcctactacaagtccctgactgtctgcgcgaggaggccgaaagcgagaagaaatgagaaggtctgggcccactatgaggagcagcccgtggaggaggtgatgccagtgctggaggtagaaggagcgatctgctagctacaagcccgtgtttgtgactgagatcactgatgacctgcgacttcatactgtgcaggatgtcggagatcgggcgactcgcgagattggagaagctgatggagaacatgcgcaatgacgattgccatgtctacccctcccgtgtagagggctccgtatgccccccgcgagggggagagttctagctaagttgtccaaattttgtacgatggagaatggtcacctgtgcccgagtagagaaagtcgagtctcctgccaaccatacatgtcttctacattgactacggcacacagagaggtcctgacatccatccgtcgtgggtaccctatcacactgccgttcagcactcgggtgctgccagatcaagccacggagtatgcctacgacttcatacaggtgccccaagatgattgatggccgtagcggacgccgtggacagcgtagttcgggatatccagatacaatcaggtgcctgctcaacgttggaagacctgagtgacggggtggccccatgtcaacctgtgggtttgcgattcgcagggcgatgtgggggctggccttgggggaacgcaaggcaggccaggtggaacgtggcccgggcacccggcccaaaagtggatccccgattctgactgtcaaattggaaaagcaagg

SEQ ID NO: 595351 - DNA, 266 bp, Homo sapiens
cacgagggatgcgcggctgtatcgcaccggcgaccgggtgcgctggcgcacggatggcagcatcgccttcgtcggtcgcaccgatcagcagatcaagctgcgtggcttccgcatcgaacccggcgagatcgaagccgcgctcgccgcactgcccggcgtgaaccaggctgccgtcatgctgcgcaccgccaccgacggcgagcgtcgtctgttcggctgggcgagcggcgatggtctggacggggctgcgcctgcgcacacagctc

SEQ ID NO: 595352 - DNA, 488 bp, Homo sapiens
cggatcgagctcggtaccatataggttggacgaggcaggtggactcacctgaggtcaggagtccgagaccagcctgaccaacatggtgaaactctgtttctactaaagatacaaaaattagctgggtgtgagggcacgtgcctgtgatcccagctacttgggaggctgaggcaggagaattgcttggacctgggagacggatgttgcagtgaaccaagattgcgccactgcacaccagcctgggcaacaagagtgaaactctgtcccaaaggaaaaaaaaaaatctctcttcttcttcctcttcttcttccttcttccttcttcttccgtcttcttctcttcttcttcctttcttttttcttcttcctttttttttctccttctttctttcttcttctaccttacttcttccttcttacttcttcctatactatttttctatcttacattccttcttctttcttcttccttcctcctccttactatct

SEQ ID NO: 595353 - DNA, 144 bp, Homo sapiens
  misc_feature (3)..(3): n is a, c, g, or t
tantggcgagcccgagccgagctgagcagatggcaagaaggccgaagcgattagctgtacaggaggctgctcagctggacatgctgcgtagagaagctgccccaggtgcatgaggagatcagtggtcccttgcacttcagccaa

SEQ ID NO: 595354 - DNA, 134 bp, Homo sapiens
ggcttcaggcaggcctagacttgatgcagccactgcaatcatggtccatggtgcaattggcagacaagtaggtgaaaggtaagtagtctccagagatttcaatcagggacgtggtttccagatgttaaaagata

SEQ ID NO: 595355 - DNA, 299 bp, Homo sapiens
tgaaggcagtggttccccatccaccttcttccatccccctgcagacagacagatgagcgatagggctcgagccataggggatcctgaccagctcagacacctgaaggaggaggcacaggtctgtgagtcagaaagaagccacttgcttaggacatcagacataggtaatggctgaatctccctaccctgagtgtttgtggaggcggaagaaattagttgtgtgcggatcctagactagggtagccatcatcatttcctaagctcttgattcaaaaatgtgtattattctcacgtctgca

SEQ ID NO: 595356 - DNA, 403 bp, Homo sapiens
cgcagtcataagcagtaggtcagagacctagtggccacttctgggctgatcagcattgtcaaagctagcctacttgtaacagaggtttctacatatgcaaaccatccgatgaagaactcggtgttttgacctgtgagacactctattaagatgaacggaatagttctaattcctatgacaattatggactagcaaatgctgagcattgatgcttcattattatgggatttcaaacggatatactctgtgattctttatggagcactgcctacagcctggcaccagattgtgccttagagctgcgatatatgcacatgcatggatacgttcggtagggatttgaggacttgatatctgtgactacctctgatgagacaggtggctttgctgtcacaggtggtcg

SEQ ID NO: 595357 - DNA, 275 bp, Homo sapiens
  misc_feature (93)..(93): n is a, c, g, or t
  misc_feature (107)..(108): n is a, c, g, or t
  misc_feature (111)..(111): n is a, c, g, or t
  misc_feature (117)..(117): n is a, c, g, or t
  misc_feature (122)..(122): n is a, c, g, or t
  misc_feature (131)..(131): n is a, c, g, or t
  misc_feature (135)..(135): n is a, c, g, or t
  misc_feature (147)..(147): n is a, c, g, or t
  misc_feature (151)..(151): n is a, c, g, or t
  misc_feature (153)..(153): n is a, c, g, or t
  misc_feature (159)..(159): n is a, c, g, or t
tcggtaataggtcatgtgcatccaggcagtgggaaggcatcgtgggaagaagaagagaggaatcacgtgatcatgcttagggttgcggtgatnatggaggtggaatnnggngctgtnaaatngtataggtnatancttttctagtcnggtnangtctangaggagtaggggcaggttttggctcgtaagaaggcctagataggggattgtgcggtgtgtgatgctagggtagaatccgagtatgttggagaaatcccaacggtgaccggcgactt

SEQ ID NO: 595358 - DNA, 212 bp, Homo sapiens
ctcacatgcttaaagagcataaagatcacaggtgaaggccaattagaacactgatgagggtctgtgtccgctgtgtacacattgtcttgataaacatcttaacaggaaacaaggttcaagagcagagaaccagtctgactagaattcaccaggctggaatttcccaatcctagcaagcctgagggtactgcaggagaccaggctgtatttca

SEQ ID NO: 595359 - DNA, 229 bp, Homo sapiens
tgctattacttttggaaagtgtgatctgtcacacatagtatttggtttcttaagctgttttgtagaccctataatgaaatctacattttgtatgtatgttttacatgataggaaagtgaggctggaataaatatgtcagaaaatatacacccactgggacctgagaaaatctggagtaagcaaagccattctcagagtgctcaagtgtgagcctaggactgcttccatg

SEQ ID NO: 595360 - DNA, 317 bp, Homo sapiens
agatatgaaagtctggagtaaggcatgagaggttgagagctccgcatagttgaatggaggaatgaggaagaggagcatggtgccctgggctgggatcctggaactcagtggtagagctgccctccagagacaagagattctgattaactgatgagcgttaattgaactctcagaaccagaataaaagaccttcttcagtgggacacaaacgccaggtcataaaggaaaagagtgattaatttagccacatccaaaatctaagacatcgtgtgaaaaaaggcacaataaaacttgcaaaagatgggaacagattagga

SEQ ID NO: 595361 - DNA, 207 bp, Homo sapiens
gcagcccatttttggggacccctttttcaaatatgagaagatcaggcccaagaacatcagaatttaagataatggcggatatcatttccataggctcaaataattagatgcatgaaaacgatgagtcggttacccggtgaaaaaatcaaggaacccggtgaaaaaattttattgatgaataaataactttaattattttgtcctcca

SEQ ID NO: 595362 - DNA, 159 bp, Homo sapiens
gtgctcggacatacttctggctgggcactgtgcggaaacttgaggataaatcagttgagctgcatgcattttataaggcatggcctgtctcctcacttaagtgcaaggttctcatcgaccaaagccctgattctgatcaattactcatcttcatgccag

SEQ ID NO: 595363 - DNA, 226 bp, Homo sapiens
  misc_feature (12)..(12): n is a, c, g, or t
  misc_feature (15)..(16): n is a, c, g, or t
  misc_feature (22)..(23): n is a, c, g, or t
  misc_feature (26)..(26): n is a, c, g, or t
  misc_feature (40)..(40): n is a, c, g, or t
  misc_feature (43)..(43): n is a, c, g, or t
  misc_feature (59)..(59): n is a, c, g, or t
  misc_feature (64)..(64): n is a, c, g, or t
  misc_feature (71)..(71): n is a, c, g, or t
  misc_feature (105)..(105): n is a, c, g, or t
  misc_feature (107)..(107): n is a, c, g, or t
  misc_feature (114)..(114): n is a, c, g, or t
  misc_feature (143)..(143): n is a, c, g, or t
  misc_feature (158)..(158): n is a, c, g, or t
  misc_feature (160)..(160): n is a, c, g, or t
  misc_feature (163)..(163): n is a, c, g, or t
  misc_feature (165)..(165): n is a, c, g, or t
  misc_feature (177)..(177): n is a, c, g, or t
  misc_feature (180)..(181): n is a, c, g, or t
  misc_feature (184)..(184): n is a, c, g, or t
  misc_feature (204)..(204): n is a, c, g, or t
  misc_feature (212)..(212): n is a, c, g, or t
  misc_feature (217)..(217): n is a, c, g, or t
  misc_feature (220)..(220): n is a, c, g, or t
cctcactcagcngcnncctacnnggnatcctcagcaagangcnggagactttttacccncccgngacagcnttacaacccgtaaccacaatccctccacctctcngngggaacnggaaccctcctttctccgcgtgacctaangccactcaatgaacngnagntnacgagacctttngcnnggnctccggaatgtcctcacggnatattgangttcnggnggagct

SEQ ID NO: 595364 - DNA, 376 bp, Homo sapiens
cctctgaaggaatttatgctttctccagatgttgaacatagcgtgctctttggcctccttcaaaaaatgttggagtatggccagcccaaaaaatttctttcagagaagccttaaagcatcccttttttggccttttgaagaaaaggatatagatctgtaattgggcagctctctcgaaaagattttcacgaccggatcagtctaatttttaaattttaaggtattttggacagctttgtaaatttttaacctttttatattgccctgtttattttgtttggggaatttggttccttaaggacaaagctaaggtaatgaacctctttttccgtaattgtaaagtgattttttccgaataaattttttggggttttta

SEQ ID NO: 595365 - DNA, 775 bp, Homo sapiens
tgctctggccaagatttcgaggttgagaaaacaaaaaaatgacatggtgcagaagcttgtaacattgagtcacattcttaactgtaaatggtgtctttcttctggggttttcatgttattgcaaagaaatgaagagattctggaaatgcatcaataacctaagaaacacacgcgacataaacaatatacttatggcttgtgtttatgctcttcatcattgtgcgttgtgtgcggttacctgcttgagctgatcctgcaactctgttcgcgacgagagggcactcacgtggcactctgttcgattatgattcgtctgtttaactagagaaaacaatagtggactcgatttcccattcaaggctgttggtgttcaagtgttgatagtgaacgaacaagactgtgaagtaatgatatttttctgcttacaacttatccccactcattggcacgtgaacagtgacgcaagctcaatagacttcagtaagctgttcatagaacttttgacaatgtctgagtgatcttagaaatcattatctgttatttacaaatcaacggaaactgaggtccagaagagagcaagcgactttgcttaaagtcgcatcagagagctgagggtaagactcaggtgtcctgactcccagtttagtatcttatgaattttatgtctgtaccatttagaaaataactaattaacactattatgtgcaagtcagggttatggaaaattcagtgtcccaataaaaagtggacttgcacactaagggaccatccccca

SEQ ID NO: 595366 - DNA, 151 bp, Homo sapiens
acgacactggtggacaggtagagttataccgagcgatcgagtgaatcgtggtgaatgaactcggcaaaatgcccccgctaactttgggataatgggggacctgagctgtcgtgcacccgatgtcggtgtggtggcggtgaggggcgcagag

SEQ ID NO: 595367 - DNA, 299 bp, Homo sapiens
cgggggggggggtttcaggtaagggtgtgtgaggccccccgctgctgcttttttggaggttaaggggatttattacacccagtcctaaatgtttcaagggcagaaaaaactgggtaagtcctaaatgttaccgggggaggacattttaggcatgaaaaacttttttttattgccaaaaaagaaattaaagctttgggttgtttccttttttggggttcaaaaagtagtctgtctgtgggaactgtttggaaaatcttgttttccccattgtgatttttgattaaattttattccccata

SEQ ID NO: 595368 - DNA, 200 bp, Homo sapiens
tgcctagagggcttaaggaatcgtgctggtgctcggaagcataagacgaatcaacatatggtgattcatttacaaagcagaacattaccgatcgataaataggaatgaatttctgatatatgcaacaacatgatggatctcagacattatgctgagtgaaaaaagacaccagcacgatagcaccagcacgatagcaccag

SEQ ID NO: 595369 - DNA, 140 bp, Homo sapiens
ccgttgtgctttcccctattgggctagaaaggaggaaagacacggatgtgggaagccagtgagggggcaggaggaaaaagggactacaagctcctgagatgtagtgtcaacaagttattggagctgagcgaccatcgttg

SEQ ID NO: 595370 - DNA, 127 bp, Homo sapiens
tgatcataaagttgtgactcgtggaaatgtcacgctgctgatctggcgctctcgtggacatttccacgagtcagccccactttatgaatctgtatgcccatatgcctggccctgactcgtggaaatg

SEQ ID NO: 595371 - DNA, 112 bp, Homo sapiens
gtcctggtcacggaacttcgggcattgtagtaggactgtaaatgtgcagccactttgggcaacagtttggcatttcctccaaatgttaaacacagttaccatatgatccagt

SEQ ID NO: 595372 - DNA, 116 bp, Homo sapiens
gccttattcgattgcattgacctgtgggaaagtctttctcacagaagtcacagctcatcaatcatcagagaactcatacagtaaaaaatcctaggactacagttaatagtagtctt

SEQ ID NO: 595373 - DNA, 334 bp, Homo sapiens
  misc_feature (14)..(14): n is a, c, g, or t
  misc_feature (40)..(40): n is a, c, g, or t
  misc_feature (64)..(64): n is a, c, g, or t
  misc_feature (70)..(70): n is a, c, g, or t
  misc_feature (156)..(156): n is a, c, g, or t
tcctgcagttttcngtccttggcaagtttccaccaccagnggggctcaggaacaggattaaaancccaantgatgccaaactcatagtagaagcttagagtctctcccaggaagtagatagaggtgggaagaaagtgcatgggattcggaatcaangggttaatctaaacctgtcacctaatggtagtatattttattctatagatcaaataattatttgaattttataacaatactcaagacatgcaattcttgtttaatgtattaaaaacatttaaatgtttgggagatcgagctgggaggatcgcttgagcccaggagtttgagaccggcc

SEQ ID NO: 595374 - DNA, 755 bp, Homo sapiens
gcgtccttgtcctaggtacccggggattgcggccattatcggccgggtgctccaggaccccgaccattcgtggtgtgaaaatctacactttcagtcaatgcaggctcgggacactgtcctcattattgaaggcacactcgagactgatgtgaaatgtgctcaaggggccaagaagcactatgtatgacaagaggcaaggggtggaggcaaagttcaaaatcttgcaagaccacacatccctatggggcgcgctctccgagccacccaaaagaactgcagggcgcaaaagcgccatctgccatcgcaaaccacccgcccaccgcccgcccctcgtggcgcatgccctgggtggggatgcagcgtagaagcgggcagggcgggggtcggcgtgcagacgggtgcgagcacctcctatagggtctctaacgctgcccacgccgccccccttccccccccgtatcactacgtacattgcgatactctcggctgtctctagcgtcatagcgctactcatgcgcttattagctgcggttgcgctcgacaaccggttcgaacaagcatactacctctagctacaatgagcgtgtcgggatgcgggcggacaggaggggcctgggcgattggccgggtcggcggtcacctctacgcggaccatgcgtctaggtggtaacttgtctcggaaatgtagttggtatagaggtgtggtgaatagaatggacggaacagtcgggcggggacggtctgggctggccggc

SEQ ID NO: 595375 - DNA, 993 bp, Homo sapiens
gcggtagggcagttcgggtctcgatccagtgtgcgttctgactgaggccctttgagcctcctgctcctggactcgaatgtgtcgttacgagtggccgactggtctatcgggcgagacgaggacggtgcgcagtgtgccggctctgggccttctggtggtgactagcgtgatgcgtgaccacgatagtagcatatagaggatgtcgcatgtgtgaacgtcgtgaccccttgcgggtattccaggtgactgagttagcgcacgatgcgatcgacgaccgactgggaacttgcgaggattagggaccgactttcgtttggtagtctcctgtcaaacttcagcgcagcgtatcaccacgttgtaataggtctggaagaccatccctggtcccgtgatgccaaaggtgcttgggtgccttatcttgtgcccatgccgttgcagtgctagcgaatttcactgcaacaggtgtcccgatgagctgagaatccacgagcttgacaattcaaagctgtcgatcccttcacagacagtaaaccagctctttggaaaccgagttccatcaccccaataaaggagctcttcacagcacctaatgatctctgcctttcacaaagaccacctttgtgcatccatgcctactcttcagaacagcactgcaagaaatcccctcagccactttgtcatccaccaaggctgaaaggtaaccctctatgaagctctgctgaccacctcctttgggtcctgctaacctaccctctgtttcatgacacttaggacactgggagctagaggtcattggtatgaacctgttcttctcccatggactaagcttgttcagagaaacagagacttgtctcaattccttgggttaccagcaaccttgcccagacagcaggaacttcattaaaaatgggctggacttgatctggtgggtttgactggtcagtggtttaacctgagcaaggaaagaaggttggtcattttgattcaacccca

SEQ ID NO: 595376 - DNA, 407 bp, Homo sapiens
  misc_feature (13)..(13): n is a, c, g, or t
  misc_feature (339)..(339): n is a, c, g, or t
  misc_feature (383)..(383): n is a, c, g, or t
tgggcttaagtgnttctcctgccctcagactccctgagtagctgagacccacaggtgcatttcacccactcagctaatttttagtttttttgtagagatgaggtctctacccaagctggtctctaactccctgggctcaagcgatcttcccatcttggcctcccaaagtgctgggattacacatgtgaaccactatgcttggctcaaagatttattgataataccctgcaagcacaagcgtgcaaagcaaaaatggacaaataggatcacatcaagttaaaaagctgcacagcaaaggaaacaataaacaaagtgaggaaacaaccacagaatgggagnaaatatttgcaaaccacccatctgacaagggattaattaccagnatatataaggagctcaaacaactc

SEQ ID NO: 595377 - DNA, 182 bp, Homo sapiens
gaggagtatcatgctgatggcgaggctaacctgggcctcccacgagaagatgcaggagggtgacgagggccctgttccaccaccataagccaggcctcggggagtggcaccccactaaagaccacagttggccaatgatcacatgtggccacggtccatggtccacatgtcatggttggcca

SEQ ID NO: 595378 - DNA, 177 bp, Homo sapiens
atgtacagctatgagcacatgaaagagtgtttaacatcctccactcagcctccaagtagctaggactacaggttatgcgccatcatgcctggctaattttcaaactttttttggtagacaactggtcttactatataatatgttgcccaggctggtctcctgggctgaagcagtcct

SEQ ID NO: 595379 - DNA, 328 bp, Homo sapiens
gactgtgggtgcaaacctagggcagtttgcaggtggtaagccatttaccaacgatagttgtaggtaaagaagggcagatttattagagaaatggtgaaaatatgttgcagtgggcagctcagcagagaaggggctacctgcaaggaggcaagggctggaggaaagttttatagggtcctgctgaagggtgctacgtgtggaatgaggtcattgtgcccgcaggtggtttgtgattagctgtctctaacaatggttcatacaataattgtgcattattgttctcaacttggggctctccccaacctggggacccttccttattgttgct

SEQ ID NO: 595380 - DNA, 301 bp, Homo sapiens
caccaccatgcctggctaattttttatgttttgtggagacaggatcttaccatgttgcccaggctgggtctcaaactcctgggctaagcagtgtcccacctcagcctcctgtagtgctacgactacagacgcaagccaccgtgcctggctaatttttgtatttttggtggagacggggtttcaccatgttggccaggctgggacttcaagtgatccgacctccttggccttccagagtgctgggattacaggtgtgagccacagtgcctgcccttacttaattcagtgaatgctttgaggc

SEQ ID NO: 595381 - DNA, 906 bp, Homo sapiens
agcggagtcgggcgatcccctggctccgtgcgcgagggacggccgcgatgcgctcggcctgaggttacccgtgcccggccctttcctcgcttccctcggacgtattccactgcgatcaatcgcgctgccccaggcgtcgatcctgcgaagtcccgtctgactgggagggaagatggctgcacgggagtctggcaggacgagctggccaagctaggcccgaggagggctcggctccggctgccgggaaatgctctcggctcggcctaggctttctgcgctaccgtagctgggcgctccatcctggggctggagccgaacacggtaccaccgtgctgggtgatcctggtgggcacctggcgcgctcgggctgctgcctgctgtttctgctgggctacgcgctgggcctgcggcttggcgccgggcgcccgcggcagattgctggcaggagcccgttcccgcaagctgggaggaggcgtgctggtcgtgccggctctgcgggcccgcgaagacctgggccgttgctgagagcaatctccggagccgacggaaccagacgacgcacggaaccgcgaagaagactgtcctgaagaagccccagacgccaacatggcgcgggccctaggtgtgacaagtggcctggagggctgacaggcttggttcggacacacccctccacacgtgcgtacaagcagaagcctgtcacaatgacgaacaactgcacgacggcccttccgaccgacccagtcgcgcctccagtccccccccccccacccaaccccccccccccctccccccccccacccttgcaccgctccccccccgccaccccccacctcctcccctctccgcccccccactgccccacccccgtttccactccccctccacctcccgcccctcgcactc

SEQ ID NO: 595382 - DNA, 605 bp, Homo sapiens
  misc_feature (425)..(425): n is a, c, g, or t
ccagctactcgggaggctgaggtaggagaattgcttgaacctggaggcggaggttgcggtgagccaagatcgtgccattgcactccagcctgagcagcgagagcaaaactttgtctctaaataaacaaatacataaaataaacataaagtaaaatcttggaccaggaacgaggttgtgcaatacactgacttttgcccccgaaatgttttatgatctgggatgggtatttatgacgcttagtgcactttgtcctagcctggtctgtaccacttggcgcgagtgaacttttgctacgttattagggaccttgtggtccatcaagtccttgggccctgaatccaccaggaaaggaggctcttaaggggaactacgcgggcatccatcgttctgggaaaaacgcttttgccggtaaaccctcaggaanccccccggttgcttaaaggccccaaacagtcccccaccttttggttggaccgttcccccttttggccctcaaaccacccaagggaaccttttatcacttaggagaacttgggatcaccggtccaaacacctttaagttttctaccttttaagagggaaaacgggggccccaaaagacaag

SEQ ID NO: 595383 - DNA, 148 bp, Homo sapiens
  misc_feature (1)..(1): n is a, c, g, or t
ngtaactcctattttacttaaaatgtaaaagtgcaagagtagtaatgctggtatattgctataattgttctatgttattattaactactgttagcctcattaacatttaatttataaattaaatgctattgaaacttctaaaactagg

SEQ ID NO: 595384 - DNA, 251 bp, Homo sapiens
ggtttttcccccccccccctttttataaatgtaggcctagaaaacgtttttttgttgcaaaactcaggtaagttccggcttcccccttgatgttgaaattttttatgtaaaagggcaggggattttgttaaaatggcaaaaaaaacccagtttcaaatttttggaaaagagcctgtggtggagttttaaaaatgtttggggaagggcttaaaatcagaactttttaatgaaaggtccttggggaagtccta

SEQ ID NO: 595385 - DNA, 289 bp, Homo sapiens
tggctgttacctacctgggcgtatctaaatggctgttacctaaataggctgttacctaaatggctgttacctaaatggctgttacctaaatggctgttacctaaatggctgtggagcgctttgatgcctttggtgaaaaagggaacgtcttcccataaaaactagacagaagcattctcagaaacttgtttgtgatgtgtgtacccagccaaaggagttgaacatttctattgatagagcagtgttgaaacactctttttgtggaaaatgcaagtggatatatggatag

SEQ ID NO: 595386 - DNA, 597 bp, Homo sapiens
cccgggctgcaggaattcggacgggtaattggatgtctgttactatgtatacttcctatgcaggtctgcttggcatgatatttggaccattattgtatgtaggagacagccagaattcaaagtagcatagagacacatactatgcttgatataaacaacggcctttgatatactgtgtgacactagaagagctattaaagaaaggcatacttagttaaataaatcagtatgacatgcacatactgcatcttgtcctggataatgatccatcagagaacagacaattagaatattccctgtattgagcaatcatatgctatttactaggctctatatatcagcctatcagttgacattcgaaactcgataggcgagccgctcactaaacccactgaggggcatctcattctgacgtgaaatgacacttcattatgaagtttagcggcttctgagaatgatatacagaaagtacagcgctacgtacatgcatgcgaatgcagctcattgaggatgaggatagatctgatacgtgtatgagctcgagacattctgacgtcatgactctcagttctactggactcatgatgagacggcctg

SEQ ID NO: 595387 - DNA, 160 bp, Homo sapiens
  misc_feature (66)..(66): n is a, c, g, or t
  misc_feature (70)..(71): n is a, c, g, or t
  misc_feature (73)..(73): n is a, c, g, or t
  misc_feature (75)..(75): n is a, c, g, or t
  misc_feature (79)..(80): n is a, c, g, or t
  misc_feature (90)..(90): n is a, c, g, or t
agtctgctacgatcacgagagcccggttgcacattcctgagcccccacgacgaaagtgtggttcgntctnnanancctnnagagcgggtngtgctgacttgtgagctctcaagggtggacttcccggcaacctggtacaaggatgcgcagaaggtggtgg

SEQ ID NO: 595388 - DNA, 234 bp, Homo sapiens
taacccaggtagagctaacctgtatcattactgcaggacagctactcttgcgcctaacttgggagcgccaccctaactatatcagccattatgcttccctctacacgtatgatcttcacaattctaattctagtgactatcctagaaatcgctgtcgccttaatccaagcctacgttttcacacttctagtaagcctctacctgggttaggttacctgggttaagtctacctgg

SEQ ID NO: 595389 - DNA, 297 bp, Homo sapiens
cacgaggggggcatgggaagttgacaacgaccaattgagagcaatcattgaactacatgaaacattacagaagaactcagcgttgactattcgacggtcattatggtcgttcagcattccaagcatcttggaaaggtgaaatggcttgataagtgggtgcctcatgagctgagcggtaatcaaaactagcgttttgaagtgtaatcttcttttatgctacgcaacaacaaaccatttctcaatcggattgtgacatgttatgaaaagtgaattttatacaacaaccagctcagtggt

SEQ ID NO: 595390 - DNA, 143 bp, Homo sapiens
ctcataactagctagcacattactatctatcactagccatggcatccccttatgagcgggcgcagagattataggcttacgcatcgaagattaaaaatgccctagcccacttcttaccacaaggcacacctacaccccttatc

SEQ ID NO: 595391 - DNA, 185 bp, Homo sapiens
gcttaaaatttgggggaaaatttaaaaaaaaaattgcccggatttttggaaatttgttataaagaatgaacccttttgtcaaaaaagattcatatttcctttttaaccctttgataaagtaaggcagggggggggttaatttggtttttttttgttcccccagttaaataaatcataaaacttga

SEQ ID NO: 595392 - DNA, 459 bp, Homo sapiens
gcaacatgactgactaacactagacacagattcaccccatggaatagtgcatatggggataccaggtaccttgcgacatgttattctcttaggaatgatgcatggggactgctaacatattactggtgaacacttatcacttagtccgctgaagtttgcgacggtgcttaggtatggttttataccatgagcttatatatacatcggtgcgggcatgtggatccattagtgctatacccagtcttcgatcgcatctgagcgcgagccaagattacgaaagaacacccatttatcataaaggggcggatgttctaagacgtggcataactggaccttgtgatctgtaaaagagatgacacttgctggacggttactaaactctatgtcaataaggcacgaagaatgtttttccagactgtggctcaagaaagcacttctttgtgcgctctgccatgtacg

SEQ ID NO: 595393 - DNA, 1158 bp, Homo sapiens
gagcttttaggaatcattgtaggacagacagagccctaaacaaccattcatgacttaagttgttggctcagtgtatgctggggacaaagaaaaactaacaagccgacctgcctttatgataaattctcagtgtgcttcccacagggcatgcacttcctgcaggtgtgcatctgtcccaccattgcaagcaactccaatacactagcaagcacaggggcagctgtgcagcaacgtggcattgttctaccaacttgcacaagggattaaccagaggcaagtggctgaggccatagagatcacgtatattccaagttcccattcgcaacactatatttcttggacaacgcggaacaggaagctgtgtaccgtcatggtcatagacagaccatggaaatccatcaacgctcagaaaggcaaagtactgattggcatcgacacacatgtgcgacggcatcaggggacagaatcagatcagacatacatagggaaatagaccagacatgccatgtacgacatggcccataatgggagcaaagaacctatgcagatacaagacaggatcagcagaagagctagggacaggaacatagtcatacgatgctactgaggacaacaaaacccgaaccagtaagcaaaacaaggcagacgtagagcgcacatgcgacactggcagatcaaaaacaaggacagacatgaacgcaccgagcactaggagacacaagcataacactggcaacaagaccacacacgttgacacacccaacgcagaaccacacaagacaaacaacgcaaccaaaacaaagcaaacaaacacaacccaacagaccacacaagaaaacagaaaaaagaaaaacaaagaacacacaacagcagcgcaagccgagaacacgacagaacgaaggagaggacgcgcagaagaaaaagcagaaaaaacgaaccagcaagacaaagaacgcagagacgagcacaacaaacggcagcccgacacccgacagcccacagcgagacagatcgacgaacacaacaggcgagacacaccacgaaggagaacagcgacacacctcgaagccggcagccggaagcagcgcgaagcacagccggaagcaggcacaagcgggcccacaacgagcagaagaagcagagcaaccactggcagcc

SEQ ID NO: 595394 - DNA, 188 bp, Homo sapiens
gagctagaccatgtagacgtaactagaagtgtgaaaaggtatggcttggattaaagcgacagcgatttctaggatagtcatgtggaattagaatggtgaggatgatacgtgtagagggaaggttaggggtggatatagctagggtggtgcttccaattaggtgcatgagtagggttaggtctacctgg

SEQ ID NO: 595395 - DNA, 101 bp, Homo sapiens
gctcggcccttgtgtatgagaactcaaacaaagctctggataaggccggttaaagagcaaagacgtcaagttggctgaggcacaccagcaggatgtgtgcg

SEQ ID NO: 595396 - DNA, 502 bp, Homo sapiens
  misc_feature (78)..(78): n is a, c, g, or t
  misc_feature (142)..(142): n is a, c, g, or t
gctcccgaattctgccaaaagtacatggaacaagcttctgcacagaccgccttcatatctgtgtgcggttacactccntatcacgtcacccgatatcccaaacatgttgtcttgtgctggctgcagaggctccacacaacgnatgcgacctgcctttggaaagccccagggcactgtcgccaggcttcacactggccaagtcatcatgtccatccgcaccaagctccagcaccaggagcatctgattgtagccctgcgcacgggccaagttcaactttcccggccgccagaagatccacatctcaaagaactggggcttcaccaagttcaatgctcactgacatttgaagacacggtggctgacaaccggctcatcccagatggctgtggggtcaagcacatccccactcgtgcccctctggacaagtgccgggccctccacccatgagggcttccaatgtgctgcccccctgttaacactcaccactaaattctactccct

SEQ ID NO: 595397 - DNA, 278 bp, Homo sapiens
ggggggggggggggggaattgggtttcttttttacagggcccgggtttttaaccaactggcccttggtaaaaaccccccataaaaacttttgggagggggggggggggggggcttcctttttggccaaccttcccagggtttaggggggggggggtttttttttccccaggggaaaagggtcctggggtttgggccccttcaggggttgcccccccaaaaaatttttggtggggtttttttttgtttttttttaaaaaaaaggggggttgggggggga

SEQ ID NO: 595398 - DNA, 129 bp, Homo sapiens
tctgagatccccaagatgttgcaacctcaagctcaagtacgcgcagatacgccggaggcacttatcctcacgtgacttcaacaaggacagccggggaagacacgcctgcgggattcggatcaacaccaa

SEQ ID NO: 595399 - DNA, 188 bp, Homo sapiens
ggccccccgaaaatgaaatccccggcctggtttccagttccgacccccccccaaaaagttttgggaaaggcccccctttataaccagttcctattgaccccccccccatggccggaaaaccccccgggccgtttttaacccaataaaaatttgtgtagtttgtggggaaaaaaaaaaaaccaccccca

SEQ ID NO: 595400 - DNA, 214 bp, Homo sapiens
accaagagaatactaagtcagaatagagcctaagcaaaaaactggatgcaccacattacctgacttcaaactataccagtaagagtctgcagtaatccattacagcatggctagtgactacaagaaacacactagacccatggtacacaaggttgctcttcagtgcaagcttcaattcgctctgccaggtgctaagccccactatgatgaatta

SEQ ID NO: 595401 - DNA, 163 bp, Homo sapiens
tctcaggacttccacttggatagcggatagcggacgatactgcagttgaaaacaggcactccaggcttagtgacagtggcagcagacacagtgttggctgctttctgatcctccctcatccgcttatactacatgtgtaccgcgctctcgattcgtaatcctt

SEQ ID NO: 595402 - DNA, 236 bp, Homo sapiens
tacttcagcaacgcacactgttcagcccagacgaaggacggagactacgacactggaaggcaatgtgtgaccctgtacttggctcctgggacagaaagaggacagtagtgcgaaattgtgtgaacaatcaagaaagaaaaaaaaaacctttagttgagagtattactcccagtggtaatattctcttcttgcgggcgtaaggggacggagtggcggcccaattaccaggctgaagt

SEQ ID NO: 595403 - DNA, 958 bp, Homo sapiens
tggggcacaggaggcgctaggggggaacgctgcctctgaaactagctctgggaccgggtctgcggccggcccctagctgccccgttcccatccccagaagggtatcactgggatcctgagcttggtatccagttccccacgaaaggattgtccccttttctaaaagctgctggagaggacttggacgtgtacatactaatccttgttgtggatgtgaggagaactctggggcacagactagaatgaaaaaaattgtgcaatgtggtcgggagaaaggggtaacagagtcagagaaaagctgtgggctctaagtgaagaggggttgaaaaccagtgtttaataaagagctttgagacgcacttgtggggcccagggttacagacaaaattacattaccatctttcaggggtgttgccggtgaaggtggcaaaccagcactttctggggcaaggccgtgttgcaaatttcaaccaacaaagtaactggcaaggacgaccacgtgctaagggagactcaaggagaagtcacattctttacaaggggaaggtcaattgatactgcctgatctaataaaaggggggtgactgaatatgacaaaccatttgtggcaaggagcacggtgatgcagtgtgattgatctcctgcattaggaagacacctaagggaccaattaaccctgtgtttgaggagcttgcaaagtccaagcatgttcacctcttgagatgatagcaggctggctgtcacagagatctccacctcgtgtggtccatctaactgtccggttgactacctgtgcggcaagtggtgggggtccaacaacgcggacgtggccacgacatgcagtccctaacctgtggacttgactgaacaggttactttggcgtaccaaagtcgaacggtggaccgtggcgcacagccatacagtatatgttccacacgagaacgcactttttttgaa

SEQ ID NO: 595404 - DNA, 161 bp, Homo sapiens
tagagtatcggggtatgcgtcgaatcataagaacaggaaggtaagaagtagggtctggtagacaaaatatgttgtgtagagttcaggagagagtgcgtcatatgttgtcctaggaagatagtagtggtgagggtgtttataataataatgttagtgtattc

SEQ ID NO: 595405 - DNA, 502 bp, Homo sapiens
tgagccggtccgtcacgcccacaaggactggtagatgtcagagctggaacctcaccccaggcctgactccaaaatccacactccctccaccgcacttcacattccttcccatacaacaacagaggcaacgtgggtctatgtggagagtgggtgctggaggacaatgatgtgaggcatgaagggtgtggaatgtggtcacggagcatgcagtttggccgggggaatgtggtgaggcaagaagtcaggcagcaaccacagcccggggctaggaaggggagtggaaaagtccgaggaccctcagactgtcaaacatgccaggagtacagagatgggaagacatgaccaagggtaagatgacgcatgccaggagctctgagcagagagggaagacagcaaggaggaggttgggaagttcagtccccacttgttctttggttttttttttttgagacggatctcgctctgtcacccaggctggagtccttgtggcgtacggtccggc

SEQ ID NO: 595406 - DNA, 191 bp, Homo sapiens
cactcgtatctgctcctcactgcacggatcttccatcaaggacatcctcatcagccatttcttgtactctttcttctctttatctatccagatccttgagtctttgccttagatcttccaactccgccttagacttcttctcagctgccatcagctgaacttcgtctctctgtaaccaacggggaggaacg

SEQ ID NO: 595407 - DNA, 437 bp, Homo sapiens
atagtatagacgacggtacacgttttatcgtgatagtggttactggataagtggcgttggcttgccatgatatgtgaggggtaggagtcaggtagttagtattaagagaagaggttgttagggagtcggaggaaaaggttggggaacagctaaataggttgttgttgatttgattaaaaaatagtagagggataatgctaataattaggctgtgggtggttgtgttgcatcaacattcatgtgttttttggaaagtccatgtcagatggtaagtaatcatcacattgtcgggacgcattcagtttcagccattggcagatcaggcttaggttcatgtacgtcatctcagagccatatgtgtaggagcatagcacatcagtaggagctaggccccacgctgcttcgcaaacgagacaaagcactagtattggcatcgg

SEQ ID NO: 595408 - DNA, 278 bp, Homo sapiens
taaaaatttaaacatttgtgtcaattacatattcatgtaggtaataaaaaaatctcactggccgggtgcggtggctcatgctgtaattccagcattttgtgagaccaaggcaggagaattacttgagcctagggagtttgagaccagcctggaacaacatgggtgaaatcctctgtctacaaaaaatgggaaataaaaaaattagccaagtgtgggtccccatgcctgtgggtccgggggccccatgcctgtgggtccccagcttacttgggggaggg

SEQ ID NO: 595409 - DNA, 154 bp, Homo sapiens
agtcataacccagcttcatattttaaaggcttcaggttgaaattaagtcaactgcatgcagctttgctgatcaatgaataatactctttgatgccatttatgagaaaagacttcaatatctgttggctggcatatttaagaaaaattactgttg

SEQ ID NO: 595410 - DNA, 231 bp, Homo sapiens
gacacattctaaaggtatcgtgaagatccatgcatatgtaataatcttctacatagataataaccatcataatcggaggcttgagaatagactagtgccctcgtaataatcggtgcccccgatatggtgtttcccgcataaacaaaataagcttctgactcttacctccctctctcctactcctgctcgcattctgctatagtggaggccggcgcaggaccaggttgaaca

SEQ ID NO: 595411 - DNA, 1523 bp, Homo sapiens
agcggggtgggcttctgtgaaacatggcggtaggctgggaccataacacaagcatgactatatgaaggacagcaggaaggttttcctgaagatgaggcgactgaatcggaaacaaaactttaacgttctcggtaaaacgacgtcgcgactgccttatccgaacgcgcttcctgacgacgctactgtagacgacctatcagccaagtggacggctacagctcttcatctaaataagcactttaccacaccctattggcgtcttacttacaccaagtaatttggacatatcatcaagctattactccacagaactccccactgcgacttgacacgttactcgaccctaagccgaaaagatacgaccaccccgcggactatcacgccctacgccccaccactctacaccgaacctttacacctaccttcccgaacctaacttcacacccctcggctctggcaccacataggaccacgatggtaccacactaacttgctctgccgacagccagagcaatagctcactaccggcgccccccataccgcaccacgacaaaaacgacaaatggcggaatctgaaccacatctccctggccccagaccaccctggagccacatcacaccccattcaaccgctgcccaaacgcaccgcaaggacccaagacctaacaactaccctatgacacttcccatacacatcgcgaaagcacccaaagcacacgcgcccagcggccaaaacgaagcgacagcgtgggcgacacaaagccaacggagcaaagtggcccattagggccaacgcgcgcttcggcaacctcttccccaacggataaggacctccaccgcggccaccttacacccaacaagacaaaacaacgcaccagaccccacatcttcaccccaacaaacatccacacgacaaccacccaacctctccatatgaaaccataacacattaacacccaacacacaaccgaccttagacccctatattaacgacaaaactcaatacaccagatcaaaaccacaacatattcccacaacatacctcaccacacccacttccacctctttactccacaaaaaaccccaaaaacaacacgtcgacaccataccacaaaacacacatcaccaacaaacaaaccaaaaataccgacacaatatcccgaaatatgctaaaaaccaaaacacactatgtacctcacacacaaaacaatattaatatcaaacgaccacaacaaatcacaaaacaccacctaaatgacaatcataccacaaaacgccacaccacacatatggacacacaacaatcaccccacacaccaacaaccccagaccacaacataatcacactccgcataacaccattccccaccaccactaaacgccaacaaacatattaacgcaacaaaactctacccaacatatacatctaaccgacatactacacacttacctacacaccacggacctccacaccacacaaccggcgccctcataagtagaacacataccaccaccacaaaaat

SEQ ID NO: 595412 - DNA, 655 bp, Homo sapiens
  misc_feature (308)..(308): n is a, c, g, or t
  misc_feature (388)..(388): n is a, c, g, or t
tcgagtttcgagctctgggcgcgtcaggtcggacgttacgtccgtccctttagactaatcgggttgtaaatcggtgcataccgagtggtgtatccctgcagttagcatctcagggttctcacgagcataggcccaggtaggggtcccgcggtaaaggggtgccaacacaagggcaaaattgggtggcaccaaaacagttgggagaggagatgcccccccccgagctggcttgagggcgggaaccccaaaatgatgggttccccttctcaaggaggaagggtcagccccggtagcacctttgttcccangatttttagggcctttgttacccccacctttaaggccttgggtcgcggcatttttaaggtcggaaggccttaaattggcngggggtcccccccctttgttttaagcccccaaaggaggaaaaagccggcatttccctccagaaaaaaggagggggtggggacccaaggttcagtcccttggttttaaggaccccctgtcctgattctttccagagggggggcccttggggttttttttttcgggggggatttttttcctttttgaccgggaaagggttgggtttttcaatttttttcccccaaaaaaaagattattcaaaaaagtttccggccttttggcaaacata

SEQ ID NO: 595413 - DNA, 949 bp, Homo sapiens
  misc_feature (49)..(49): n is a, c, g, or t
  misc_feature (65)..(65): n is a, c, g, or t
  misc_feature (239)..(239): n is a, c, g, or t
  misc_feature (275)..(275): n is a, c, g, or t
  misc_feature (344)..(344): n is a, c, g, or t
  misc_feature (348)..(348): n is a, c, g, or t
  misc_feature (407)..(407): n is a, c, g, or t
agcggactagggcggaggcagcggctgtagcggggctgtagccgggcgntgagcacagcgcgggncaggccgaacggaagggacctgccacaggccctcaactccacggactcttcgtccctagactagcggagctgcatctccgcgcttcgttggacgcctccgtaagcagcgaagggctctctctctcccgtgaccctccagccccatgacctgttcatatgcagccgagagctcangccaggcgggggtgttgtgggtacaggccatcgatncctgtgacccctcaaagagccaggatctcggtttccgcccgcaggcttccctcccctgtgatctccctncatngcagattctggggacagagctgtgaccgtagccgctaggatccgccgcgctgagagctncctcactgacgggtccctcctcggagtccccttcattggggtctccgtaagaagcaccaattttggtctctggcaagcctcgctgaactcgctgaacgaggtggggaggcctgcgtgtagagcaatgtgcagagtcgtgaggacacatccttgatacaacactggatctcctgtggatctccaaagcataatattcataagcaactgggagcacaagctatggcaagaggacatttgcgcaaaggcagcattcgaatcaaaggtggcacacattgacttgacaatcgtaggggaagctacttcggaattggaagcgtgcgtgagaaccgcatgacatgggaacggttagagttgaatcggtggcaagggacgactgtcatgtcaagggcctgatgaagatttcgtgggaggcaggaccagctggatacaagggggaccgcaagacgcggtggaaggatggatagccgtaaaaagggggaatttcaagagatcattgtctttaacagcatgtgggagcaatatggggcgcaccagtgtatccc

SEQ ID NO: 595414 - DNA, 876 bp, Homo sapiens
gggatcggcagggcggggcggaacggtgaggccatctactgaaacacagaagcaattttaaaagaaaatggaggcagtataactgatctttgcagaaagtggggaagtgagttgaccagagattaggatgagagaatgccaagttgtcactgaacgccaagctgagcaatggtgattctgcaagcatcagcaacatgcgtttgcaatggctgctactgtgaacttggaacttgcatcccatttttttgaaagccactaggtttcttgcattcacaagcaagtaaagattctgctgaacaagctaaacagcactgcttgatgaatctcttggctcggggccattgattccagttaccgtccatctcaacaaggcatgtggagccacccaaaatttcaagccacaaacaaacattctccattaagcacgagcccaccaatatcatccagtcttccttctggtaataatcatggcaggtcctcacaactgacacacggtcaagaaggaagctgaaacgagacctgtgatccaatgcacatccgacatcatgaaaggagttgatatccaccagaccctagatggccgaacccagaacacacagtcattctcccatttaactgtcccaaaagtagccactgtatctccacttatgggctgaccctttccaggtctgacgacgacccaggcctgatgctttgccactggagatggatgggcctgcgctgcgctggcaacgacgggtgccttcggatcactccgaatgctgaatgcacctctacaccgcatggcaaaccaggtacacggacaatacccctggtgatggcgcgtcccaagacgaggccaccccaccgcacccccgtcacccacaacgtgcacaa

SEQ ID NO: 595415 - DNA, 835 bp, Homo sapiens
  misc_feature (1)..(1): n is a, c, g, or t
ncttccggaaatgtaaaaatttcgccccccacttattgcctttttttccacacatggcccccctctaaattagctgcttccgcccacctcccctggttccccactaccaggtgtaattcaccgccccaaacaactcgtgccgcagaaaataacttttttgtctccaaacactcatggccacgaaacatgttttcaaaggcactacactccccgtgcgcctaaatatcaatcttccggcgtgtttgacacgaatgctctaatgacgccccctcttccccgcatgaaccatgtctttccatcacagccccctctccccacaatattggtggggacgctcacattctccctccgggagtactctattactttggctgggtgatcactcatcggacctagtaaacgacttttcaggaagaccccacgcctctgcggtgactttccatggttacaatccccccacgcacctggagtgtgcgatagaaaattaccactggggtgttctccccccctctctgcggggtttaccacccatacgtgggtatcctcaccattcctgttcatataaaaacgctttcgctgggtccttcttttcagaactcctaccgcatgaatatttttttattgctcctccaccatggttcctcccccacatcatcttccaaatttctgtctcccactcctctgtttaccacgcatgtcccatctcaaacgggcgacgtataaaagcccctttttccccgctcccacccccatctttgcggcgagcaatcaacatgaaacagacaacccatctgaagggcgggatatttttttcccaaaaaaccccaacataaca

SEQ ID NO: 595416 - DNA, 118 bp, Homo sapiens
ccctcccccatttatttttccccctcccgtcctccccatcattggtttttttttgggggtcaactgggcggtttttattttattccttttattttcccccttttcacaaagaaataaa

SEQ ID NO: 595417 - DNA, 547 bp, Homo sapiens
gcactcagggaggcagaagcaagaagatagcttgagcccagcagttcaagacctgcctgggcaacatagtgataccctattctccacaaaaaggaaaaaaaggcaaaataaaataaccaagagaatgacatgtctgatgtttttgaattaaatgtgtggaccctctgtctattaatgcaggcactagggggtttagtcaaactacgtctgcagaaaggcattagaaagagcagctgggaagagtacaggtgatttgattcttttcctaataattttcaagtgcccctggcatattaatacaagtttatggcattgccctttgggctttgttataaatgtgtgtccaaaaaataatttgttcctcctttgcctttgccatcttattcacagtctaaagcaatgttttagagtaaatgtggtgatctgatgcttaaggatgtaatttcagtcttagcttctataaatctctatttagtgttcttaaaagattttctttgtttttttcagtatacttcttgatgaagaaggtcacatcaagttaacaggt

SEQ ID NO: 595418 - DNA, 225 bp, Homo sapiens
tgagggggcagcatgtacccggatgaagatgtctatgagcgtgcacaccttacttatagggtcaacaactccgatcggggtggtacccagaccgtggcgtctccgcccctcggggtgcacgcgggcgagggacggaggccgaggtggctggggctgcccccgggagccgcggaaggggaaggcagggacgcgagtctctcacctcgggcagctcgccgcctgagt

SEQ ID NO: 595419 - DNA, 277 bp, Homo sapiens
atttaatttttttaaattcccgttaaactctattttatggttttgatttcagattgcaaacatgttaaacccgcaaccaagcgagtcctcggttttgccggtttttttagttttttactgtccctgtcatggaaacagctaattttctgtggatggtgctgtaaaggaagcatgttcctttcatgggtatttaatcatgatgtttaattttgcccccctatttggaatgttttttttaaataaaaggggctaattttgttgtagtttggcgcctgta

SEQ ID NO: 595420 - DNA, 150 bp, Homo sapiens
atgtagtcactcatggggatttatgtaacctgtatagagcctttaatgtgtcacatgttctccgaaccccatcgtctcctctctgctccaaaacgccatcatcttttggtcaaacagactgctagctgatcttcctgcatcccactcccg

SEQ ID NO: 595421 - DNA, 872 bp, Homo sapiens
gttatacccaattctaatcgcaatggcattcctaatgcttaccgaccccaaagatattgggctatatacgaacgtacgccaaaggccccaacgttgtagagcccctacgggctactacaacccattcgactgacgccataaaactcttcaccaaagagccccataaaacccgccacatcataccatcaccctctacatcaccgaccccgaccttagactcatcaccatcgctcttctactatgaaaccccaccatccaccatacaccaaccaccactggatacaacacatcaaacactaggacatcatatataatatctagaacaaccatcatagacactagacacagtagatacatcaacatcctcatgcatcagaggaatgaacgacaatcacacagacatcagacaaagtaacgaccccatgaaagtccgagacgacacacatgcagtacgaacaaagaatcagcccaaacaagaacagaaatcatcaatactgcacgatacacacacataagaagccaatcaaatataaataacataatccaaaaaacatataccattaaaataaacagaatgacaaatcacatctataaaacacatcatcgctcaccacatttacataacaacaacacaaacaaaagacaaacaccacctgcaatgacacattaacaattcccaatgcaccaaatccacaatgaaaaaccacctaatgacaaccaaattacaatcatagaatcctaatacatacaccacacaccatacggcaaagcaagacaaccaaaaccacaaaaaacaaaccaataaaaaaaacctatgaccaaaaacagagaagaaaatatcccaatcacctaaatactccaaagactaacca

SEQ ID NO: 595422 - DNA, 348 bp, Homo sapiens
  misc_feature (43)..(43): n is a, c, g, or t
  misc_feature (45)..(45): n is a, c, g, or t
  misc_feature (105)..(105): n is a, c, g, or t
  misc_feature (244)..(244): n is a, c, g, or t
gttgagcccaaagagcttgcttacttgctgggaggcagggcgngnagacgctgacttcaggacgacttgggcctgcagaggtcgccaggaggcccaagctggcgncggaggagcccaccgaccggagaccgtttggggcctggagacgccatcggagggcaggagctgatcctggagaggccaccgtgagcctgacctgggcctggggagcttggcttgaggaagctgtgggccgaccaaggcngccagaggatgggcaggcgctgagtccaaagaggttgttgggaggcagcagtcgggcctggagacgcagccgggaggaagagctgggcccggagaggacgccgg

SEQ ID NO: 595423 - DNA, 237 bp, Homo sapiens
  misc_feature (87)..(87): n is a, c, g, or t
cactctgcagtctttcgaggatgcacccagggaagcgtggcccggcccgcggtgacaaaggcctcgtcatcactctgtggtcttttnaggacgtatcccgcgaagtgtggcccggcccgtggtcacgaaggcttcgtcgtcactctgcagtcttttgaggatgcacccagggaagcgtggcccggcccgcggtgacaaaggcttcgtcatcactctgcggtcttttgaggacgtatc

SEQ ID NO: 595424 - DNA, 1296 bp, Homo sapiens
  misc_feature (166)..(166): n is a, c, g, or t
ggtagatagacgatggtaagatgtaggaaggagcttggtgacaggtaagatacggggtcagaagacgaacataacgaggaacctgaggatgtagggagtagacgatgagtgatctaacgtggagaataaccctagttttgataaagattaccgtgatgtgtgactngtagaactggtgattatgaggcctactattcaccgtcatgcctggcgtcttgcgatacccgtgcacacacgcgtgaagctgctgatacgttggctagtcatcgcgatattgagtagtcgtcctgtgtgatggagaagatgtggagagacgcaaggcgatacgtagcgtagtggttgacgtagtcgagttggagtgtcgcgccgaggggagcgagcgaggagggagcgtttaatcataagaatctcatgaattagcacgaggactatcattcagtgcttgacccttgtagacttgtcgcttgaatgcgttcgcgtgcttgggtggtccgcgtggaacttttgaaagcatggtaatctcgcaaagaaatgggcgagacctcgaggagcagtgcctcttactggcattacagcgactgggagtgtgacaatcaacgtaaatcgtgcggtgttaaccaagaactggattccacgtgaggccaccctagcaggcagaacgacgatatgagggaaatcgttagaggaagtcagcacttacattacgcaaaactggctagcaacgcgacacagtagcatatgtgccaatctctggtcggcaatggtgacaacatgctggagccaaggtgctaacatgactgagtcccgggactggacaagtcacccgtaggggatggcaatggccacgtggaaccccgctgcttgagagtcctgggactgggatcctaacaaccactacgtacaaattgaacaggcccttgcagcaggctctacaaggatgtctacaacaccgggggagatgggaacgaggccggttgggccgaacgggcgacacgggggcccaaaaccgggaatgagcggccacgagtgaccacgaccagacacaaaggagagaaaaaacgttgcgtaaacgtcaccggaaaactaaaaaaagcgagcccggcgagaaaggagagtaccgcaaaaaaataatggagcaagaacatagagcaagcagggaggcgaacaaacactgaggaaacaatcacccacaaagaagaaaaaacagaaaggagagacactagaacgacaagagtgtattcaaagacgacacaacagaagaaatgcaacatccttcacagcgtcagccgctcagga

SEQ ID NO: 595425 - DNA, 883 bp, Homo sapiens
aggatgctcagacgcgtgcgactcggttccgtagcaaattgatcatcgcaaaagcgcaaagtgacgagaaacttgtggtgatagggcgtcttaaatagtaggtctatatcgtcatactgtctatactctgggggctatggggacgagagaacgtcgtatgatgtggttcgcaattgaactctcctatctaatgaacaccattagagttgggcatagcattctctacgcgtagcactgtgtctgggaaacactagggtgcactgccaaggtgactgcgctttccacggcagtggtagcactacaatacagtgctcactgtgtgctgaacgcctcctgggaaacatgcaagacggggcccttctctagggaccagtggatggtttggtggacaccctaggggaagtggataaagaacctctagggcttgaacaacttgggcacgcgaaaaccttggatttgcataagtaaaacctatctgcgcggtagttggagtaccactgtgtcccgaaggtagtatcgcctcgaggaggtagtggtgtagtccgcggacgtacatcaataattgctatagttcgcggaagctaaccgtgtggtccatgtacgggcactgggggggcaaggtccaacacttgggctaggcatcttagaatacttacgcaaacaggagtaccattggggaatccgtgccgcctttggctcggaagataatacccaattcaataaacgggtaaggagactagatgttggaattttgccgcttttaaatcgccacacggggtaatttgacataggaattcgtgcgaaatgcgggccacgcatacccttttgccccgtcatagctcggagggaatccatactcccaaaagggatcatcggccggcta

SEQ ID NO: 595426 - DNA, 1435 bp, Homo sapiens
gattgaggaggtgaagagcactacgaagacgcagcgcatcgcctcccacagaccacgtgcaaagggctggggctggacgagagcggcttggccaacgcaggcggcctcagggcattgtggtgcccggagacacgcgcgagatggcactgtgagcgtcaatagtagaacttaactcaaaagcaaagaaacatggctggaagagctgtcttagtaagcgcagagacctcctggcaactaggccaagcacagctactggcatctggctcatttgctacaggagacatagggatagtaacaggtacccacttctagcccaatcggtaggagcgagtgacacgtacacctcaagctgacgactcaacgaacgaccacgagagtgctgactggacgacaactatccgacagaggaccaactcagggacatagcgacacataaacaaggacgacccacaaggccacgctctcacatgcacaggtagacagatatcaacagcacgcataaaattcacgctgtcgagcaacacgaagcacattccccactggcgaacgggactactgagacaaaacacacgaaatgaagacccactgttgcctacactaagcgcacatcacaaaacaccacggcccaacgcaggcgacaaacccacaaaaaccacgatcggcacacaaccacggcaaccgcccaggaagacatcctaccggacacacagcaatcagcgcccgcacaacacgcaacgcagcaggactacgcaacacgagccacggcgaagaccgtgagccggccactaaaacccccgcaccgaagcagggccacaaaacgatagcttgggaagcggcacccgtcaggaaacagggaaggcgaccccgagcggcaccaacagagatggcgcgacagtaacccccgatacacgtgaccaccacaccagtgcacaaatatacgcgacacccacagcgcaccaagcagcgatgaacacaggcaaggattcctatggaatcgccaccccacagctggccacaaaccaacaggggtaggaaaatgatatgtaagaaggacacacacacacggcaacacaaggcacaacgagttcacaatcccaagagagaacatgaatgcacgcccatcgagcaccagtatgaccacccttgagggaaacatggataggccactacagcgttggcgcacggcgggccaccaccgaagaggcgagcaggaacacaaaacagcacaaacacccgaggagagcagccaaatgagcacagaggtgtgcaccagcatacagagtcgtaaagcacgcacaaagacacaacaccagaggatcacgagaccaccaaacggacacgcagaagcaaatacaagaacggcaggaacaaaccatcagctaatcggcgtgggccgcgaacgacacagaatcacaatgtgaacaaacaaagtgga

SEQ ID NO: 595427 - DNA, 387 bp, Homo sapiens
atgtttctcaggacttgtacaaagtatcttgttcatagcagcatctcatctcaatatctgctcaactacattatttccatcactccactacttataatcacaacatctgccatgatgggaatacaatttgagccttaaacaatcattctcactttatttgtaaaatgagacatggtcatgtactgtcagaaggtaatgaatatatataatggccatctatcagtttttaaagtgtgtttctttctatgtatatatgcaacgttaagcattcagactatgtatgtattgacatcaaactatctgtatatatatgtgtgtgtgtatatatatatatatatatatatatatatacttctcactcatagtaatatcttttcatgatcattc

SEQ ID NO: 595428 - DNA, 244 bp, Homo sapiens
caaaaacagcagacatgcatccagtctcctgcatgcgctgatggatcttgcagtacaaggtaacgactgacggcctcctgggaccaggactggtggtaaaactcagcaccggacgctcctcttcagggttgccggctacatctgtcatcaccttaaggtacccaggctctgggagcggagcatgtcttggacatcgcctttggggtctctggagaagcttagcatgaagacctaagcacctata

SEQ ID NO: 595429 - DNA, 409 bp, Homo sapiens
gtcactgcacctccatctcccggtttcaagagattatcatgcctcagcctccaagtagctgggactacaggtgtgcaccaccacacccagctaatttttttttttagttgagatgggagtttcaccatgttggccaggctggtctctaactcctgacctcaagtgatccgccgtgcctcagcctcccaaagtgctgggattacaggtgtgagccaccatgccttggccaatagtttatttccaatggcgatctattacatttgggtctcgtttgtcataatttgtgcacataccctttttcacagagtattttcctcggttgtggcatgtcgccaaattgtggacacttttagtggtttgtttttcgcccaagagttccccgaacgtgcgcccaaagggtagcacacgg

SEQ ID NO: 595430 - DNA, 683 bp, Homo sapiens
  misc_feature (7)..(7): n is a, c, g, or t
  misc_feature (136)..(136): n is a, c, g, or t
  misc_feature (147)..(148): n is a, c, g, or t
  misc_feature (158)..(158): n is a, c, g, or t
  misc_feature (184)..(184): n is a, c, g, or t
  misc_feature (188)..(188): n is a, c, g, or t
  misc_feature (235)..(235): n is a, c, g, or t
  misc_feature (257)..(257): n is a, c, g, or t
  misc_feature (263)..(263): n is a, c, g, or t
  misc_feature (279)..(279): n is a, c, g, or t
  misc_feature (293)..(293): n is a, c, g, or t
  misc_feature (302)..(302): n is a, c, g, or t
  misc_feature (304)..(304): n is a, c, g, or t
  misc_feature (318)..(318): n is a, c, g, or t
  misc_feature (329)..(329): n is a, c, g, or t
  misc_feature (332)..(332): n is a, c, g, or t
  misc_feature (337)..(337): n is a, c, g, or t
  misc_feature (356)..(358): n is a, c, g, or t
  misc_feature (362)..(362): n is a, c, g, or t
  misc_feature (379)..(379): n is a, c, g, or t
  misc_feature (381)..(381): n is a, c, g, or t
  misc_feature (383)..(383): n is a, c, g, or t
  misc_feature (393)..(393): n is a, c, g, or t
  misc_feature (421)..(421): n is a, c, g, or t
  misc_feature (425)..(425): n is a, c, g, or t
  misc_feature (436)..(437): n is a, c, g, or t
  misc_feature (452)..(452): n is a, c, g, or t
  misc_feature (459)..(459): n is a, c, g, or t
  misc_feature (467)..(467): n is a, c, g, or t
  misc_feature (489)..(489): n is a, c, g, or t
  misc_feature (502)..(502): n is a, c, g, or t
  misc_feature (535)..(535): n is a, c, g, or t
  misc_feature (537)..(537): n is a, c, g, or t
  misc_feature (548)..(548): n is a, c, g, or t
  misc_feature (559)..(559): n is a, c, g, or t
  misc_feature (608)..(608): n is a, c, g, or t
  misc_feature (642)..(642): n is a, c, g, or t
  misc_feature (652)..(652): n is a, c, g, or t
  misc_feature (658)..(658): n is a, c, g, or t
  misc_feature (682)..(682): n is a, c, g, or t
atgagangatacacaaaccagttttcaaatagtaaagccagtaatctagcaattgtaagaaataggtaaaagattataagacaccttacacacacacacacacacacacacacacacacgtgtgcacgccaatganaaaaaacaatnnggcctctacnaaaataagaacatgaagacccttaantgcngcgaggggggaacactgtgtaacccctccctacaatccagggagtgncctttaatccaatagcaaagcngggcanatgtgagaggagtgantgtgagagcgacgnggaaatccngnggggaaccattgangtgcacccacnggngcgcngaaaaaatgccaatgattnnncgcncccactgctgcggcggngncngccacagccncacagagaccccagacccgcgggccccnggcngggcagcgcanngcggggagagcaagngataggnctcgtctntgacgtgacagaagcgatagancaaattgcctggncggtcattgtaataaccagagaagtaaattctnanccctggcagcngcttagcaggngggctcaccccaattttcataaattttctcttgtggggctttttgagtnccaggagggcataaacataatccatgccgatgtnattggcattncccttnacccaacccttgggcacatgggtnc

SEQ ID NO: 595431 - DNA, 401 bp, Homo sapiens
  misc_feature (11)..(11): n is a, c, g, or t
tccatgaatangggagcttcctcctaaagtcactacccaaggcagctatttcctttttttttttgaagacgggagtttcactcttgttgccccaggctggagtgcaatggcacaatctcggcttacctcaacctccgcctcccgagttcaagtgattctcctgactcagcctcctgagtagctgggattacagcatgtgccaccatgcctagctaattttgtatttttagtagagatggggtttctccatcttggtcaggctggtctctaactcttgacttcaggtgatccacccacctcggcttcccaaagtcctgggattacaggcatgaaccaccgcgcccgccaccaaggcagctatttctatgaaggcaaatcacagggagaaagtaatacaaatt

SEQ ID NO: 595432 - DNA, 362 bp, Homo sapiens
  misc_feature (15)..(15): n is a, c, g, or t
gggccacccggctantaaagtacgtttaattaaaaaaacagctttgttttaattaaaaaaaaaaaaaaaggccaagcacagtggctcacgcctgtaatcccagcacttcgggaggccaaggtgggcagatcacctgaggttgggagttcgagaccagcctgaccaacatgaagaaaccccgtccctactgaaaatacaaaattagtagtggcgcctgcctatagtcccagctactcgggaggctgaggcgagagaatcacttgaacccagggaggcggaggttgtggtgagtgggagattcacaccattggcactcagcctggggcaacaaaaggcaaaattccatcttttaaataggttaa

SEQ ID NO: 595433 - DNA, 468 bp, Homo sapiens
cttactgggttaagttcggtatagtcgactggataagtattataatatgagctacttagctgtggtggtgtaccctctctgtgaacagatatgcaggcaaattaatggccttttctaacatagttcaacccaccaaagagctcgacaccatcgttaccttgaaaccgattatggatcatgcccgcaaggatccaatctactgattgcatctatgtgcggggtgaaaggtctgtgctagatcaataaggcacggggtggcgatgtggcggagaagttgcttgtggggagaccttgcttttaacaggcttctggaaaagctagggaaaagtggttgcccgctttccccctttccctccccttcaagcaccgcttgagatttgggctttattattaagagctgctataaaaacagcttgcttaaatgttaagagaagcccaggggtacttcaagcattccttcggatgctt

SEQ ID NO: 595434 - DNA, 558 bp, Homo sapiens
  misc_feature (12)..(12): n is a, c, g, or t
  misc_feature (63)..(63): n is a, c, g, or t
  misc_feature (66)..(66): n is a, c, g, or t
  misc_feature (74)..(74): n is a, c, g, or t
  misc_feature (98)..(98): n is a, c, g, or t
  misc_feature (101)..(101): n is a, c, g, or t
  misc_feature (103)..(103): n is a, c, g, or t
  misc_feature (106)..(106): n is a, c, g, or t
  misc_feature (151)..(151): n is a, c, g, or t
  misc_feature (153)..(154): n is a, c, g, or t
  misc_feature (156)..(156): n is a, c, g, or t
  misc_feature (160)..(160): n is a, c, g, or t
  misc_feature (163)..(163): n is a, c, g, or t
  misc_feature (169)..(170): n is a, c, g, or t
  misc_feature (180)..(180): n is a, c, g, or t
  misc_feature (223)..(223): n is a, c, g, or t
  misc_feature (242)..(242): n is a, c, g, or t
  misc_feature (244)..(246): n is a, c, g, or t
  misc_feature (275)..(275): n is a, c, g, or t
  misc_feature (292)..(292): n is a, c, g, or t
  misc_feature (325)..(325): n is a, c, g, or t
  misc_feature (342)..(342): n is a, c, g, or t
  misc_feature (344)..(344): n is a, c, g, or t
  misc_feature (349)..(349): n is a, c, g, or t
  misc_feature (352)..(353): n is a, c, g, or t
  misc_feature (478)..(478): n is a, c, g, or t
  misc_feature (549)..(549): n is a, c, g, or t
agatatacagtngtacaaattagcttcaagttacacatactgaaaaaaagagggtgagcgagnganggtggggnggagtgaggggaaggaggaaggtngancnggnaggagaagaaacaaaagaattgaacaggcatgcaggcttttccanannancttnaangctaanntgcttcagtnggagagtaaagtaggcaagaatgagcagccacggattgttganctgtaaccagcaccaggcntnnnagcgaactattgacagcggagtgggaaanattttttacagcaaaancattacaacgaagtccctccccaaaccaccttnaaccatctaaagcgaananccaanaanntgcaaacactggtataaaacacagtttaaacaattagaaaaatgaaaactgaaaccactgatgcctctatagtgtgattaacctctctctaagatgcttgcatcacctatgggtctaaaggcttncaaatgtaatttccatttgctaatggtgatcttgccacaactggcacggagagcgacacagtaatgctganaaagcctct

SEQ ID NO: 595435 - DNA, 1413 bp, Homo sapiens
gggtgcgctctagcgttaacgttactccgacggagataccagtcggtagaggagaacgtcgaggttagagggaactgggaggcactatatgctgtctgcaatcgacagttcgagcaggcccagtatttaggcgacagtgaatttattactctgaagagggttctgcacatatttccaacacttatatcggtggtcatcagaagtaggtgataggaagaaatacttactacacgggtgcaaacatgccgagtaatcaacacttttaacttggagcaagcataaaccatactaccaagaaagcatcatcaacatcaccaccagcagcagcaccaccagcagcaacagcagcagccgccaccaccgccaatacctgcaaactgggcaacaggccagccagccacaatgaacggcttgacctatcgacctgaacagaacttttcagaaaaccagggagagacagaccttcacccaacggcacgccgctctacaagctgggaaatctatcctcccgacactcactgcacggacgacacactgacgggaaacgctatcagcaaggaacatagtggacaacagggcagagcggaaagacaaccaatccatacaccgggataacacgggactcagggccagaagtccccgccaaggaaacacccccgaaacccctaaccggaccactggccacaaagtcggcgccatggccacaagtcatcagcccaccacacgagggcaacagccagcctggcgatgctggcacataaggacacagcacgtcacctgcatacacaataacagcgcacaaaaaccttccctcacagaaaaacaagatccaagcaaccgtgcgcgacagacagcccactacaagcgaaaggccaagagaaacaacaggcagcagcgccaacatgcgcgacaatagacacgccgtaaaagcgacatcagagaacaggacgaaccgatacacaccaacacggaaagcccgagggcaccgaccaccacgcgaacacgcgcccacgaccacccatacgaccagcccactcagtccccgaatacagagcacaacaccgaccacgaccaagagaacacaaagcaaagaacaaacacggcattcgagagagaaaggcagcatgaacactgcagacacaactaacgaagacagaggtaagagcactttaagatgtacgcagacgagagtcaacgacgtcagtaagctgatagaatcaagagtagcattacttgcctgacaaacgcgatcatagaaatacgtgagaatataagcgatgacgggaggcagcaacaccaatgtaatgccaggggagagctagcacgagtagaaagaagaccctgcgctcaccaggcaccagagagggtcagcaccatctgcaaccacacacaaggagcaacccagtcaggaat

SEQ ID NO: 595436 - DNA, 2507 bp, Homo sapiens
cttcagttcaactaaaaatggacagatctcagcagaccagccgtacaggatactggaccatgatgaacatcccccctgtagaaaaagtggacaaggaacaacagacatactttagtgaatcagaaatagtggttatttccaggccagatagttcttctacaaagtcaaaggaagatgccctgaaacataaatcgtcgggaaagatttttgctagtgaacaccctgaatttcaaccagcaacaaacagcaatgaagaaattgggcagaaaaatatcagcagaacttcatttactcaggagactaaaaaaggtcccccagtacttttagaagatgagcttagggaagaagtaactgtacctgttgtacaagaaggttctgctgttaaaaaagtggcttctgctgaaatagagcctccatcaacagaaaaattcccagctaaaatacagcctccattagttgaagaggccactgctaaagcggagcccagacctgctgaagagacccatgtccaagtacagccatcaactgaagagactcctgatgctgaggcagccactgcagttgcggagaattctgttaaagttcagcctccacctgctgaagaggcccctttagtggagtttcctgctgaaattcagcctccatcagctgaagagtctccttctgtagagcttctggctgaaattctgcctccatcagctgaagagtccccttcagaagagcctcctgctgaaattctgcctccaccagctgaaaagtctccttcagtagagcttcttggtgaaattcggtctccctcagcacaaaaggctcccattgaagtacagcctttaccagctgagggcgcccttgaagaggccccagctaaagtagagcctcccactgttgaagagacccttgctgaagttcagcctctattacctgaagaggctcctagagaagaggctcgagaacttcagctttcaacagctatggagacccctgcagaagaggctcctactgaatttcagtctccattacctaaagagaccactgcagaagaggcctctgctgaaattcagcttctagcagctacggagcctcctgcagatgaaactcctgccgaagctcggtctccactatctgaggagacttctgcagaagaggctcatgctgaagttcaatctccattagctgaagagaccactgcagaagaggcctctgctgaaattcagcttctagcagctatagaggctcctgcagatgaaactcctgctgaagctcagtctccactatctgaggagacttctgcagaagaggctcctgctgaagttcagtctccatcagctaagggagtttctatagaagaggcccctcttgagcttcagcctccatcaggtgaagagaccactgcagaagaggcctctgctgcaattcagcttctagcagctacagaggcttctgcagaagaggctcctgctgaagttcagcctccaccagctgaggaggcccccgctgaagttcagcctccaccagctgaggaggcccccgctgaagttcagcctccaccagctgaggaggcccccgctgaagttcagcctccaccagctgaggaggcccccgctgaagttcagcctccaccagctgaggaggcccccgctgaagttcagcctccaccagctgaggaggccccctctgaagttcagcctccaccagctgaggaggcccctgctgaagttcagtctctaccagctgaggagactcctatagaagagacccttgctgcagtacactctcccccagctgatgatgtccctgcagaagaggcctccgttgacaaacattccccaccagctgatttgcttctgactgaggagtttcctataggagaggcctctgctgaagtttcacctccaccatctgaacaaacccctgaagatgaggctctggtagagaatgtgtctacagaatttcagtcaccgcaggtggcaggaattccagcagtaaaattaggatcggttgttttggaaggtgaagcaaaatttgaagaggtttcaaaaatcaattctgtccttaaagatttgtctaataccaatgatggacaggctcccactcttgaaatagaaagtgtttttcatatagaattaaaacaacgtcctcctgaactgtagtcaggttgtacctaagctagcaatcagaagctacatggttttggaagaacatactttagaaaagggtgggcagcaggaagtagctttgtcaataaggcaaattaaaggggaccccaagacttggaatacaggttggaaaatgaacaataaaaactgtagcagcataaaattacttgtgttaatttcattcaaatttatggcatgaaaaatacctattttgaaagtaagtttataattgaaaaaaattgcttaaaatatccttcctacagtaaacttgttgacacgagtaaagtttaatctgcagccatcttttcttgtctttgccttccctttataagtaaatatagtttctagtgg

SEQ ID NO: 595437 - DNA, 123 bp, Homo sapiens
ggagcagaaacattggaatgccaagacgctgaggatgctggtacaagttgtgggactgcatgctactgtctaaagcttgtctcaatggatctaaaacttcatcgccctcttgcccgcgttcct

SEQ ID NO: 595438 - DNA, 221 bp, Homo sapiens
tatagatactagtccagaccttactcaaaggtaaggggatgaaacaaggtatgaatatctggaggtgctgatatccagagctcgcttctatatcacctgtaaaccctgtaaggccgaaagttaagtgtagaaatttaattagtttgatgatgaatgtctttaattcaaacatgtgagaggtaatgttttatacttatgttgtatgacacagtaattcggta

SEQ ID NO: 595439 - DNA, 306 bp, Homo sapiens
tttgctgttgtgacctgaggtcacttgcctgcccttctcctgaactgcaactgtaggggcctgtagaacctggttcccccttgttccaatttccccacctcagtgaaggcacaaccaaaagtgtccccgggcattatcaaagaccctccaggccccaggtctgagacaaaggggaggcagggttctccccagcaatcagtggcccgagcagggatgtgccattgcggccacaagaccaccaatggagtcggagccgccccgaaggggagggggctgcacaaatgccaccacacaggggggctcgga

SEQ ID NO: 595440 - DNA, 297 bp, Homo sapiens
atagcctatagctgggcaggaaggcaaaaggtggcctttctgtgcctggcagaaaaagagggtctcagccgggcgtggtggtgatcccggcctttgatcccagcactcaggaggcagaggcaggcagatttctgagttcaaggccagcctggtctacagtgtgagttccatggccagccagggctacacagagtaaccctgtctgaaaacaaaacaaaacaaaaaaataaaaacagacaaaaactgtacttagatgctaccagaatggcttcaatcatgaaaacagccaaaaaaggg

SEQ ID NO: 595441 - DNA, 661 bp, Homo sapiens
  misc_feature (1)..(1): n is a, c, g, or t
  misc_feature (17)..(18): n is a, c, g, or t
  misc_feature (252)..(252): n is a, c, g, or t
  misc_feature (348)..(348): n is a, c, g, or t
  misc_feature (415)..(415): n is a, c, g, or t
nccgcctcgccgtcgcnncgggctttctccggtcgctgccgccaccaccgttgcttcgcgggctgggaggcccggggtccccgggcgaacagaggctgcgggtgggagccttcgcgggcgctgcagagcgggccgggggaggccgggatggagccccgcggagtggactgacgccgcaggggcgagctagccggctccgcgcctctccgcgggatccagacgcctcctggggctgctggcggagggtctgangcggcgcggccatggctcacctccggggatttgccaaccagcactctcgagtggaccctgaggagctcttcaccaagctcgaccggcattggcaangggctcgttatggggaaggtctacaagggccatcgataaccacacaaaggaggtggtggccatcaangatcatcgacctggaggaggccgaggatgagatcgaaggacatccagcaaggaagatcactgtcctcgagtcagtgcgacagcccctaaatcacccgaatagtttggttcctagctaaagagcaccaagctatggatcatcatggagtacctgggcggcgggagcagacacgggacagtgcctaaagccaggtcccactgaggaagacataatggcacagaaactgcggaaatcgaagggccgcat

SEQ ID NO: 595442 - DNA, 144 bp, Homo sapiens
ttctgcacgggtgtccctgcatctgactgagaagaagaacagactgaggaaacgaggctcttcaacagccccagttatcctggccccatgacctgtggctacagccctgctccagcagcacttgcccattccttacagcccttc

SEQ ID NO: 595443 - DNA, 599 bp, Homo sapiens
  misc_feature (1)..(1): n is a, c, g, or t
  misc_feature (17)..(18): n is a, c, g, or t
  misc_feature (190)..(190): n is a, c, g, or t
  misc_feature (286)..(286): n is a, c, g, or t
  misc_feature (353)..(353): n is a, c, g, or t
nccgcctcgccgtcgcnncgggctttctccggtcgctgccgccaccaccgttgcttcgcgggctgggaggcccggggtccccgggcgaacagaggctgcggtggactgacgccgcaggggcgagctagccggctccgcgcctctccgcgggatccagacgcctcctggggctgctggcggagggtctgangcggcgcggccatggctcacctccggggatttgccaaccagcactctcgagtggaccctgaggagctcttcaccaagctcgaccggcattggcaangggctcgttatggggaaggtctacaagggccatcgataaccacacaaaggaggtggtggccatcaangatcatcgacctggaggaggccgaggatgagatcgaaggacatccagcaaggaagatcactgtcctcgagtcagtgcgacagcccctaaatcacccgaatagtttggttcctagctaaagagcaccaagctatggatcatcatggagtacctgggcggcgggagcagacacgggacagtgcctaaagccaggtcccactgaggaagacataatggcacagaaactgcggaaatcgaagggccgcat

SEQ ID NO: 595444 - DNA, 1148 bp, Homo sapiens
caagattttcagcatccctaaaatcacactaagaagataaacatggaaacagcttggagctgccctacccatagtgaggtggtactgactggaagacagcttaaacgatttggagaaaagtggaatacattaatctcagaaaactctaccacctgtagaaagagagctaaaatggagacaaccacaggcagtctaagatacgctgaactactacagaaaataatgcagcatgaaggaatgctggaaggtatggggtcagagcaagctgatggagggtccttcatttccaagccacgagtacagcaggatgtaaggcttagttcataagaacatctcctgaaagacaatctctataaaaactgtttcaatagaaagaatgcaagatgtaactgtttaataataggactgatattttaaaaaacaaatgaacgtaatagaagactagatggatgtgcttctcaaagtcctctctgtgggaggcttcatcctcactctagatgtgttgcctgtagcagctgttattgattacccgcccatagcctatccatacttactcatcattcctttacctaccagtggcatcctattggaagcacctgcgactttcttagggctttctcttggccaagcattggaaggccagcagtattgaaaagttaatagtcttggaagcactggccctcaactaatgacaaagaaaaaatataagataaattccccagcttccttgcctcctgaatgggtcaagtctgtggtgtgttctacccgtttttcagaggtcccatgttttaaaccctagctgctcaaggcaatttcctgatcattgatgtactctctattggctaatttttagataatatggaatatgctcaaaataggatactcaaagaaaaaatcagatgccaaaattatgtacaccgaatgagttcaattctgtataagtgtggacatacacacatcaaaagaaatatggaacaaaagatataaatgtttcatagtgggtaataactgagtgttgaaaatttaagtggatttgcctttgaatctagataatggtatctatagagaaggaaatcaatattaccggaatttactgtaaaagtagaaaaacgacataggtaattaaaagggataataagcgaaaaaga

SEQ ID NO: 595445 - DNA, 966 bp, Homo sapiens
gaaggtacagtcgccgcgtgcggaggtgttcctggttacttggcctcatggcggtccgagcttcgtttcgagaacaactgtgagatcggctgctttgccagactcagcaagacctactgtctggtagcgatcggaggctcagagaagcttctacagtgtgttcgatgggcgagctctccgataccatccccgtggatgcagcgcgtcgtatcgtcggatgccgcatcatcgggcgcatgtgtgtggggaacagggcacgcgtctccgtggtacccaagcaataccaccgaccaggagctgcaagagattacgtagatagcctcccagaacacagtgcagattaggcgggtggaggagcggtctcacgtcttgggccaatgtcatacactgtaaatgatctacgtgagcttggtccacccacgagcattgtgagggggacgacagagagaagattctgggagatgtgctcaaggtggaaagtcttcagacagacagtgggcgaccaggtgctagtaggaagcgtgctgtgtcgttcagcaatcagggcagggttggtgcaatcccatagatttcaattgaagagcaggatgagctgtcctctcttcttcaaagtccccctgttggcggggactgtgacccgaatgacatgtgagcgtgatttggtgctgggatggtggtgacctgcctgggtgtgcttctgtggctggacctcaccagctctgatgtgtcagtgcggagagtgtctccaagctgaatgaagcctgctaagatgcgttgcaacagggtgagggatccgtcttgaaggctgagctgtttacttcctcgttgtccttgggcctggcttgcctgtggccacttttcggttcgccacttggcgggtgtggggggggggcagacgccggacgagggtggcgccccttgctggtcgggtctatgggccgcttttgggccatgtgggagttttgc

SEQ ID NO: 595446 - DNA, 537 bp, Homo sapiens
acccgttctcccccccccatcgctttggcacattcattttcatcgccatattggatcgcccttcagcgtttcccgctggggtctcacccccagatttttcagcttgttgtacgctgctccttgttaaaactccctggacttccttaatcacctcattccttagttcgccatatcctccttgactgccctgcatgctatttcagagtggcgtatatcatcctagaggaaaactcgtagttaccagtcccatcatgtctctgggattttcactatcacatccccttcctcacctcccaaggaatgcttcaccctttcattcagtgatgtgtccaccacgcctcctgtattcaagaaaagaagacttctttgtgctatttagaccataaaacattacatgtacttatttattcttcattgcctcgacagatggctcattgttactgagtagatcgacactcggataccattaattccaattagtcaagcagcagctatccgcaaacagaaataaattaaaataaaacaaaatatcattca

SEQ ID NO: 595447 - DNA, 238 bp, Homo sapiens
tagcggcggctcttgttcgctcggacggccagcagcttgctggtcgccgcctgcctcgtcttccctcttgacggctgccgctgggccggcactgtcaccaccaccgcctgtgtgactgacgcgggacaccggctgtgctcacgacgcacgttccacctgggctccgccgtccgtcaggcgattctgtcttgggggactgtaggccgggtacgtttgccctgtgggtacggtcgccttg

SEQ ID NO: 595448 - DNA, 432 bp, Homo sapiens
ttgcctctgcatctcaagtcctgtaagttgtaggtgtaagccatcagtcacatccagacactaacagcttctttacgtagagttgttggcccaggagaacaccaggttttcaggtgtgtctgggttccatagttcttcctcatcagtcagtgattggcttcaccttgctgcactccagaactgcacggtaaatccgcacagagcagtaatttcagagaaggttgtgtatagtgtgaaattccctctccagaattggaagtttacacaccatcggcttcctgttctgccctgctcttctgtagatcatgaatatatggtatataacaaaacatttggggaggggctggtttctctgtgaagcccaggctgtcctggaactcactggtctacagagcaagttcaaggacagccttttctctaccctgtctcgag

SEQ ID NO: 595449 - DNA, 117 bp, Homo sapiens
taccacctggatgaaaggagattttcttggcctgtataaataggcttagcaggaggcagaaaaccctttacacagctggggatgtggagcctgggcctgcgcctcaggtgggctacg

SEQ ID NO: 595450 - DNA, 119 bp, Homo sapiens
  misc_feature (12)..(12): n is a, c, g, or t
tatcaatgcatnaaatttcattacatgtcatagagaatcagtgttcttcatgatacatatgtctactgagtgagtttgtccctccagagacctttctgggaacatgccttctccaggga

SEQ ID NO: 595451 - DNA, 430 bp, Homo sapiens
  misc_feature (17)..(17): n is a, c, g, or t
  misc_feature (122)..(122): n is a, c, g, or t
  misc_feature (127)..(127): n is a, c, g, or t
  misc_feature (160)..(160): n is a, c, g, or t
  misc_feature (162)..(162): n is a, c, g, or t
  misc_feature (187)..(187): n is a, c, g, or t
  misc_feature (227)..(227): n is a, c, g, or t
  misc_feature (246)..(247): n is a, c, g, or t
  misc_feature (253)..(253): n is a, c, g, or t
  misc_feature (273)..(274): n is a, c, g, or t
  misc_feature (279)..(280): n is a, c, g, or t
  misc_feature (295)..(295): n is a, c, g, or t
  misc_feature (300)..(300): n is a, c, g, or t
  misc_feature (309)..(309): n is a, c, g, or t
ggcggcggcggcggcgngtggtgtgggaccacataagtggaaggtgtagtaaaatctcagacttcactactgtagaactcatatatatgaccaaaagccatttgtaccccaaaagccattgnaattnaatatatatatatacacacacacacataaagananacaaaagaaaattataagaagttantattgacagacctggaacaaaaaatcaaagacagtattangtcattaaaatttgctatnntcaatntcatcagtgtaaataattanntttanngtggagaggagtgtncattngtaaccatnggagttactgtctgtatggtcctagatcggaggaatcgggatacggagattcaggaaactgctttaccagcattatccaaacacaacaattcaaacgaaacgcaaggtcaacacgacgcgc

SEQ ID NO: 595452 - DNA, 468 bp, Homo sapiens
attgcctactggtatactctagtgtctctgctgtggacaagagtcagggaaatagtagaacaggattactatcactaatgtagcaaggcgccgttcgagcaaggatgacatagaccgtattgcccaggaagctgagatgtccaatgctgaaaatgaaacgcagaagtacacggtgtcatccataaatccacttgtagtcctatgccttcaacattatccctactgtagaatgattacatcccttcgaggtcaagcattatctgattcaggatcaatgcatgaagcagttctgtaccgagtgtcatgtacttatccattgtcttgataataatcagactgctgagaaggaagaatttgaacatcaacagaaagagctggagaaagtttgcaaccccatcatcaccaagctgtaccagagtgcaggaggcatgccaggaggaatgcccgggggtaggaggtgggtaccga

SEQ ID NO: 595453 - DNA, 1034 bp, Homo sapiens
gccagcccagaacactggtctcgggctggaacagagctccttcatccagcgcataaggtgtcaccactaaaatctcctggtgcacacatgcgaaatgctgaagtgatgtgcagccatgatcaagactggagaccaagtgcgagccagacgaagccacgctgctgaacatgctacaacatctccccccttctcctttgggctggtcatccagcgaggtgttctgacaatgactagacaactacaacccatgaagtgcattgatatcacagaggaaactctgcatgctcgctttctggagggtgtccgcaatgttgccagtgtctgactgcagattggctacccaactgtatgcatcagtaccccattctatcatcaacgggtacaaacgattcctggccttgtctgtggagacggattacagccttcccacttgctgaaaaggtcaaagccttcttggcctgataccatctgcctttgatggactgctgcccctgatgagctgctgccaccatcagctgctcctgactgctgatgcagtcccagctaaggttgaaagccaaggaacaactcggaggagtcggacgaggatatgggatttggtctctttgactaatgcaccaaaaaggcaacaatttagccggtttatacgcaccacacaaggaaagtacagcttacttctgtagacacccacgacgatatcgcgaaggcgtccatcttgggctgcggcaccaaacagggtcaatgacactggccagtggatatggtgtgagtcaagcccgaacttgcttgtatcacagtggaaaatgcggatcccaaaatgaaagcagtaattgaaaaagacggttaacgttagtgctttcgacgatcgacgactgtgagagagaaggggcctagggagcaattgacaacaggcgccggttgaacagccgctagacaaaagagcatgacaagaggagtgaagacgagaaatgacagaaagtattgatcgatggtgagaatgacaacacacgaggagtcaatagagcaacaaacga

SEQ ID NO: 595454 - DNA, 159 bp, Homo sapiens
gaaggtctgtccgtgaaggactaatagaagtagtatgtactaacctttacatgaggactctattctttaactcccattaccatgtaatggcagttatattttagcagatcccacattaatagaagacctagagaatgtatccccgaaaagcgtgagcta

SEQ ID NO: 595455 - DNA, 4724 bp, Homo sapiens
tgatttggggcgggcgggggagtctccaggggaacctcgaggttgcccccagcagaacccatgcaccgctaagccacccgagcaccgcctccttccgctcgggcccgccccggagctgcgggtcgctccgagcccattcccgccggaagtgcgtcaccagcttggcgctccgcctccctcggccttagctagaagtcgaaacaaaacaagccgctaaggcggtggcggcggcgccgggacgggggaggggcgcgccggaaccggaaccgacctgcgccggaaccggaacggagagcgggttgccagggcccgaagagggctggctgcggcggtctcgctcggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagagggagcttgtgaagaccctcatgatctcttggctactcccactccagagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgaggtgcagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatgaccgctcctttgaggctgagatcaactacaacaacccactagggactggtgggcgtctggccattggctttgccgtgctgcttcgggcgctgtggaagggcacccaccatgccttccagccttccaagttgaaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtggtagctgaggaagcatggcagcggcacaagatgaggaatgactctttcatcgtggacctatttcaggggcagtacaagtcgaagctggtgtgccctgtgtgtgccaaggtctccatcacttttgacccgtttctttatctgccggtgcccttgccacaaaagcaaaaggttctccctgtcttttattttgcccgagagccccacagcaagcccatcaagttcctggtgagcgtcagcaaggagaactccactgcgagcgaagtattggactccctctctcagagtgttcatgtgaagcctgagaacctgcgtttggcggaggtaattaagaatcgttttcatcgtgtgttcctaccctcccactcactggacactgtgtccccatctgatacgctcctctgctttgagctgctatcctcagagttggctaaggagcgggtagtggtgctagaggtgcaacagcgcccccaggtgcccagcgtccccatctccaagtgtgcagcctgccagcggaagcaacagtcggaggatgaaaagctgaagcgctgtacccggtgctaccgtgtgggctactgcaaccagctctgccagaaaacccactggcctgaccacaagggcctctgccgacctgagaacattggctaccccttcctggtcagtgtacctgcctcacgcctcacttatgcccgcctcgctcagttgctagagggctatgcccggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaagctgctgtgcctgggtaccagcatccaagtgaagctatgaatgcccacacaccccagttcttcatctataaaattgattcatccaaccgagagcagcggctagaggacaaaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccaggcttcccggatttggcaggagctggaggctgaggaggagccggtgcctgaggggtctgggcccctgggtccctgggggccccaagactgggtgggccccctaccacgtggccctaccacaccagatgagggctgcctccggtactttgtcctgggcaccgtggcggctttggtggccctcgtgctcaacgtgttctatcctctggtatcccagagtcgctggagatgagctcgcctgcaggcagctgctgtgagctggcctacctgcctgccccaggccatgcctgcctttgttgtggggaacacctctgggctttgggcctcagcttatgcatctggtgggagagggtggggaggttgtggcccctgcaggggcagagtatcctagggtgtgtatccatctggctgtctgtccattcatcctgctgctctgacccttggcctcaggcttggccctgcccaagctacttcctgtacttaaaagtgttaataaaaccagactattcaggccca

SEQ ID NO: 595456 - DNA, 255 bp, Homo sapiens
  misc_feature (241)..(242): n is a, c, g, or t
atccaaagaatttggcacgagggccaaggtacgggagctggaggctgagctatgatgcagagcagaagaagcacgacgaggcccttaaggcgttgcgcaaatgaagcgccgtgtcaaggtaagagctacaagcgccagtttgaggaggcggcagcaggccaacacgacctggccaagtatcgcaggcccagcacgagctggatgatgcggaggagcggcagaatggcggaaccgaggccannaagctgcggcacg

SEQ ID NO: 595457 - DNA, 726 bp, Homo sapiens
  misc_feature (231)..(231): n is a, c, g, or t
  misc_feature (233)..(233): n is a, c, g, or t
  misc_feature (235)..(235): n is a, c, g, or t
  misc_feature (690)..(690): n is a, c, g, or t
  misc_feature (719)..(720): n is a, c, g, or t
aacaaaaggctggaacgtcgggttgaggcctaagcaatggtctcaatataaagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccaggtgggtgggtagatgatgggcanancnatgcctcaggtgggacagtatgtctcatgctcttcctcatgtccttcctcctatcctgctgtgcctctgcagggatggaaacttcctgaggctgcacccgggctgtgggccccacaccaccttccgttggcaggtgaagctcaggtgggtggtgcccggccccaccactgtgcctgtcctacaccgtgggctccatctccctggctcatctatcctgatgctcattcctcctaagtccctgagttcagcccccacaggaatctgattgagccagagcagtgcaccttctgtttcacggcttctcgcatcgacatctgccttcgtaagaggcagagtcagcgctgggggggcctggaggccccggctgcacgaggtctgcacacgagctcccttcattgcccagttccacgtgaccaggacccaaacccctgtcacatgctgctaaccaccagccntctcattccccctttttaaggtgcagtgnntggtgc

SEQ ID NO: 595458 - DNA, 405 bp, Homo sapiens
tgatttggggcgggcgggggagtctccaggggaacctcgaggttgcccccagcagaacccatgcaccgctaagccacccgagcaccgcctccttccgctcgggcccgccccggagctgcgggtcgctccgagcccattcccgccggaagtgcgtcaccagcttggcgctccgcctccctcggccttagctagaagtcgaaacaaaacaagccgctaaggcggtggcggcggcgccgggacgggggaggggcgcgccggaaccggaaccgacctgcgccggaaccggaacggagagcgggttgccagggcccgaagagggctggctgcggcggtctcgctcggtgagtggagcaggctgcaactcgctggcttggccgcagcggggaggccgcaacgcgcggccgc

SEQ ID NO: 595459 - DNA, 836 bp, Homo sapiens
atttgaatttaaaaggtttgcaataaacttcatgtttagaaattgaataaataggagttttattaccacattggatatccttgtgtcctaacctttttccttggagttatcttagttcaataaataaaacctcattagactattcccatttcaacgagtttattaaattttgcaggagtaattagcataagctgtgctaatttttctggaagactaatgagggaggttcttaattaggtttactttgtaagaatcagaaaagatgataatgacaaaagtcacatagggtagtctgaattgggaacccagtttttctgcatctattaaaaaatctttctatatggaaactttttaataaatgtcggaactgaatatattaagtatgcagactgttattccatatctggttaggatgaccattcattcttaatttgcttccccaaactctttattttcctaaactatctttgagcaatgacatggatgaatacagatggtcttataaaaacatttctttctccaaagtatgctggaggcttcttttcacacagactcctgaagtttctggctagatttctgttgcttatttgcagtggggtgggatagggggcagttaatgttggttgttgtagtagtttgaattagaattagtgcaattgatgaaatgaaccattaagtaagggtgacaaatgtgagcatcattccttgtgcaatgaatccttatctgttacaagtggatttttttttaagtagaattgaaatcctaaggggtgaaatccatctcaaattatgttctccttatggtgtgaatttagacctcagttttaagggattaa

SEQ ID NO: 595460 - DNA, 4646 bp, Homo sapiens
tgatttggggcgggcgggggagtctccaggggaacctcgaggttgcccccagcagaacccatgcaccgctaagccacccgagcaccgcctccttccgctcgggcccgccccggagctgcgggtcgctccgagcccattcccgccggaagtgcgtcaccagcttggcgctccgcctccctcggccttagctagaagtcgaaacaaaacaagccgctaaggcggtggcggcggcgccgggacgggggaggggcgcgccggaaccggaaccgacctgcgccggaaccggaacggagagcgggttgccagggcccgaagagggctggctgcggcggtctcgctcggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagaggagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgaggtgcagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatgaccgctcctttgaggctgagatcaactacaacaacccactagggactggtgggcgtctggccattggctttgccgtgctgcttcgggcgctgtggaagggcacccaccatgccttccagccttccaagttgaaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtggtagctgaggaagcatggcagcggcacaagatgaggaatgactctttcatcgtggacctatttcaggggcagtacaagtcgaagctggtgtgccctgtgtgtgccaaggtctccatcacttttgacccgtttctttatctgccggtgcccttgccacaaaagcaaaaggttctccctgtcttttattttgcccgagagccccacagcaagcccatcaagttcctggtgagcgtcagcaaggagaactccactgcgagcgaagtattggactccctctctcagagtgttcatgtgaagcctgagaacctgcgtttggcggaggtaattaagaatcgttttcatcgtgtgttcctaccctcccactcactggacactgtgtccccatctgatacgctcctctgctttgagctgctatcctcagagttggctaaggagcgggtagtggtgctagaggtgcaacagcgcccccaggtgcccagcgtccccatctccaagtgtgcagcctgccagcggaagcaacagtcggaggatgaaaagctgaagcgctgtacccggtgctaccgtgtgggctactgcaaccagctctgccagaaaacccactggcctgaccacaagggcctctgccgacctgagaacattggctaccccttcctggtcagtgtacctgcctcacgcctcacttatgcccgcctcgctcagttgctagagggctatgcccggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaagctgctgtgcctgggtaccagcatccaagtgaagctatgaatgcccacacaccccagttcttcatctataaaattgattcatccaaccgagagcagcggctagaggacaaaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccagggactaggccctggccaggcccccgaggtggcccccacgcggacagcccctgaacgcttcgccccccctgtggatcggccagcccccacctacagcaacatggaggaggtggattagcaggtccctggctgatgggggggactgggtttgggacacccacacagagggccagctccttgccgcttctccttctctaacccagaggacactggctctgtcagtgggaagctgaggggtatgatttgggtgtggagacctctcaggttgggacttcttgtcagcttggacccctgaccagtgggctttggcttctccagccgcctccagtgctgcgtgatttgattctgttgtaccttcaattcttctgacccgcattataaacattataattttattctaaaaattgtaattttttttgcattttggaagtgactgctgctgtttaaatatattttaaaaataaataataagtaagtaga

SEQ ID NO: 595461 - DNA, 4515 bp, Homo sapiens
tgatttggggcgggcgggggagtctccaggggaacctcgaggttgcccccagcagaacccatgcaccgctaagccacccgagcaccgcctccttccgctcgggcccgccccggagctgcgggtcgctccgagcccattcccgccggaagtgcgtcaccagcttggcgctccgcctccctcggccttagctagaagtcgaaacaaaacaagccgctaaggcggtggcggcggcgccgggacgggggaggggcgcgccggaaccggaaccgacctgcgccggaaccggaacggagagcgggttgccagggcccgaagagggctggctgcggcggtctcgctcggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagaggagttgttgctcgattggaggcagagtgcagaagaggtgattgtcaagcttcgtgtgggagtaggtcccctgcagctggaggatgtagatgctgctttcacagatacagactgtgtggtgcggtttgcaggtggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgaggtgcagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatgaccgctcctttgaggctgagatcaactacaacaacccactagggactggtgggcgtctggccattggctttgccgtgctgcttcgggcgctgtggaagggcacccaccatgccttccagccttccaagttgaaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtggtagctgaggaagcatggcagcggcacaagatgaggaatgactctttcatcgtggacctatttcaggggcagtacaagtcgaagctggtgtgccctgtgtgtgccaaggtctccatcacttttgacccgtttctttatctgccggtgcccttgccacaaaagcaaaaggttctccctgtcttttattttgcccgagagccccacagcaagcccatcaagttcctggtgagcgtcagcaaggagaactccactgcgagcgaagtattggactccctctctcagagtgttcatgtgaagcctgagaacctgcgtttggcggaggtaattaagaatcgttttcatcgtgtgttcctaccctcccactcactggacactgtgtccccatctgatacgctcctctgctttgagctgctatcctcagagttggctaaggagcgggtagtggtgctagaggtgcaacagcgcccccaggtgcccagcgtccccatctccaagtgtgcagcctgccagcggaagcaacagtcggaggatgaaaagctgaagcgctgtacccggtgctaccgtgtgggctactgcaaccagctctgccagaaaacccactggcctgaccacaagggcctctgccgacctgagaacattggctaccccttcctggtcagtgtacctgcctcacgcctcacttatgcccgcctcgctcagttgctagagggctatgcccggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaagctgctgtgcctgggtaccagcatccaagtgaagctatgaatgcccacacaccccagttcttcatctataaaattgattcatccaaccgagagcagcggctagaggacaaaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccagggactaggccctggccaggcccccgaggtggcccccacgcggacagcccctgaacgcttcgccccccctgtggatcggccagcccccacctacagcaacatggaggaggtggattagcaggtccctggctgatgggggggactgggtttgggacacccacacagagggccagctccttgccgcttctccttctctaacccagaggacactggctctgtcagtgggaagctgaggggtatgatttgggtgtggagacctctcaggttgggacttcttgtcagcttggacccctgaccagtgggctttggcttctccagccgcctccagtgctgcgtgatttgattctgttgtaccttcaattcttctgacccgcattataaacattataattttattctaaaaattgtaattttttttgcattttggaagtgactgctgctgtttaaatatattttaaaaataaataataagtaagtaga

SEQ ID NO: 595462 - DNA, 3784 bp, Homo sapiens
cagaagcgggcccagggccgtggtgaggtaggcgcaggtgctggccccggggcccaggcagggcccagcgccaagagggctgtgcatctctgcagagggccagagggggacgggtccaggatgaccctggaccccggggtgatgccccacccttcgtggctgacccagccacccaggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgaggtgcagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatgaccgctcctttgaggctgagatcaactacaacaacccactagggactggtgggcgtctggccattggctttgccgtgctgcttcgggcgctgtggaagggcacccaccatgccttccagccttccaagttgaaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtggtagctgaggaagcatggcagcggcacaagatgaggaatgactctttcatcgtggacctatttcaggggcagtacaagtcgaagctggtgtgccctgtgtgtgccaaggtctccatcacttttgacccgtttctttatctgccggtgcccttgccacaaaagcaaaaggttctccctgtcttttattttgcccgagagccccacagcaagcccatcaagttcctggtgagcgtcagcaaggagaactccactgcgagcgaagtattggactccctctctcagagtgttcatgtgaagcctgagaacctgcgtttggcggaggtaattaagaatcgttttcatcgtgtgttcctaccctcccactcactggacactgtgtccccatctgatacgctcctctgctttgagctgctatcctcagagttggctaaggagcgggtagtggtgctagaggtgcaacagcgcccccaggtgcccagcgtccccatctccaagtgtgcagcctgccagcggaagcaacagtcggaggatgaaaagctgaagcgctgtacccggtgctaccgtgtgggctactgcaaccagctctgccagaaaacccactggcctgaccacaagggcctctgccgacctgagaacattggctaccccttcctggtcagtgtacctgcctcacgcctcacttatgcccgcctcgctcagttgctagagggctatgcccggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaagctgctgtgcctgggtaccagcatccaagtgaagctatgaatgcccacacaccccagttcttcatctataaaattgattcatccaaccgagagcagcggctagaggacaaaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccagggactaggccctggccaggcccccgaggtggcccccacgcggacagcccctgaacgcttcgccccccctgtggatcggccagcccccacctacagcaacatggaggaggtggattagcaggtccctggctgatgggggggactgggtttgggacacccacacagagggccagctccttgccgcttctccttctctaacccagaggacactggctctgtcagtgggaagctgaggggtatgatttgggtgtggagacctctcaggttgggacttcttgtcagcttggacccctgaccagtgggctttggcttctccagccgcctccagtgctgcgtgatttgattctgttgtaccttcaattcttctgacccgcattataaacattataattttattctaaaaattgtaattttttttgcattttggaagtgactgctgctgtttaaatatattttaaaaataaataataagtaagtaga

SEQ ID NO: 595463 - DNA, 105 bp, Homo sapiens
agcaataggcgagccccagagcataccaaccctacctccagaacacccaggaacatcacttctgtatgcgtgagctgatgtgacacattatagaatactctcaac

SEQ ID NO: 595464 - DNA, 4592 bp, Homo sapiens
tgatttggggcgggcgggggagtctccaggggaacctcgaggttgcccccagcagaacccatgcaccgctaagccacccgagcaccgcctccttccgctcgggcccgccccggagctgcgggtcgctccgagcccattcccgccggaagtgcgtcaccagcttggcgctccgcctccctcggccttagctagaagtcgaaacaaaacaagccgctaaggcggtggcggcggcgccgggacgggggaggggcgcgccggaaccggaaccgacctgcgccggaaccggaacggagagcgggttgccagggcccgaagagggctggctgcggcggtctcgctcggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagaggagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgaggtgcagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatgaccgctcctttgaggctgagatcaactacaacaacccactagggactggtgggcgtctggccattggctttgccgtgctgcttcgggcgctgtggaagggcacccaccatgccttccagccttccaagttgaaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtggtagctgaggaagcatggcagcggcacaagatgaggaatgactctttcatcgtggacctatttcaggggcagtacaagtcgaagctggtgtgccctgtgtgtgccaaggtctccatcacttttgacccgtttctttatctgccggtgcccttgccacaaaagcaaaaggttctccctgtcttttattttgcccgagagccccacagcaagcccatcaagttcctggtgagcgtcagcaaggagaactccactgcgagcgaagtattggactccctctctcagagtgttcatgtgaagcctgagaacctgcgtttggcggaggtaattaagaatcgttttcatcgtgtgttcctaccctcccactcactggacactgtgtccccatctgatacgctcctctgctttgagctgctatcctcagagttggctaaggagcgggtagtggtgctagaggtgcaacagcgcccccaggtgcccagcgtccccatctccaagtgtgcagcctgccagcggaagcaacagtcggaggatgaaaagctgaagcgctgtacccggtgctaccgtgtgggctactgcaaccagctctgccagaaaacccactggcctgaccacaagggcctctgccgacctgagaacattggctaccccttcctggtcagtgtacctgcctcacgcctcacttatgcccgcctcgctcagttgctagagggctatgcccggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaagctgctgtgcctgggtaccagcatccaagtgaagctatgaatgcccacacaccccagttcttcatctatctggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccagggactaggccctggccaggcccccgaggtggcccccacgcggacagcccctgaacgcttcgccccccctgtggatcggccagcccccacctacagcaacatggaggaggtggattagcaggtccctggctgatgggggggactgggtttgggacacccacacagagggccagctccttgccgcttctccttctctaacccagaggacactggctctgtcagtgggaagctgaggggtatgatttgggtgtggagacctctcaggttgggacttcttgtcagcttggacccctgaccagtgggctttggcttctccagccgcctccagtgctgcgtgatttgattctgttgtaccttcaattcttctgacccgcattataaacattataattttattctaaaaattgtaattttttttgcattttggaagtgactgctgctgtttaaatatattttaaaaataaataataagtaagtaga

SEQ ID NO: 595465 - DNA, 5550 bp, Homo sapiens
  misc_feature (4825)..(4825): n is a, c, g, or t
tgatttggggcgggcgggggagtctccaggggaacctcgaggttgcccccagcagaacccatgcaccgctaagccacccgagcaccgcctccttccgctcgggcccgccccggagctgcgggtcgctccgagcccattcccgccggaagtgcgtcaccagcttggcgctccgcctccctcggccttagctagaagtcgaaacaaaacaagccgctaaggcggtggcggcggcgccgggacgggggaggggcgcgccggaaccggaaccgacctgcgccggaaccggaacggagagcgggttgccagggcccgaagagggctggctgcggcggtctcgctcggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagaggagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgaggtgcagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatgaccgctcctttgaggctgagatcaactacaacaacccactagggactggtgggcgtctggccattggctttgccgtgctgcttcgggcgctgtggaagggcacccaccatgccttccagccttccaagttgaaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtggtagctgaggaagcatggcagcggcacaagatgaggaatgactctttcatcgtggacctatttcaggggcagtacaagtcgaagctggtgtgccctgtgtgtgccaaggtctccatcacttttgacccgtttctttatctgccggtgcccttgccacaaaagcaaaaggttctccctgtcttttattttgcccgagagccccacagcaagcccatcaagttcctggtgagcgtcagcaaggagaactccactgcgagcgaagtattggactccctctctcagagtgttcatgtgaagcctgagaacctgcgtttggcggaggtaattaagaatcgttttcatcgtgtgttcctaccctcccactcactggacactgtgtccccatctgatacgctcctctgctttgagctgctatcctcagagttggctaaggagcgggtagtggtgctagaggtgcaacagcgcccccaggtgcccagcgtccccatctccaagtgtgcagcctgccagcggaagcaacagtcggaggatgaaaagctgaagcgctgtacccggtgctaccgtgtgggctactgcaaccagctctgccagaaaacccactggcctgaccacaagggcctctgccgacctgagaacattggctaccccttcctggtcagtgtacctgcctcacgcctcacttatgcccgcctcgctcagttgctagagggctatgcccggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaagctgctgtgcctgggtaccagcatccaagtgaagctatgaatgcccacacaccccagttcttcatctataaaattgattcatccaaccgagagcagcggctagaggacaaaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccagggactaggccctggccaggcccccgaggtggcccccacgcggacagcccctgaacgcttcgccccccctgtggatcggccagcccccacctacagcaacatggaggaggtggattagcaggtccctggctgatgggggggactgggtttgggacacccacacagagggccagctccttgccgcttctccttctctaacccagaggacactggctctgtcagtgggaagctgaggggtatgatttgggtgtggagacctctcaggttgggacttcttgtcagcttggacccctgaccagtgggctttggcttctccagccgcctccagtgctgcgtgatttgattctgttgtaccttcaattcttctgacccgcattataaacattataattttattctaaaaattgtaattttttttgcattttggaagtgactgctgctgtttaaatatattttaaaaataaataataagtaagtagacttagtgactgtgatccaccacatgctggggccacctcccctccccatcatttgcggtgtgtatgtgtgtgtatgtgtgtttatatatgagagaccctgaaagtgccctagtctgaagggagatgatggggtcccagctcatgtcctatgggtcatgaagcccccagtgctatcagctntttggagcctacctgctgctctttcatcccactggttctggatcctacataagaggcagcttggtaggcatcgtcaggatctcaatatagccaagggacagaggagtatatgaagcactggagctgacagcgtggagtaaaaggtgcattcaccagagcagcctggggctgacaagtcagggaggacttgggggacagaagtactgggagatcttcctcctcctctcctgtcctcagctttttctttgctgtaacttgaacactaactgcatccctgcaggtaacagagcaggaggaaaactgctgtggggcagatcttgctgccctgaaaagaggacaagcagagaggaccagagtgaatcttgtctgacttctattggagggagggtgctggggcctgccagcctgaagagtcttcccttaagagttcctgaagccttccttctttggccaggcatggtggctcacacttgtaatccccgcactttgagaggccgaggcgagtgggtcatgaggtcaggagttcgagaccagcctggccaagatggtgaaaccccgtctctactaaaaatacaaaaattaggtgcagtggcgggcacctgtaatcccagctacttgggaggctgaggcaggagaatcgcttgaacctgggaggcggaggttgcagggagccgagatcgcgccactgcactctagcctgggcgacagagcaagactccgtctca

SEQ ID NO: 595466 - DNA, 4976 bp, Homo sapiens
tgatttggggcgggcgggggagtctccaggggaacctcgaggttgcccccagcagaacccatgcaccgctaagccacccgagcaccgcctccttccgctcgggcccgccccggagctgcgggtcgctccgagcccattcccgccggaagtgcgtcaccagcttggcgctccgcctccctcggccttagctagaagtcgaaacaaaacaagccgctaaggcggtggcggcggcgccgggacgggggaggggcgcgccggaaccggaaccgacctgcgccggaaccggaacggagagcgggttgccagggcccgaagagggctggctgcggcggtctcgctcggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagaggagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgaggtgcagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatgaccgctcctttgaggctgagatcaactacaacaacccactagggactggtgggcgtctggccattggctttgccgtgctgcttcgggcgctgtggaagggcacccaccatgccttccagccttccaagttgaaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtggtagctgaggaagcatggcagcggcacaagatgaggaatgactctttcatcgtggacctatttcaggggcagtacaagtcgaagctggtgtgccctgtgtgtgccaaggtctccatcacttttgacccgtttctttatctgccggtgcccttgccacaaaagcaaaaggttctccctgtcttttattttgcccgagagccccacagcaagcccatcaagttcctggtgagcgtcagcaaggagaactccactgcgagcgaagtattggactccctctctcagagtgttcatgtgaagcctgagaacctgcgtttggcggaggtaattaagaatcgttttcatcgtgtgttcctaccctcccactcactggacactgtgtccccatctgatacgctcctctgctttgagctgctatcctcagagttggctaaggagcgggtagtggtgctagaggtgcaacagcgcccccaggtgcccagcgtccccatctccaagtgtgcagcctgccagcggaagcaacagtcggaggatgaaaagctgaagcgctgtacccggtgctaccgtgtgggctactgcaaccagctctgccagaaaacccactggcctgaccacaagggcctctgccgacctgagaacattggctaccccttcctggtcagtgtacctgcctcacgcctcacttatgcccgcctcgctcagttgctagagggctatgcccggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaagctgctgtgcctgggtaccagcatccaagtgaagctatgaatgcccacacaccccagttcttcatctataaaattgattcatccaaccgagagcagcggctagaggacaaaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccagggactaggccctggccaggcccccgaggtggcccccacgcggacagcccctgaacgcttcgccccccctgtggatcggccagcccccacctacagcaacatggaggaggtggattagcaggtccctggctgatgggggggactgggtttgggacacccacacagagggccagctccttgccgcttctccttctctaacccagaggacactggctctgtcagtgggaagctgaggggtatgatttgggtgtggagacctctcaggttgggacttcttgtcagcttggacccctgaccagtgggctttggcttctccagccgcctccagtgctgcgtgatttgattctgttgtaccttcaattcttctgacccgcattataaacattataattttattctaaaaattgtaattttttttgcattttggaagtgactgctgctgtttaaatatattttaaaaataaataataagtaagtagaaaaaaaaaaaaaaaaaaaagggggggggctataagagtatatgcttaggggggccaaagtataagcggttacccaagtttgtttttacaagggggccctatagatggaatgggtatttataaacaaaggaagggccgtagttaaacaacggtcgtgcagggggaacacgtgtctagctgggaattctgggtgaaggaacctttcttgtgggggttggaatagtggaggaactaccaaagaaaattaaggtctggacgacattaaactcagtgtttagtggtcacagacgaattgctgtgtctagaattgctcggcattctagaacttagt

SEQ ID NO: 595467 - DNA, 921 bp, Homo sapiens
gcgagttggtggtggtcgtcgttatctgttggctggtttgtattcggctactttggcctgtcgcttgtccgtggtgtccgaggtggtgctcagtgggatggcgtagtttcccaattgtgtgtcggcgatgatcgattgctgctgggggcactgccatattgtatgggtctcctctgttgagggtttccgttatgtcgcccgttggtcttttcttttgcttctctgctgtccctgttctgtacactcggccgcggctggttattacgtcgtttggacgctgcttgcaggtgtggacgcttttgggtttttctgtgcgcggagtctgcatggtggcttttagtggacgctccgattcttgggtgtcctgattgtcctaatcagcacagtggtcttcgtggctcctccgcctcggtcggctgcaagtcacgttggcccgcccagggcgcctgcagatcttacggtgggacccccgggatcggtgtgggtatttttttcaagtccgctacaataatttcccccccctttgttcgttgggacccctggcacctttgttgtccctcctgaccttgaccccccagggtgtgggatcgtccggtcgtaggccccccgcttgggagaaaattgtacagtgacccaagcgcttgttgtacctcatatgaggggtgccccccctatgtggttgttcataccggagttccgacttttcccggtgcgtttacccccagccgctcttttgcgcccgtacatcggcgccgggggttatcccccggtccaaatcgtgttgcataactttgcgggaggcaacacccctggttccatgccgccctctgtgccaatgaattgtaatttggccccctaaatttttaaaaggggccccgtttttcccttccccccctttatccccctttgaacccacaaaaa

SEQ ID NO: 595468 - DNA, 415 bp, Homo sapiens
  misc_feature (8)..(8): n is a, c, g, or t
  misc_feature (19)..(19): n is a, c, g, or t
  misc_feature (199)..(199): n is a, c, g, or t
  misc_feature (380)..(380): n is a, c, g, or t
  misc_feature (385)..(385): n is a, c, g, or t
caggcggnggcgccgctgnctggccagtacctgctggcgcaggctggggatatcccagcgctgttgtgcttcatcgacaaatgcctgcagcagcgcctgatgctccgggctgccggtgaggttctcccgctcgtgcgggtcgcggctcaggtcatagagtaggctggggtcatcctcgctgtacacgaacttgtacggnccgcggcggatcatcatcagcgggccgacggtgccttcggccatgtattcgccgatcacttcatcgtgaccgccctgcccttgcagatggccgacaagcgagcggccgtccaggtgcaggcttttatccacagacccgccgccagttcgaccagggttgcagcaggtcgcaggtcgatacngaggngctgacccggcctgctgcaaagcgcttggg

SEQ ID NO: 595469 - DNA, 303 bp, Homo sapiens
cccccccccccccccgaccccccgggcccatgggtttttttggcagggagggggaaggggccccatttcccaaccccccccccccccggggttggcggttttttttttcccctgggccccccggttttcccccttggaaacgggccgtgggggccccccccttttttttggtttggtcccccctttggccccccccgcttttccctttttttttcccggttgttttttttttggggtttttggggggttacccttttcccccggggacccctttttcctttttttggatttgggcccggggga

SEQ ID NO: 595470 - DNA, 346 bp, Homo sapiens
  misc_feature (12)..(12): n is a, c, g, or t
  misc_feature (53)..(53): n is a, c, g, or t
  misc_feature (76)..(76): n is a, c, g, or t
  misc_feature (304)..(305): n is a, c, g, or t
acaaatgtgtgnattttttcaacattaggtagaattcttaaatctatttaaanggaaaatcaggccaggcgcaaantgtcacgcctgtaatcccagcactttggaagctcgaggtgggtggatcacctgaggtcgggagttcaagaccagcctgaccaccatggccaaaactccgtctctactaaaaacacaaaattattacccaggcatggtggcgcacgcctgtaatcccagctacttgggaggctgaggcaggagaatcgcttgaacccaggaggtggaggttgcagtgagctgagtgttnncattgcgctccaactggggaaacgagcgacatccgtctcag

SEQ ID NO: 595471 - DNA, 4804 bp, Homo sapiens
tgatttggggcgggcgggggagtctccaggggaacctcgaggttgcccccagcagaacccatgcaccgctaagccacccgagcaccgcctccttccgctcgggcccgccccggagctgcgggtcgctccgagcccattcccgccggaagtgcgtcaccagcttggcgctccgcctccctcggccttagctagaagtcgaaacaaaacaagccgctaaggcggtggcggcggcgccgggacgggggaggggcgcgccggaaccggaaccgacctgcgccggaaccggaacggagagcgggttgccagggcccgaagagggctggctgcggcggtctcgctcggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagaggagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgaggtgcagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatgaccgctcctttgaggctgagatcaactacaacaacccactagggactggtgggcgtctggccattggctttgccgtgctgcttcgggcgctgtggaagggcacccaccatgccttccagccttccaagttgaaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtggtagctgaggaagcatggcagcggcacaagatgaggaatgactctttcatcgtggacctatttcaggggcagtacaagtcgaagctggtgtgccctgtgtgtgccaaggtctccatcacttttgacccgtttctttatctgccggtgcccttgccacaaaagcaaaaggttctccctgtcttttattttgcccgagagccccacagcaagcccatcaagttcctggtgagcgtcagcaaggagaactccactgcgagcgaagtattggactccctctctcagagtgttcatgtgaagcctgagaacctgcgtttggcggaggtaattaagaatcgttttcatcgtgtgttcctaccctcccactcactggacactgtgtccccatctgatacgctcctctgctttgagctgctatcctcagagttggctaaggagcgggtagtggtgctagaggtgcaacagcgcccccaggtgcccagcgtccccatctccaagtgtgcagcctgccagcggaagcaacagtcggaggatgaaaagctgaagcgctgtacccggtgctaccgtgtgggctactgcaaccagctctgccagaaaacccactggcctgaccacaagggcctctgccgacctgagaacattggctaccccttcctggtcagtgtacctgcctcacgcctcacttatgcccgcctcgctcagttgctagagggctatgcccggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaagctgctgtgcctgggtaccagcatccaagtgaagctatgaatgcccacacaccccagttcttcatctataaaattgattcatccaaccgagagcagcggctagaggacaaaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccaggtgaggcatgtgggaggctttacagaatactgggggacagttcacagactggggccgggttgggggatatagcttcctctcctccagccacaggcccattgagccttgggattcatgagaattgcagagttctcttaacatcaaagctttagccagaggcatccccatgccttggggacactaacaaacatacaagtacactaacatgctgccactggcaagcacattggcacctacttggcacaggtcaggcaaactgctctgaacctcactgggcactatgctgtgaatgaactatacctgacactctcctagatttcctctgcacattccccacatgctggccaacaccctcacttgtgatgtccctgagttctagtgtgcactcaagacaaggcctatttgggctggccatggctctggtggctgttatactctttgaggtaagcatctgtctttgctgagccttcaggatcttctctttagtgacatggtgtgccataggcccagttagtgggcgtaggcacatctcttttctggactggccgtctcctttctggctccatcctctcttgagccttctctgtcaagcttagagaaatcttgcagaagactggtcaggatctgggtatggtgg

SEQ ID NO: 595472 - DNA, 1028 bp, Homo sapiens
  misc_feature (4)..(4): n is a, c, g, or t
  misc_feature (14)..(14): n is a, c, g, or t
  misc_feature (68)..(68): n is a, c, g, or t
  misc_feature (78)..(78): n is a, c, g, or t
  misc_feature (187)..(187): n is a, c, g, or t
  misc_feature (718)..(718): n is a, c, g, or t
  misc_feature (1028)..(1028): n is a, c, g, or t
ccancgagttcccnttattagctttaagccattcaaaatattaaagttatcattaaagactcgactcntccagtattncgtgtaacatagagattcgctgtacagcgcactccctcgcgacacacgacccacacacacacaagtacgcgaatatatcataaatctatgacgttaagcaacattaganaaccaacaacacacgtacctcggccctcacactcaatcgtcgagccggactcgcaagcctcgcagtacgatacaccgcacatacctaatactaactcgcgcgtccaacacataggactgtgataaatcagagagattaaacatcgacaacaacagagtatgacacgccgcgacgcgcgccctataagaatcactccattatataataagctgcgacgtcgatcgactaaccctcaccatattgttattccacatatttttattattcatcgtatactactttttactctataaccatcttcattctcttgacatttacttgttcttattactactttattaacttctagtctgcacacactacgatgtccgtgttttgtacatattcaccttttatactttatcatgtccaaatatctgttctacgttactctcattatatggtacagaatgaaagagccgccatcatgtctgtatctcgccattgaaaccacatcaatatacttttgttgctgtatgatttcttattatnatttagagtatagttatatattacaaacatatattatgaatcgtatagtgaattagctaaatgaaataatcgctgatattatttcacagtactccgagatatcacactattaccatgatgtgagacctacttccttaacactttgaaacgcgacacactgtactggttatcatcgtgtactcgttggtgtagtctgcgtactgtatacgattgtgttgtagcgttgttttatagcgccatctccaagaacccaataactcacacattagatccgtacggctatactaactccacgttcatactccgcagn

SEQ ID NO: 595473 - DNA, 395 bp, Homo sapiens
gggtcctaagctggctgagggagtcggtgatgaagacacctttaagtgcctctaataaagagccatggatgtagtcacgccagaatgcatcgaggtaggcgagctcagagaactggatgtcacagatgatggagcccaggtcccgggactggaggatggggtgggccgggttaaagcgctcaaacgggcgctcaagggggtccggctggttagagaagacatggcccggcagagcagtctcatgcgggcagtattcagcccgaacccgcagtcggatgtcacatgtcggcttctcctggggatcggtggtcactgacttccggggttttcgctggctcccaagtgtggctctccctcgggctggccggttgctacacagctgaggaccatcgtgg

SEQ ID NO: 595474 - DNA, 459 bp, Homo sapiens
aggctgattgacatcccagaagcctctcagggagtaggtagcagaacccaaaacttgaacaggtctgccccacactaaagcccttacctggcttgttaggttggctccaggtagatccctggagacatcctgccaagggatcttcccctagtggggaagatgaaacagcacccccgttcctggtaggtcctccctgccataggccaccagaaagaagaaactgcagtgtctgatctttcttttccctctgcaccaaggctctggcctaggttttcccagatcttgcagtttccattctcctggggactaccttcatggttttcccttatctatgagccacctatgctgtcacagattttctgtgtattgactaactttttttacttgggcacattttcttttaaaaggcttctatcactctcaattgaaaagtagtttcacttggcattaatctaaagt

SEQ ID NO: 595475 - DNA, 846 bp, Homo sapiens
cgccggcgggagggagggcgggcggcgcgagtgggcgcgggcccggtggtgccaggctccaggagcacgtgtcagggccaggagacgatggtctccgtgactatgtggtgagtctgtggtcttctctccagggcccccctctcccctagtgccctttatgagccatcttccgagtggatcctgttctttacggcaagccgcgctattcctcctggacctgccgtcctgttatgccgtgatgtctgtaggtactaataggattcagaagagcatgctgctggatctcaataaggagataatgaatgagctgggcgtgaccgtggctgggtgacatcatcgaccattctcaagcatgccagatagatggtgcaccgtcaggacatgtggcaaagttgccactgagtcagtaccctgcagccctagcccccttgacacggcgtaagattctgccgtggtcaccagtgctgcctcccgagatgatcatccaacagcgctgtaaccatgactctccaccgcagtcagaccccccaggcgcccggacactcagacactctccaagatctcggtcactgtgtccaacaagatggcagcaaagagtgccaaggccactgcaagctcctggcccgccggcgagtgacgtgagtagctctggctgttcctgccaaggcggagtccgggtcctgctgctgagtatgcgcgggggcacgtctcgtcttcgacatgccctaaggtctcgacaccccgttacccgtcgagatcctgcgagcatgcagcgggctgccaaaggtctccataggacgtctgtgttttgaccgctcgggccgaggaccaaggcagactccacgg

SEQ ID NO: 595476 - DNA, 306 bp, Homo sapiens
atattagaaaggctaaaccgactgactatattgaccttcacaaaaataaaaaactgaatctaagagggtccaaaggagggagcagttccataaattatggtcacattattcagattattaagcaacctttaaaacattatttgtccaggttatgtaggacagtgtttatgatgtgattcttggagacacagccgagctcaggagcatccccacatccagcacagggcatggtggcctgggggtaggggcagaggaatagggaacatcaaaaaatgaatcatttaagaaacaccggctgggtgtggt

SEQ ID NO: 595477 - DNA, 120 bp, Homo sapiens
ataatgttttaataacaactgtgggataaaagttattttccccttggaaagactaatgagcccaatgatattaatcccttttatggtgaataataaatgccataattgcctcatgggtga

SEQ ID NO: 595478 - DNA, 954 bp, Homo sapiens
  misc_feature (552)..(552): n is a, c, g, or t
caggcgcccataagcgtgctccggcgccaagaggtccccctgggggagacacccccggtggggaagattcgcccaggaatcctcaggcctgtgggaaagaacaccttatgtggagtctcccccccacgtgataggagcaccaaagacgagcgttttttttctcggagcacatcaccgttgctcagagcgtgtttaagagcccccactgttctccccccgcccctgtaagagatttattctccctgttgggggtgtggttgctccctcgggggggggacacccagccctcggcccacgctcgttgtatcggagagggccttatataggcccccgttgggaaataattcctcccccaccaacttggtgagcacttcttgagagggcccccttgtaaaaatagaggcggtccaccacacagagatggtagtaagaaatgactgttgggttccacacagagaagccttgtgccccacagagaagttatatgagatgcgcgtctttttgggccctctacagagggttcctttctgagcgtcccacgcacgatttccncaccgggattcctcgggacccacaggtgtgtataatataaaggcacaggagaagtttcactggtgtccctcgcttcaacaccaccacacgagaacacactggtgggcccacaaagtggaattgaaggttgtaagtgccacccactgccagtgtccccacatgaaaggaaaggttgttaaaagtgtctggcctgtgaagctcgttgggttgtcacacgttgtaagaatgtcaccgaacgatgagcttgtgtatacacattcacctggctgtctcacatttttggtgtccttgctccagaaaaaactggccagaatgtccgggcccttatatatccagacccccctgggccaacccccgcgcctatatttaggccaccatttgaattaattttattaccccgta

SEQ ID NO: 595479 - DNA, 718 bp, Homo sapiens
gagctccaccctgtttagggggtgcaggcaccatggagattgaacgcccgctacgagaccccagttcaccctgacagacacagatgccacgacataccgaccagaatgtctacatcccaggcagcaatgccacacatgaccatacgcagacgtggacaagcggagatggcaaggcccacagacagagtggacaatggcaacaagaagaagtcgggcaagaaggagaagaagtaacatggaggccaggccaagagccacagggcggacctctccccaaccagcccagcttctccttacctgcacccaggacctcagagtttcagggactaaacccccaggaaatactaggtagagggaccaaaggacaatgcatcccccatttgggaaaaccaagacaagcaaagttgccacaggtaccagaaaacacttaaaccacatttacacacaccaccagaggggcgatttggaacattcctttgcccaccaacaggccaagatatcccaggacatgtgggggataaaacccacaacacaaattccccaaaatttcaacaaccatgagccagttggttaaaccccacaatttgcgagggggggaattaaggaatcgcgaggagactataacagtggattcaggaacacacaaccaaaaaggaacacccaagatgttgaccaaacaacacccgcaggactttatacggtatatcacaaggacttg

SEQ ID NO: 595480 - DNA, 766 bp, Homo sapiens
ggtcgggccgtggagcgcatggaagccaggagctctgatgaaggcactggggtaaagtgaatgccgaagaagaagacttggatgatacaacaaactgattttcttgttggaatacacgtaatgaaccctttctgcgaagcatgtctacaagctcgtgtacggcaacaacgcatctggcaaggtgacgagaagacatcacacaggggacgtgaaaaaccaagtccctccacgaaactcgcacaaaacgcaacacaaggtgcctatctattaccacaaaatatgatttgcccattaaactcaagcgctacatcatcctgcccgcagtagacgcccaaggtacaaaccaaacaatggggacccgcattgacgtatccttaataggaaaccccatatcctaccctgggacataacacatcctcatttcatgtgccagaaaatacaacccttcaggaaatagacgaaacggacacgaacgttaaccaaggagcggaatcctacaatggttgacaaggcccaattcactaaatacaggctacgtgcacaaataaaacggtagcgactacggggcccgatacatacattacattccacgcgcacatgggaccctctacacacacgacaggcgaggacattacaaacgattacatacgaggatttcaaaaattcccatgaactacacttatcccacaaacaggcgcgacgtgacgcacgacccaggacagctccaacaatcaccagcgaattaaaaccacagcctagatgcacc

SEQ ID NO: 595481 - DNA, 1004 bp, Homo sapiens
ggcggcggcggagcggcggacagcagggcggaggctggaggcagcaagctcgctagagagggagaaggcagtcgggcgcaggcgcctcctccgcagcccgctccatggtacggagcccacagaccgcggcggcctgtctatgcgctccacttccttcacatcctcctccgcctcctcgttttcaggcgccgccggcggcgctgtgtggaggcccgcgagctgaaattcgcggtgcgacgggcagggagtggcagaaggcaggtgagggggcccaggatcgcggggcgccctgaggcaacggggacgccggcgggccgaagcgcagcccgacgcccgcaggctcggctccgccattggccgcaccatcccggtactcctcgcctcggccgccgaggggagggagacgaatgagcccggggacccgccgggggaacgggcccgggccaggcccggggatctagacggccgaagggggaagggagccgaccttccccaaaggcgccttatccggaactgccgtggaactcagaggacgctggtcgccgggcctcactaggggcttggtgctggaaaagggtatggaccccttgcgcatttggtgccacgacacatcacaggtcgcacgcaaaaactggtccaataagagacccccattggccaacgggttgaattggaaccgagaccactggaaaacccatcacgttcaccatggaacgatggggcggtcaagaaaggtaaacatctacgaaacccagccggctaccagcgagcccacggtagtcagaaaactgctaattagcctccttggtgcagaattgaacaaacctcacattccggaaatcttaaaggacctggttggaaaaacattcgggcaagggggaatttccgcaaaagttaaaatggcacaggatttatccttaccgggcagagaggtggcataaagaaataatggaaaaactcagtttgaatcaaaaggttaacaaagttctgcaagaagtagatac

SEQ ID NO: 595482 - DNA, 1384 bp, Homo sapiens
  misc_feature (928)..(928): n is a, c, g, or t
ctagattctgatttagagtgagagacttgagattcttccttttacttgaacacttagaggccatgtagggttatcattaactgaccttatttcaatattaaattgaaatgtctcagggaatagggagccgagaagagacggagagaaacaggggaacagcctgtggtggtgctgtcagaacacacacatttatgattaagtttggcattttgtatcggcgtgatttgtggttacccaaaatgattacaacagtaacattaaataacactgatcacatatcattaaaattgatataatagtaataataaattttgaaatgttgcaagaattacacagagacatgaagtgagcacatgtcattgaaaaaaaatgacaccaatagacttgctggaggcggggttgccacaaacctttagttgtaaaaacacagtattggataagtgcaatatctgggaggcacagtaaaaataggtttgcccatacctccaatgccccagtgttttcaacactgaagtctttattaaaggaatttatagtctgcttaaaacttgatcatttcttcactttagtttattacggcaagggaagaagaattaaaagtgttctggcagtaatgttgaaaagtcacaattttaaacatttctactatgagaggtcccatgtgattaatgttgttaaaaaactatcaatttttttaaattaatttatttttccccaatgaaagaattttcatttattttatagtattttaatgttatttaacataaatttataatttttgagtgtgaatgtatgtatacttacatgttacatagacaatttacaatttatttttctatgcagtatttgttcatagctctagcatatttctgttttttttaattctagcttgagaagctcatatatattttacgggattatggctttngcaaaatatttctcaggggggggggctcgtgtctttatcaccacgcagattatggttggattcttttctttaattacaaacaaacatgggtatattggatcaaaacaaaaacaaaacaacaaccacaaacacacaacagtcaaacaaccacccccaaccaagggggggggcgcggtactaagaaatttcctccgagggggagagccaaaatttgtggccggtgaacccacggatgttgcgttggtcaaacaacggcgcggcccccaatgaggaaacgaccgatcataataacaagaaagaaccgggcgcccgagtcataaaaacgcgcgggcaggtggggaacaccgtccatcgcggtatctgggaggaagagcaacccccatcgggcggggggaacgggggaaaccaccccagagaatgtaaccccagggaaaacaacctcagaggtcaagtgcg

SEQ ID NO: 595483 - DNA, 314 bp, Homo sapiens
atttgctatatcaaggtcagatgaaagcgttttttgagggccaggcggtggctcatgcctgtaatcccaaactctttgggagtggcgaggtggacggatcacttgaggtcaggagttcgagaccagcctgaccaacatgttaaaaccccatcctactattcataaaaatacaaaaatcagcccgacctggtggcacatgcctgtagtcccagctactcacaaggctgaggcaggacaatcacttgaaccaaggaggcagaggttgcagtgagcagacatcgcaccactgcactccagcctgggcaatcaagctt

SEQ ID NO: 595484 - DNA, 387 bp, Homo sapiens
ccaatcactaccatctctgaaaataccatgttatcatctactggacttcaattgctacttcctattgtgatgtgaaggacacgaagacaggtgacatagagctggctatcctcatatgtgtctcaatcttggtcctatgccccttcccctagtcattctgtgaccactcttcacatgaatcagatatgtcattcatactgtcatatggaacacaggcttcttttcttctttccttgtcaactgaaactgtaatttattgttcatacaaactaatagagggtagtagtacagatgaaaccaagtagatttttcatatggtcaatattgtttccatttctaagggcataatagctgatcatttagaagtatcacttgtggttgattggg

SEQ ID NO: 595485 - DNA, 270 bp, Homo sapiens
accctgcggggctagcggcgggcgcttctgaggggcacggttcagacaactcagtggagcatgcagattacagagccaaactctcacagatcagactaatctaccatacggagctggagaaatacgagcaggcctgccaacgagttcaccacccacgttatgaatctctctgcgagagcaaagccggatctcaggcccatctctcctaaggacattgagcgcatagtcagtatcatccaccaagcgccacaccaagagccccaccaatag

SEQ ID NO: 595486 - DNA, 847 bp, Homo sapiens
  misc_feature (57)..(57): n is a, c, g, or t
  misc_feature (81)..(83): n is a, c, g, or t
  misc_feature (177)..(177): n is a, c, g, or t
  misc_feature (180)..(180): n is a, c, g, or t
  misc_feature (196)..(196): n is a, c, g, or t
  misc_feature (230)..(230): n is a, c, g, or t
  misc_feature (238)..(238): n is a, c, g, or t
  misc_feature (246)..(246): n is a, c, g, or t
  misc_feature (337)..(337): n is a, c, g, or t
  misc_feature (454)..(454): n is a, c, g, or t
  misc_feature (459)..(459): n is a, c, g, or t
  misc_feature (524)..(524): n is a, c, g, or t
  misc_feature (553)..(553): n is a, c, g, or t
  misc_feature (556)..(556): n is a, c, g, or t
  misc_feature (563)..(564): n is a, c, g, or t
  misc_feature (621)..(621): n is a, c, g, or t
  misc_feature (698)..(698): n is a, c, g, or t
  misc_feature (777)..(777): n is a, c, g, or t
  misc_feature (838)..(838): n is a, c, g, or t
tgtataagagatcttttttaaaaagtttttaaaataaaattcaaaaatataaatatnttgatattaattgcacctaatggnnnattctttttttgtatttgctttcgcaggcaaaatctacagatatatctgagggaagataacataacttttggaaaataacactgcttatacctntgnacatttcaacagttcnaaaactcacatataccatttaatcgattaaaatntaacatgnattcaatntgtaaagaaaagccaaataaatccttattaaaagttttgacggctgggtgcagtggctcacgcctgtaatcccagtcctttgggagaccgnggcgggtggttcacctgaggtcaggagttctagttcagcctgttttacatggtgaaatcccatctcttctaaattcaaaaaaaaaaatttgctgggtgtggtggcattcgcgggttntcccngctacttgggaggctggggcaggggaatcgcttgacctcagggggtatcggttgcggtgagccgngattgcgccattgcactccagcctgggcnacnagggcgnnactcttcttcttcgatttccattgtttcctgatggtcttgttatctgagtgggcacnatttgacggtgggcagttcccatgagtagcataaggcacaagggtccaagtacttcacttatgttcacaataggcancatcaaatataagacaattgctataacttgcatgaaataaagtagtaacagccaaacaaagattcttaaagaggtgacntgaatccaccaaattgctgaacaatgggaaaaatacaactcgaacaagccccttccgagtnagagatgtc

SEQ ID NO: 595487 - DNA, 252 bp, Homo sapiens
ggggggggcccggggggggttttttttccccccccccctttcccagggccccccccttggggcaaacccttcctttggggccgggggggggggggggggggggggggggggccttggggggggggggggcccccccccccccaaggggccccccccggggggggggggggggccgggccccttttttaaaaaaaggggccgggggggggacccctttgggggggggggaaaagccccctttttttttttcca

SEQ ID NO: 595488 - DNA, 121 bp, Homo sapiens
ggggccgggggggaaaaaaaggggggggggggttcccttggggcgggggccccccggtttggggggggccctttttttgggaccctggggaataccccccccttttggggggtttttttta

SEQ ID NO: 595489 - DNA, 716 bp, Homo sapiens
  misc_feature (124)..(124): n is a, c, g, or t
  misc_feature (132)..(132): n is a, c, g, or t
  misc_feature (136)..(136): n is a, c, g, or t
  misc_feature (138)..(138): n is a, c, g, or t
  misc_feature (141)..(141): n is a, c, g, or t
  misc_feature (143)..(143): n is a, c, g, or t
  misc_feature (146)..(146): n is a, c, g, or t
  misc_feature (158)..(158): n is a, c, g, or t
  misc_feature (166)..(166): n is a, c, g, or t
  misc_feature (179)..(180): n is a, c, g, or t
  misc_feature (182)..(182): n is a, c, g, or t
  misc_feature (184)..(184): n is a, c, g, or t
  misc_feature (196)..(197): n is a, c, g, or t
  misc_feature (199)..(199): n is a, c, g, or t
  misc_feature (205)..(205): n is a, c, g, or t
  misc_feature (207)..(207): n is a, c, g, or t
  misc_feature (209)..(209): n is a, c, g, or t
  misc_feature (217)..(217): n is a, c, g, or t
  misc_feature (222)..(222): n is a, c, g, or t
  misc_feature (267)..(267): n is a, c, g, or t
  misc_feature (275)..(275): n is a, c, g, or t
  misc_feature (277)..(277): n is a, c, g, or t
  misc_feature (283)..(283): n is a, c, g, or t
  misc_feature (294)..(294): n is a, c, g, or t
  misc_feature (313)..(313): n is a, c, g, or t
  misc_feature (326)..(326): n is a, c, g, or t
  misc_feature (386)..(386): n is a, c, g, or t
  misc_feature (404)..(404): n is a, c, g, or t
  misc_feature (419)..(419): n is a, c, g, or t
  misc_feature (425)..(425): n is a, c, g, or t
  misc_feature (475)..(475): n is a, c, g, or t
  misc_feature (480)..(480): n is a, c, g, or t
  misc_feature (554)..(554): n is a, c, g, or t
  misc_feature (574)..(574): n is a, c, g, or t
  misc_feature (593)..(593): n is a, c, g, or t
  misc_feature (621)..(621): n is a, c, g, or t
  misc_feature (630)..(630): n is a, c, g, or t
  misc_feature (648)..(648): n is a, c, g, or t
  misc_feature (669)..(669): n is a, c, g, or t
  misc_feature (680)..(680): n is a, c, g, or t
  misc_feature (687)..(687): n is a, c, g, or t
cgacaatgattgcaccaggttgttttgaggctttagtgccccagcaactgaggcacgcaccccaaaaggccagaacacctgggatgtggtttttaagggttgttttttaccgtcagaagtcaangaatcttnttcncncancnacncaaagggctggnaatgagtnattattatctcanngngnatgtttcttgcnnanccttgnananttttgatngaccnctgggatgttattaaagcctaacgttccttctattctcacaaatnttcgttangnctcagnaggatcattanctctggtatctgtttgttngcttgtatggcancaataagcagatttcttctttctaatctatggattagtatagaccaggagaaggctaatncagagactatgaaacggnaataagtttttttancgatanggcaaaattgtgactctgaaagatcattcatgtatattctaaaattaccncagtnataaaaagtcttggactttcatgaggaaatagcatagctagatatgaaaaaatatagaaaatcttcatcaatgnaactattcttggggtagacnctaatcatatgaaaagacnaatgctcattccctaagatagcctgaanctcatttanaatgtagaaaaccccttnttagtaaagagacatcttctncagtaaccacngagaagnagtggaagtttttcatctccttttttatt

SEQ ID NO: 595490 - DNA, 710 bp, Homo sapiens
  misc_feature (118)..(118): n is a, c, g, or t
  misc_feature (126)..(126): n is a, c, g, or t
  misc_feature (130)..(130): n is a, c, g, or t
  misc_feature (132)..(132): n is a, c, g, or t
  misc_feature (135)..(135): n is a, c, g, or t
  misc_feature (137)..(137): n is a, c, g, or t
  misc_feature (140)..(140): n is a, c, g, or t
  misc_feature (152)..(152): n is a, c, g, or t
  misc_feature (160)..(160): n is a, c, g, or t
  misc_feature (173)..(174): n is a, c, g, or t
  misc_feature (176)..(176): n is a, c, g, or t
  misc_feature (178)..(178): n is a, c, g, or t
  misc_feature (190)..(191): n is a, c, g, or t
  misc_feature (193)..(193): n is a, c, g, or t
  misc_feature (199)..(199): n is a, c, g, or t
  misc_feature (201)..(201): n is a, c, g, or t
  misc_feature (203)..(203): n is a, c, g, or t
  misc_feature (211)..(211): n is a, c, g, or t
  misc_feature (216)..(216): n is a, c, g, or t
  misc_feature (261)..(261): n is a, c, g, or t
  misc_feature (269)..(269): n is a, c, g, or t
  misc_feature (271)..(271): n is a, c, g, or t
  misc_feature (277)..(277): n is a, c, g, or t
  misc_feature (288)..(288): n is a, c, g, or t
  misc_feature (307)..(307): n is a, c, g, or t
  misc_feature (320)..(320): n is a, c, g, or t
  misc_feature (380)..(380): n is a, c, g, or t
  misc_feature (398)..(398): n is a, c, g, or t
  misc_feature (413)..(413): n is a, c, g, or t
  misc_feature (419)..(419): n is a, c, g, or t
  misc_feature (469)..(469): n is a, c, g, or t
  misc_feature (474)..(474): n is a, c, g, or t
  misc_feature (548)..(548): n is a, c, g, or t
  misc_feature (568)..(568): n is a, c, g, or t
  misc_feature (587)..(587): n is a, c, g, or t
  misc_feature (615)..(615): n is a, c, g, or t
  misc_feature (624)..(624): n is a, c, g, or t
  misc_feature (642)..(642): n is a, c, g, or t
  misc_feature (663)..(663): n is a, c, g, or t
  misc_feature (674)..(674): n is a, c, g, or t
  misc_feature (681)..(681): n is a, c, g, or t
cggccagttttccaaagctttgtatgagcctttagtgttccaccattttagccaccatcccaagagccaagaacccggggggtgggtttcagtggtggttccccccacaagagtcaangaatcttnttcncncancnacncaaagggctggnaatgagtnattattatctcanngngnatgtttcttgcnnanccttgnananttttgatngaccnctgggatgttattaaagcctaacgttccttctattctcacaaatnttcgttangnctcagnaggatcattanctctggtatctgtttgttngcttgtatggcancaataagcagatttcttctttctaatctatggattagtatagaccaggagaaggctaatncagagactatgaaacggnaataagtttttttancgatanggcaaaattgtgactctgaaagatcattcatgtatattctaaaattaccncagtnataaaaagtcttggactttcatgaggaaatagcatagctagatatgaaaaaatatagaaaatcttcatcaatgnaactattcttggggtagacnctaatcatatgaaaagacnaatgctcattccctaagatagcctgaanctcatttanaatgtagaaaaccccttnttagtaaagagacatcttctncagtaaccacngagaagnagtggaagtttttcatctccttttttatt

SEQ ID NO: 595491 - DNA, 199 bp, Homo sapiens
ggatcgagctcggtacctgaaattcgtgtcccagagccttagatagagaggactctatcctccttcagtttctggggttacatgagggaaacaggtgtttttcctagaatggggtctgtgacgcctcctctgtttttccccaggagtcccaggctgttagtaattatcttaggttctctcatgtggacacgaatgttca

SEQ ID NO: 595492 - DNA, 190 bp, Homo sapiens
gtattcgctgacccgtctgacgaccgtgggatttcccagtgcggggaagatggtcgttttgccaggaatgcctcctggtcggggtgtgctcccagtgcctccatctcgaagagattattatgacttgagccctcgtcgagaaccatctccccctcctcccggactagtcggccgggatggtagccgagct

SEQ ID NO: 595493 - DNA, 332 bp, Homo sapiens
ggcacgaggggaggatttccccacaggacccacgcacctccctgtatctgcgcacttcgctcgtgtggctggaacgctgtcgataagcttcacgcactggcttgcatctcttcagctctaggacttgtagctttaagcaaacggtgtggcatgggttgagtgtggccacctgcaggatgtgcatgggttgagtgtggccacctgcaggatgtgcagggctgcctcagaagctggctggggactctagcctctgtgttcataaagacattaagaagtggatggatgttgttccttttttgaagttgtcattaaagtaggtgcaacaaccaaga

SEQ ID NO: 595494 - DNA, 97 bp, Homo sapiens
  misc_feature (44)..(44): n is a, c, g, or t
tcaagcttctaacgatgtacggggacatggagccatagaaaggnctatggattgtttaagaactattttaaagtgttccagacccaaaaaaaaaaaa

SEQ ID NO: 595495 - DNA, 144 bp, Homo sapiens
tatctgcagcttctcacaccgtgtcaggtaccaggcagtgcgagctggtagggtgatctcgtcaggtctgcatctcttcagctcttcgggcgaggtcaggcggtcagcttcagcaggatctgcactgtcatggctgtgcactcc

SEQ ID NO: 595496 - DNA, 1116 bp, Homo sapiens
gctggtgaagaggacccgtcgccatgggccgagtgattccgtggacagtaggaggggcgccgggtctgtgttccgcgacgcacgtgaagcaccgtaaaggcgctgagcggcctgcgagcgccgtggactttctagctgagcggtgacgagctacaatcaagagggagcagtccgtcaaccggacgagtcgatccacagacaccgagagcacagcagagctgcgtcctccctcgccaaaggttgtgtcattcctggagactcgcgtagttccggtctaaggaaaagcagtgacggagggcatgttcgattgctcggctctgatgggtcgattcacctacaggcgccacagtattgtagtaattgcggagcaaggaagggccactcagcgtcgaaactagttatgcgcgacatgatgcgtcacctgtgtcgaggcacacagtgccgtggagcggtcacaactccgttgttgcattgcactggagagcggagaaaggccttggggaggagcccgtagggcataagctggtgcgccgtgcgcgatcaagggaagagctagttgccacacgttatatctcacgcacaatccgactgtagaatcagagaacgagcccggtgggtggaacgtctgacccattccggagctccatgaagacaggtatagtactcacgtccaggcgcaagcgaggagactggtgggtcgagtcgtgtgatggcttggaacggttggcgcgacattgacctaagaccacagtccttgagaggtctgagcctggggcggtaccgacaagatattaagtgcagaagaaggaacgtgctgtggccatcgaagtactggggtgtgtgtgccagtgtaatccttgtgggagcaatcctttttgggagtgtggcataccaacaagcacatctggctaagcccttctcacagtccgaagaagattgccccctgttggcccgaaaagtgggtctcattagtgaccgccggactggacgtctccggggaaccagactgtgcagcgacaaagagaactaattggtgaggcctcaataaagtcgggtttattgcaaaaaaaatgaaacctaatcaaaatcccggagcaaattgggggggaaaaaacg

SEQ ID NO: 595497 - DNA, 382 bp, Homo sapiens
  misc_feature (246)..(246): n is a, c, g, or t
tgggactacaggcatgtccatcatgcctagctattttttattttgtagaaataaggttttgccatgttgcccaggctagtcttgaattccgtgggcccaagtggtcctcttgccttggcctcccaaagttctaggattacaggcatgagccactgtgtccagccatgtatctcgactttactaatgtcaatttcctggttttgatattttactaaattttgcaaaattactaaattttcccattgnggaaaactgggtacaaggtatgagggatcattcttttattatatcttttaaaattttaatgggaaccggacggtagcactgtggcccaggaaaaaaggaaggggaacaattagggaagcgaggaaaacccaacccc

SEQ ID NO: 595498 - DNA, 986 bp, Homo sapiens
  misc_feature (206)..(206): n is a, c, g, or t
  misc_feature (232)..(232): n is a, c, g, or t
  misc_feature (235)..(236): n is a, c, g, or t
  misc_feature (244)..(244): n is a, c, g, or t
  misc_feature (247)..(247): n is a, c, g, or t
  misc_feature (252)..(252): n is a, c, g, or t
  misc_feature (277)..(277): n is a, c, g, or t
  misc_feature (282)..(282): n is a, c, g, or t
  misc_feature (290)..(290): n is a, c, g, or t
  misc_feature (354)..(354): n is a, c, g, or t
tatgggaagggggtgttacccaataccattgctgggcaataggtatttatatttgccgagtgtttttttgcctggacccaccgtgtgccggctttcttcagaccttctctctggcccggctctgcacaaggctgaaacgggtgagcgaatccatagataggccactcctggctggccggagctatacaagcgattacacagtcaanctgcccaccctactactggggactgncanntgtaactntcnggacncagtttccccatgcaactgggggcngcctnaaagagtnaaaagataataatatcaatcattaagcttttatggcacataagtggtcaataaacaggcattanttctacttctgagggaccacaggaagcccatcagttgtcttttccactcagtcaggaagctgaaccttttttgctttggctttcaggctcataaaggactcagtgcagcatttacagaccctgacgcaatccggagctgaccagcacgaggcttggaaccagaccactgtcatacacctccaggctgctaaggtgagcgcctgccagctgaagctgaaagggatccattttgcttcccaggcaggctaccctgctgggaaaatccgggctctgccattattccccaactctgcttcagtggcggctgccctcatttcacttccaaggctttagtccagggtattttaattaaaggacttaactccaagcaatcttgctggcagctcttaggggaaaaggtaatgaggcagtgttattggatttgcttcaggttgttcaaatatttcctcccagatagaaaagcaggtcaagtctccccttagccccacaggcaatccttggatgtctgattccatttccactcgttttgtgtttctgcataattcacagtcggtcggcaaatatttgagcacccactctgcctgggcactgacctgggtgctcaacagtgaagccactgcccatgcacggct

SEQ ID NO: 595499 - DNA, 730 bp, Homo sapiens
  misc_feature (629)..(629): n is a, c, g, or t
  misc_feature (655)..(655): n is a, c, g, or t
ggtatgtctagtctggatcccttttgttgtaattggttgtgttgctaccactccctccaccccacagcacagaatagcaagggctgcctgaaccctctgtgaacactcagctcggccatttcacttcatacctcagcttcctcagctacaaaatgggtgtggcagaagtggcctttcagtgtggtgtggagggtgaaatgcagtaaggcacattaagtcctcagcccagggtcctttcctctggcaagctcacagcgccctcgcctggcctgggcttcagaatctgggcacatgtggcagtaaggctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccgnaggatgcaaccttgtaactgatgctntgacttaacggacagtgtttcagcacttgctgtatgagggaacgctacaacgccggtccagggcttatcggtggc

SEQ ID NO: 595500 - DNA, 831 bp, Homo sapiens
cagagaatctctttgtgaagatgtgaatcatagtgtgtcatggctctccaagagaaggaggtggatggcctggaccgcacagttggtgcaattcgaggccgggcacgcccgggtcattcacgtagtcacctcacacgatggacaaactatgagaccagagagtactagcaacagatgcaatggtatcgtaggcaatgcgcatctatacgacgtagttactccaacaacagtctatgccaggttatcactcgaggcaaggtacgaagcgaggcgtgtgagagccctcatgctcgagaccctgtcctcgagacccatggatgaggaatgaagtattatcgatgacttcaccgaccgtggatatagtgaatggggatccgggacatcaggaagaagcagtgcgtgattgtataagggacgcccatgaggaggtagtgatgacgtcatgacatttgagacagaagattgagatgtcagaagcaggacgagctgttcgaggacagaaagacgatcagcatgatagctggcctatagttgcccggggcgactcagtggactcagacttccccaggagtgcgaaaaatgcgaagagtcgcggagacaggtggtccagctttccagtgaagagaagagctaagcgtggatgtgctgaacgtgtccaaatgggacgacagatgagcaatgacagtcatagtgctggccaagtcggatgtgcatgattgatgatgggagatgtacagcagcttttacccgagcgtaggaggaccatcttcaccaaatacatcggatgctcagtcagtgctgtgcaagaaagtggcctgaggcaggaatcca

SEQ ID NO: 595501 - DNA, 135 bp, Homo sapiens
aacccactccaccttactaccagacaaccttagctaaaccctttaccccaataaagtataggcgatagaaattgaaccctccgcccaatagatataggtacaccaagggaaagatggaaaatttataccacccga

SEQ ID NO: 595502 - DNA, 364 bp, Homo sapiens
taggaaggttagatgaacaggaagagagaagatcttatgacaaggatgcaaactagtaagctgccagatcttcaggcatgtgtaggccgaaagccagagattgcgggttggtccttttatcattagtgctctccagctgcttgggagttgtaactcttacaaatcagtgaatatggtcttcttatcttttcactgtgaattttaactcaattttaacctgataaaactaggatcccatatatacatgatgttgatgaatcaaccctccaaatatgactaactgcctgaggccccgatcagaataaccagaccccttagacatctgtactgtaacgacagatttgggccgggcgcggtggctcac

SEQ ID NO: 595503 - DNA, 2468 bp, Homo sapiens
aagagagggaggaaggagaggagctccataagcccagacaagggcttgagagcagacaagggcttgagagcagacaagggcttgagagctggccaagcagtttctctcagcttctgtgttccagcccctctgtgggaggagagaagggcaggaccacaagcctgccagaggctgcggcctacagccggggagaggccagcccggcctacagtgcggacacaggacagaggggagccaggttctttgcactgaccaatgctgagagcagaccctcggagcagccgggttggaagtgtctctccacagtcaccagacagatccaggataggatgggcagcccagtgcaccgagtgtcattgggggatacctggagcaggcaaatgcaccccgacatagagagcgagaggtatatgcagtcctttgacgtggaacggctcaccaacatccttgatggaggtgcccagaacactgcactccgcaggaaagttgagagcatcatccacagttacccggagtttagctgtaaggacaattatttcatgacccagaatgagcgttataaggctgccatgcggagggcattccacatccggttgatagctcggcgcctgggttggttagaagatggtcgtgaattaggctacgcttacagagccctttctggagacgtggccttaaatatacacagagtcttcgtgagagccctcaggagcctgggctcagaggagcagattgccaaatgggacccactctgcaaaaacatccagatcatcgcaacgtatgcacagacagagttgggacatgggacatatcttcagggcctggagactgaagccacctatgacgcagccacccaggagtttgtgatacacagccccacgctgactgccaccaaatggtggcctggagacttgggacggtcagccacccatgccctggtccaggcccagctgatctgctcaggagccaggcggggcatgcacgcttttattgtgccaatccggagtcttcaggaccacaccccactgccaggaatcatcattggggacatcggacccaagatggactttgatcaaacagacaatggcttcctgcagctgaaccatgtgcgggtccccagggagaacatgctgagtcgctttgcacaggtcttgccagatggcacctacgtcaaactcggtacagcacagagcaactaccttcccatggtggtggtgcgggtggagctgctgtcaggggagatcctccctatactgcagaaggcctgtgtcatcgccatgcgctactcggtcatccgccgccaatcccggctccggcccagtgacccagaggcaaaggtcctggactaccagacacaacagcagaaactctttcctcagctggccatcagttatgccttccatttcctggcagtcagcctcttggagttcttccagcactcctacactgccattctgaaccaagacttcagcttcctgcctgagctccacgcactgagcacgggcatgaaggccatgatgtcagaattctgcacccagggagctgagatgtgccgcagggcctgtggcggacatggctactcaaagctgagtggcctgccatcactggtcaccaaattgtcggcctcctgtacctacgagggtgagaacacagtgctctacctgcaggtggccaggttcctggtgaagagctacctgcagactcagatgtcccctggctccacgccacagagatctctctctccatctgtcgcatatctcaccgcacctgacctggccaggtgtccagcccagagggcagccgacttcctctgcccggagctctacaccacggcctgggcacatgtggcagtaaggctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccggaaggatgccatcctgttaactgatgcttttgacttcaccgatcagtgtttaaattcagcacttggctgttatgatggaaacgtctacgaacgcctgttccagtgggctcagaagtcaccaaccaatactcaggagaaccctgcctatgaggaatatataagaccacttttacaaagttggagatccaagctatgaaataaccaacagtattcaagaagcaaccagcaccatcatgtgataatggtactatggcatatatgcaacattaaaattttaaattagatattt

SEQ ID NO: 595504 - DNA, 299 bp, Homo sapiens
  misc_feature (266)..(266): n is a, c, g, or t
ggggcagccaggttcttccctggctggtgttgtgggctccagagtgaccttacctacaaaatactcctttgcaattataagttgtgggtcaggaatcttcgttccatgtgtggcagtgaggctgtcggactgccgtgtgacctgatgagctcatgttggctggtcccatgtgttgacatgggactctctcggggaaaccaaggtcccagacgcgtctgcgcgacttcaccccggtgctccaacgaggttggtgagcaggagcccangtgcatgcacgctgagtggccaactaggggtgt

SEQ ID NO: 595505 - DNA, 2512 bp, Homo sapiens
aagagagggaggaaggagaggagctccataagcccagacaagggcttgagagcagacaagggcttgagagcagacaagggcttgagagctggccaagcagtttctctcagcttctgtgttccagcccctctgtgggaggagagaagggcaggaccacaagcctgccagaggctgcggcctacagccggggagaggccagcccggcctacagtgcggacacaggacagaggggagccagccctggctgacacccagtccctaggcagttcctcttgcacacaggttctttgcactgaccaatgctgagagcagaccctcggagcagccgggttggaagtgtctctccacagtcaccagacagatccaggataggatgggcagcccagtgcaccgagtgtcattgggggatacctggagcaggcaaatgcaccccgacatagagagcgagaggtatatgcagtcctttgacgtggaacggctcaccaacatccttgatggaggtgcccagaacactgcactccgcaggaaagttgagagcatcatccacagttacccggagtttagctgtaaggacaattatttcatgacccagaatgagcgttataaggctgccatgcggagggcattccacatccggttgatagctcggcgcctgggttggttagaagatggtcgtgaattaggctacgcttacagagccctttctggagacgtggccttaaatatacacagagtcttcgtgagagccctcaggagcctgggctcagaggagcagattgccaaatgggacccactctgcaaaaacatccagatcatcgcaacgtatgcacagacagagttgggacatgggacatatcttcagggcctggagactgaagccacctatgacgcagccacccaggagtttgtgatacacagccccacgctgactgccaccaaatggtggcctggagacttgggacggtcagccacccatgccctggtccaggcccagctgatctgctcaggagccaggcggggcatgcacgcttttattgtgccaatccggagtcttcaggaccacaccccactgccaggaatcatcattggggacatcggacccaagatggactttgatcaaacagacaatggcttcctgcagctgaaccatgtgcgggtccccagggagaacatgctgagtcgctttgcacaggtcttgccagatggcacctacgtcaaactcggtacagcacagagcaactaccttcccatggtggtggtgcgggtggagctgctgtcaggggagatcctccctatactgcagaaggcctgtgtcatcgccatgcgctactcggtcatccgccgccaatcccggctccggcccagtgacccagaggcaaaggtcctggactaccagacacaacagcagaaactctttcctcagctggccatcagttatgccttccatttcctggcagtcagcctcttggagttcttccagcactcctacactgccattctgaaccaagacttcagcttcctgcctgagctccacgcactgagcacgggcatgaaggccatgatgtcagaattctgcacccagggagctgagatgtgccgcagggcctgtggcggacatggctactcaaagctgagtggcctgccatcactggtcaccaaattgtcggcctcctgtacctacgagggtgagaacacagtgctctacctgcaggtggccaggttcctggtgaagagctacctgcagactcagatgtcccctggctccacgccacagagatctctctctccatctgtcgcatatctcaccgcacctgacctggccaggtgtccagcccagagggcagccgacttcctctgcccggagctctacaccacggcctgggcacatgtggcagtaaggctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccggaaggatgccatcctgttaactgatgcttttgacttcaccgatcagtgtttaaattcagcacttggctgttatgatggaaacgtctacgaacgcctgttccagtgggctcagaagtcaccaaccaatactcaggagaaccctgcctatgaggaatatataagaccacttttacaaagttggagatccaagctatgaaataaccaacagtattcaagaagcaaccagcaccatcatgtgataatggtactatggcatatatgcaacattaaaattttaaattagatattt

SEQ ID NO: 595506 - DNA, 370 bp, Homo sapiens
ttttctgagccagggtctcgctttgtcacccagctggagtgcagtggtgcaatgtcagctcaccacagcctctgcctcctgggttcaagcaattctcgtacctcagcctctcaagtagctgggactacaggtgcctgccacaacacccggctcatttttgtgtttttagcagagactgggcaacatggtgagacctcgtctctacaaaaaataaaaaatgaaccaccaggcatggtggtgcatgcctgtagtcccagctatttgggaggctgaggcaggaggatcacttgagttcaggaggtccaggcagcaatgagctgagattgtgctgctcattccaaactgggtgacagactgaggccatgtctca

SEQ ID NO: 595507 - DNA, 758 bp, Homo sapiens
ttgcgaatggaatttggacctccagaaaatatcaatgtctaatgttaatcctcagcaaacaaaggttttaaaactatgaatttgtgggagaaataatatgactaggaagcaggagcaggggaacctcatatcttattgcgttagttatgggaatcactgatgggctggaagatcacactgggtcagggttcagtgtttggttcttgtttactgaccttgtgagttctcagagcatcagcaagtgatgtgcacgtgtggtacccctgtctgctcaccatatgcttttgttttaggttctcccatggcgccagccagtgtgggcaattgcagtgtgggcaactgcagcccggaggcagtgtggcccaaaactgaacccctggagaatggaagtaccccaggcacctatacagcccttctatagctctccagaaactgtggatcagctctctcccaatgactgacctggacatcaagttccagtgaccgtgggaaggagtacgggccagacttgaccgtgagcaaccctcagggcttggcgactcttctatggggaccttgggtcccatgcctgaccaggaggagctctttggtcccgtcagcctggagcaggtcaattcatcgcaagggtaccggctcaatcgtatctgttagcaaaaccacggcgaaaaaaaacgcgcttaaaaaagggagaaaaaagagataaaaaaaagccaaataagagaaaaaaaagacaacacacggaaaacagagaaagaagg

SEQ ID NO: 595508 - DNA, 1095 bp, Homo sapiens
gacctcagagctgagctgggcatgagtagatgctcagtaagtggtgcacagggttggtccctatggtggaggccccctaacaccgcccaacccccctccatgttctcacagctccacgcactgagcacgggcatgaaggccatgatgtcagaattctgcacccagggagctgagatgtgccgcagggcctgtggcggacatggctactcaaagctgagtggcctgccatcactggtcaccaaattgtcggcctcctgtacctacgagggtgagaacacagtgctctacctgcaggtggccaggttcctggtgaagagctacctgcagactcagatgtcccctggctccacgccacagagatctctctctccatctgtcgcatatctcaccgcacctgacctggccaggtgtccagcccagagggcagccgacttcctctgcccggagctctacaccacggcctgggcacatgtggcagtaaggctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccggaaggatgccatcctgttaactgatgcttttgacttcaccgatcagtgtttaaattcagcacttggctgttatgatggaaacgtctacgaacgcctgttccagtgggctcagaagtcaccaaccaatactcaggagaaccctgcctatgaggaatatataagaccacttttacaaagttggagatccaagctatgaaataaccaacagtattcaagaagcaaccagcaccatcatgtgataatggtactatggcatatatgcaacattaaaattttaaattagatattt

SEQ ID NO: 595509 - DNA, 545 bp, Homo sapiens
ttcagacagagcaaacaaattaagctgacataacagctgtgacaaactggctagcaccggggcccagagagtataagggtgaacatcaagagtcaggagcaggtctcacagggtctcaattttctctcctgtgaaatgaagaagaggacactggctacctggctctcagattccaaggtcacacaaaacgcccagtctcagacccactagaaaaatccatctcttacctatggttggtttgttttacagcctacgcaacatagtgagaccctgtctctatgaaaaatgcaaacaaaaattagctgggtgtggtggcctgcatgtgtagtcccagctacttggtaggcggaggcggaaggatcgctggagcccaggaggcggaggttgcagtgagccatgatggcgccactgcactctagcctggacaacagactaagactctgtctttaaaagaaaaaaaaatttaaaaaataaagcctgagggcacacatgagtctggaacagcatctagtgagtatcaacttggcatgttgatggaagcgtcg

SEQ ID NO: 595510 - DNA, 2284 bp, Homo sapiens
aagagagggaggaaggagaggagctccataagcccagacaagggcttgagagcagacaagggcttgagagcagacaagggcttgagagctggccaagcagtttctctcagcttctgtgttccagcccctctgtgggaggagagaagggcaggaccacaagcctgccagaggctgcggcctacagccggggagaggccagcccggcctacagtgcggacacaggacagaggggagccaggttctttgcactgaccaatgctgagagcagaccctcggagcagccgggttggaagtgtctctccacagtcaccagacagatccaggataggatgggcagcccagtgcaccgagtgtcattgggggatacctggagcaggcaaatgcaccccgacatagagagcgagaggtatatgcagtcctttgacgtggaacggctcaccaacatccttgatggaggtgcccagaacactgcactccgcaggaaagttgatccatgaagcaagtgggtgagaagatttgaagagccctttctggagacgtggccttaaatatacacagagtcttcgtgagagccctcaggagcctgggctcagaggagcagattgccaaatgggacccactctgcaatcttcagggcctggagactgaagccacctatgacgcagccacccaggagtttgtgatacacagccccacgctgactgccaccaaatggtggcctggagacttgggacggtcagccacccatgccctggtccaggcccagctgatctgctcaggagccaggcggggcatgcacgcttttattgtgccaatccggagtcttcaggaccacaccccactgccaggaatcatcattggggacatcggacccaagatggactttgatcaaacagacaatggcttcctgcagctgaaccatgtgcgggtccccagggagaacatgctgagtcgctttgcacaggtcttgccagatggcacctacgtcaaactcggtacagcacagagcaactaccttcccatggtggtggtgcgggtggagctgctgtcaggggagatcctccctatactgcagaaggcctgtgtcatcgccatgcgctactcggtcatccgccgccaatcccggctccggcccagtgacccagaggcaaaggtcctggactaccagacacaacagcagaaactctttcctcagctggccatcagttatgccttccatttcctggcagtcagcctcttggagttcttccagcactcctacactgccattctgaaccaagacttcagcttcctgcctgagctccacgcactgagcacgggcatgaaggccatgatgtcagaattctgcacccagggagctgagatgtgccgcagggcctgtggcggacatggctactcaaagctgagtggcctgccatcactggtcaccaaattgtcggcctcctgtacctacgagggtgagaacacagtgctctacctgcaggtggccaggttcctggtgaagagctacctgcagactcagatgtcccctggctccacgccacagagatctctctctccatctgtcgcatatctcaccgcacctgacctggccaggtgtccagcccagagggcagccgacttcctctgcccggagctctacaccacggcctgggcacatgtggcagtaaggctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccggaaggatgccatcctgttaactgatgcttttgacttcaccgatcagtgtttaaattcagcacttggctgttatgatggaaacgtctacgaacgcctgttccagtgggctcagaagtcaccaaccaatactcaggagaaccctgcctatgaggaatatataagaccacttttacaaagttggagatccaagctatgaaataaccaacagtattcaagaagcaaccagcaccatcatgtgataatggtactatggcatatatgcaacattaaaattttaaattagatattt

SEQ ID NO: 595511 - DNA, 2500 bp, Homo sapiens
aagagagggaggaaggagaggagctccataagcccagacaagggcttgagagcagacaagggcttgagagcagacaagggcttgagagctggccaagcagtttctctcagcttctgtgttccagcccctctgtgggaggagagaagggcaggaccacaagcctgccagaggctgcggcctacagccggggagaggccagcccggcctacagtgcggacacaggacagaggggagccaggttctttgcactgaccaatgctgagagcagaccctcggagcagccgggttggaagtgtctctccacagtcaccagacagatccaggataggatgggcagcccagtgcaccgagtgtcattgggggatacctggagcaggcaaatgcaccccgacatagagagcgagaggtatatgcagtcctttgacgtggaacggctcaccaacatccttgatggaggtgcccagaacactgcactccgcaggaaagttgatccatgaagcaagtgggtgagaagatttgaaggtgccagaaacctcacccaggtccctaagccctctgttctctgtcctctgcagagagcatcatccacagttacccggagtttagctgtaaggacaattatttcatgacccagaatgagcgttataaggctgccatgcggagggcattccacatccggttgatagctcggcgcctgggttggttagaagatggtcgtgaattaggctacgcttacagagccctttctggagacgtggccttaaatatacacagagtcttcgtgagagccctcaggagcctgggctcagaggagcagattgccaaatgggacccactctgcaatcttcagggcctggagactgaagccacctatgacgcagccacccaggagtttgtgatacacagccccacgctgactgccaccaaatggtggcctggagacttgggacggtcagccacccatgccctggtccaggcccagctgatctgctcaggagccaggcggggcatgcacgcttttattgtgccaatccggagtcttcaggaccacaccccactgccaggaatcatcattggggacatcggacccaagatggactttgatcaaacagacaatggcttcctgcagctgaaccatgtgcgggtccccagggagaacatgctgagtcgctttgcacaggtcttgccagatggcacctacgtcaaactcggtacagcacagagcaactaccttcccatggtggtggtgcgggtggagctgctgtcaggggagatcctccctatactgcagaaggcctgtgtcatcgccatgcgctactcggtcatccgccgccaatcccggctccggcccagtgacccagaggcaaaggtcctggactaccagacacaacagcagaaactctttcctcagctggccatcagttatgccttccatttcctggcagtcagcctcttggagttcttccagcactcctacactgccattctgaaccaagacttcagcttcctgcctgagctccacgcactgagcacgggcatgaaggccatgatgtcagaattctgcacccagggagctgagatgtgccgcagggcctgtggcggacatggctactcaaagctgagtggcctgccatcactggtcaccaaattgtcggcctcctgtacctacgagggtgagaacacagtgctctacctgcaggtggccaggttcctggtgaagagctacctgcagactcagatgtcccctggctccacgccacagagatctctctctccatctgtcgcatatctcaccgcacctgacctggccaggtgtccagcccagagggcagccgacttcctctgcccggagctctacaccacggcctgggcacatgtggcagtaaggctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccggaaggatgccatcctgttaactgatgcttttgacttcaccgatcagtgtttaaattcagcacttggctgttatgatggaaacgtctacgaacgcctgttccagtgggctcagaagtcaccaaccaatactcaggagaaccctgcctatgaggaatatataagaccacttttacaaagttggagatccaagctatgaaataaccaacagtattcaagaagcaaccagcaccatcatgtgataatggtactatggcatatatgcaacattaaaattttaaattagatattt

SEQ ID NO: 595512 - DNA, 1032 bp, Homo sapiens
gagtcccgagcagtgctcgctcctgctcggggcgctgcggccccgggcagtcgccatgaccagtgagctggacatcttcgtggggacacacgacccttatcgactgaggacgtgtatcgccatctgtgctcgatggattactcaggatgacctgacgcggtggccctgcagggtgcgactcgggaatcctggagcagactggcagccacggcagacggtagctgcagaagcgacaccaatggaccattaccgacaccttaccacatgctcgagcggactgcatgcactgcgcacgaccaagctactgcacccagactcatcttccagattccgccctcccggcaggccactacgtcatcgagacggctactatgccctttgatgaggcctaagctacgggaggcgctgcgcacagaagctgtccaaaacggcaccaagcacagaccctggctgacctccagcaccacccacaggcatcaccctccagcagctgccgcgagcaccgcgacaactccacacgggtcttcaaggtgcgtagaggacatgccgggctccctggtggaaaatatacagccccacttcctcctctctgaccggactggccaggactatgcagccatcgactctctgctcacaacgtccgcgacagggacgcacacacggccgctccgagcaccaggacactagccttccgcgcagaacccggatccaacaccggcccatcggcaccgcgaacccacgagcgccccggacacgccacagccaggaacccaacgcatgcacggaccacggcccccggccacaacgcctcgtagacacaacacgcggacgacacccggccaccgcgcccaccacagaagcagcaacacgcacgacggggaggagacgcgccaacgcccagcacgacaagcccgcaccgaacagaccgcaaagacaccacagccacaaaagcacagcaacgcaggcgacgaaacggcaccacgcgcgggcccgtgaaacagcacccacaccgccccacccgccccaacgaac

SEQ ID NO: 595513 - DNA, 423 bp, Homo sapiens
atctagttcatattctaggaactgtacggttgagctgcatgtggaatccagcactgttactacataatctgctttgtgttcaatgctggcgcagcaagtggcattatacacgggacagtctcacgcacagcgtgcagtcagtgcttgaaaggaaggaatgacaattccagcaggtacagagaacttaatggaggtaatctcaatggtctgctcaggctcgatgatggtgggcaactcaaagtctgcgatcttgttggcgattgcatctagatgcaaagcagcaatgccatctgaaacactctttgcaagcgtgaactggtacacagttaactgagatgcaggctaacacatcatctgcagggaagttgacctcggggagtgttggtagattgagggcgaatgatgaagttcgcagcatcgtat

SEQ ID NO: 595514 - DNA, 2243 bp, Homo sapiens
gaaattccactgttagagattcattccttcgaactgtaaagacaatcttcacatgtcaatattgcctgagcccacctaggggatagaagagtcctaggcagcagaagacctggattctggtcctaaaattctgccactgcatagctttgtaaccttgggcaattcactttcccaccttggtcctcagttttgtcatctgtaaaataacaataatgtctgacttcctttccagatccatgaagcaagtgggtgagaagatttgaaggtgccagaaacctcacccaggtccctaagccctctgttctctgtcctctgcagagagcatcatccacagttacccggagtttagctgtaaggacaattatttcatgacccagaatgagcgttataaggctgccatgcggagggcattccacatccggttgatagctcggcgcctgggttggttagaagatggtcgtgaattaggctacgcttacagagccctttctggagacgtggccttaaatatacacagagtcttcgtgagagccctcaggagcctgggctcagaggagcagattgccaaatgggacccactctgcaatcttcagggcctggagactgaagccacctatgacgcagccacccaggagtttgtgatacacagccccacgctgactgccaccaaatggtggcctggagacttgggacggtcagccacccatgccctggtccaggcccagctgatctgctcaggagccaggcggggcatgcacgcttttattgtgccaatccggagtcttcaggaccacaccccactgccaggaatcatcattggggacatcggacccaagatggactttgatcaaacagacaatggcttcctgcagctgaaccatgtgcgggtccccagggagaacatgctgagtcgctttgcacaggtcttgccagatggcacctacgtcaaactcggtacagcacagagcaactaccttcccatggtggtggtgcgggtggagctgctgtcaggggagatcctccctatactgcagaaggcctgtgtcatcgccatgcgctactcggtcatccgccgccaatcccggctccggcccagtgacccagaggcaaaggtcctggactaccagacacaacagcagaaactctttcctcagctggccatcagttatgccttccatttcctggcagtcagcctcttggagttcttccagcactcctacactgccattctgaaccaagacttcagcttcctgcctgagctccacgcactgagcacgggcatgaaggccatgatgtcagaattctgcacccagggagctgagatgtgccgcagggcctgtggcggacatggctactcaaagctgagtggcctgccatcactggtcaccaaattgtcggcctcctgtacctacgagggtgagaacacagtgctctacctgcaggtggccaggttcctggtgaagagctacctgcagactcagatgtcccctggctccacgccacagagatctctctctccatctgtcgcatatctcaccgcacctgacctggccaggtgtccagcccagagggcagccgacttcctctgcccggagctctacaccacggcctgggcacatgtggcagtaaggctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccggaaggatgccatcctgttaactgatgcttttgacttcaccgatcagtgtttaaattcagcacttggctgttatgatggaaacgtctacgaacgcctgttccagtgggctcagaagtcaccaaccaatactcaggagaaccctgcctatgaggaatatataagaccacttttacaaagttggagatccaagctatgaaataaccaacagtattcaagaagcaaccagcaccatcatgtgataatggtactatggcatatatgcaacattaaaattttaaattagatattt

SEQ ID NO: 595515 - DNA, 232 bp, Homo sapiens
ccatttttttcccaagggaacaagattttttcaaaggggggtttttaaaaaagcagggacaaaaagggcctggggccatttaggcctgggggaggcatttgcttttcccgtttgggccaagggaacaaaggaaaggtgctttgtttttttccccgggatttaatggggcatttttcagcaaaaacttatcccctgggattttttaaaaaaaaaaattttttttggcctttta

SEQ ID NO: 595516 - DNA, 354 bp, Homo sapiens
tacagcacagcactcagcacgatgccaggaagcagagggcggcaggtggctgcgcacgcggaggtgtgatgatggcctggtcggagcccttggagctggtgccgttgcaccggtactggccggggtcggcctcctatgttcaggttctcaatgtgtagctctgaccggccctgcgaggaactcacgaagaacctgctctcggagccgttcatgagggccttgtcctcagagtcagtgatcttgtaccaggcccagtcagtgacaggtggcacggactctgacttgcagaccagcatggccgtctccccctcgttgatgtgttctgacgacttcacggccttcactctgggaggg

SEQ ID NO: 595517 - DNA, 111 bp, Homo sapiens
  misc_feature (104)..(104): n is a, c, g, or t
gggacagtcttgctctgttgcccaggctggagtgcagtggcgcgatctcattgcaacctctgacagccaagaacacgtcgccctcatgctttagcctcccgagnagctgtt

SEQ ID NO: 595518 - DNA, 2285 bp, Homo sapiens
aagagagggaggaaggagaggagctccataagcccagacaagggcttgagagcagacaagggcttgagagcagacaagggcttgagagctggccaagcagtttctctcagcttctgtgttccagcccctctgtgggaggagagaagggcaggaccacaagcctgccagaggctgcggcctacagccggggagaggccagcccggcctacagtgcggacacaggacagaggggagccaggttctttgcactgaccaatgctgagagcagaccctcggagcagccgggttggaagtgtctctccacagtcaccagacagatccaggataggatgggcagcccagtgcaccgagtgtcattgggggatacctggagcaggcaaatgcaccccgacatagagagcgagaggtatatgcagtcctttgacgtggaacggctcaccaacatccttgatggaggtgcccagaacactgcactccgcaggaaagttgatccatgaagcaagtgggtgagaagatttgacctcaggagcctgggctcagaggagcagattgccaaatgggacccactctgcaaaaacatccagatcatcgcaacgtatgcacagacagagttgggacatgggacatatcttcagggcctggagactgaagccacctatgacgcagccacccaggagtttgtgatacacagccccacgctgactgccaccaaatggtggcctggagacttgggacggtcagccacccatgccctggtccaggcccagctgatctgctcaggagccaggcggggcatgcacgcttttattgtgccaatccggagtcttcaggaccacaccccactgccaggaatcatcattggggacatcggacccaagatggactttgatcaaacagacaatggcttcctgcagctgaaccatgtgcgggtccccagggagaacatgctgagtcgctttgcacaggtcttgccagatggcacctacgtcaaactcggtacagcacagagcaactaccttcccatggtggtggtgcgggtggagctgctgtcaggggagatcctccctatactgcagaaggcctgtgtcatcgccatgcgctactcggtcatccgccgccaatcccggctccggcccagtgacccagaggcaaaggtcctggactaccagacacaacagcagaaactctttcctcagctggccatcagttatgccttccatttcctggcagtcagcctcttggagttcttccagcactcctacactgccattctgaaccaagacttcagcttcctgcctgagctccacgcactgagcacgggcatgaaggccatgatgtcagaattctgcacccagggagctgagatgtgccgcagggcctgtggcggacatggctactcaaagctgagtggcctgccatcactggtcaccaaattgtcggcctcctgtacctacgagggtgagaacacagtgctctacctgcaggtggccaggttcctggtgaagagctacctgcagactcagatgtcccctggctccacgccacagagatctctctctccatctgtcgcatatctcaccgcacctgacctggccaggtgtccagcccagagggcagccgacttcctctgcccggagctctacaccacggcctgggcacatgtggcagtaaggctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccggaaggatgccatcctgttaactgatgcttttgacttcaccgatcagtgtttaaattcagcacttggctgttatgatggaaacgtctacgaacgcctgttccagtgggctcagaagtcaccaaccaatactcaggagaaccctgcctatgaggaatatataagaccacttttacaaagttggagatccaagctatgaaataaccaacagtattcaagaagcaaccagcaccatcatgtgataatggtactatggcatatatgcaacattaaaattttaaattagatattt

SEQ ID NO: 595519 - DNA, 144 bp, Homo sapiens
  misc_feature (111)..(111): n is a, c, g, or t
cagaccagtctcactcactgtgcttatgctggatctatcattactgaaaaaccgctctgttgtgctggctggcaggcctgtggctgctggctgagggttctgctgtcctgnggcaccccattaaagtgcagttccctccgggcc

SEQ ID NO: 595520 - DNA, 328 bp, Homo sapiens
tgtgactctaagaccgaaactacgatggcaacctgctttacttttcattgtcagagtaagaggtccacttgctgtaaatattccaaacaaagcatttaagattttgtctttgctaagattagttgaaactaatactagtgttttcgtcaaattgaccaagaacgtatatccgttgctcaaggttattacgccatacgtagtgattggcaaaccttctttatcttctatccgttccttgattcaaaagagaggtagaataatctataagggtgagaatgaggctgaacctcacgaaatagttcttaatgacaacaatacgtaagttgtc

SEQ ID NO: 595521 - DNA, 335 bp, Homo sapiens
  misc_feature (39)..(39): n is a, c, g, or t
  misc_feature (48)..(49): n is a, c, g, or t
  misc_feature (53)..(53): n is a, c, g, or t
  misc_feature (88)..(89): n is a, c, g, or t
  misc_feature (107)..(107): n is a, c, g, or t
  misc_feature (123)..(123): n is a, c, g, or t
  misc_feature (152)..(152): n is a, c, g, or t
  misc_feature (323)..(323): n is a, c, g, or t
gatcccaataacattcccagtatagaaaacaatcaccangaaaaacanntggncaccagaacatcattaagagctcaagcataaggtnngacaacaagttgtggaanaaaccctatgtccacnctctgggctatgtttacaagttttcccantttgttctcatcaaccttccctagtacaaattgaattacatcatctcacgtgaacactactgactttactgaatctattccttgatttgatgttacctttcatacaaatcacagtagaaaaacgtatgaagttttttcaatacagccaagatgctggcttctcacctgtgnatatagttttca

SEQ ID NO: 595522 - DNA, 1271 bp, Homo sapiens
tcagttcaagttttgcaatgagttctaaggaactgtctgtttttaaggtttttatggtgtcggggataggggaaggtggacacaacaggtagtgatctaaatcttctggttcttttcccttcagtgacccagaggcaaaggtcctggactaccagacacaacagcagaaactctttcctcagctggccatcagttatgccttccatttcctggcagtcagcctcttggagttcttccagcactcctacactgccattctgaaccaagacttcagcttcctgcctgagctccacgcactgagcacgggcatgaaggccatgatgtcagaattctgcacccagggagctgagatgtgccgcagggcctgtggcggacatggctactcaaagctgagtggcctgccatcactggtcaccaaattgtcggcctcctgtacctacgagggtgagaacacagtgctctacctgcaggtggccaggttcctggtgaagagctacctgcagactcagatgtcccctggctccacgccacagagatctctctctccatctgtcgcatatctcaccgcacctgacctggccaggtgtccagcccagagggcagccgacttcctctgcccggagctctacaccacggcctgggcacatgtggcagtaaggctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccggaaggatgccatcctgttaactgatgcttttgacttcaccgatcagtgtttaaattcagcacttggctgttatgatggaaacgtctacgaacgcctgttccagtgggctcagaagtcaccaaccaatactcaggagaaccctgcctatgaggaatatataagaccacttttacaaagttggagatccaagctatgaaataaccaacagtattcaagaagcaaccagcaccatcatgtgataatggtactatggcatatatgcaacattaaaattttaaattagatattt

SEQ ID NO: 595523 - DNA, 216 bp, Homo sapiens
  misc_feature (204)..(204): n is a, c, g, or t
ctcacctcagaaacgcctatcatcttgctcatcaccatgctgattatatgcttttatatcgtcaatagttttcccgagattactgaacactactgactttactgaatctattccttgatttgatgttacctttcatacaaatcacagtagaaaaacgtatgaagttttttcaatacagccaagatgctggcttctcacctgtgnatatagttttca

SEQ ID NO: 595524 - DNA, 244 bp, Homo sapiens
ctcattgcagataatttaagcttagggccttgtggctaggtcggttctctctttacagtcggagacctctgccgcaaacatgcttcgccagattcattcggtcaggccaagaagcatccgagcttgttccccctctttgtatttatggaacttgagctacttgagcaacactgtatctcttgcgtcttgcatgttcaatccagagtttgttgggacagaataacccagagccctggacaaactg

SEQ ID NO: 595525 - DNA, 822 bp, Homo sapiens
ggcagaaggctgggagggctgcgcggcctgcgcgtcgccatggagcccgacggattacgagccgggcttcgtgggtatcgcttctgccaggaatgtaacaaatgctgtaccccaaggaagacaaggagaccgcattctgctctacgcgtgcccggagaactgtgattaccagcaggaggcgacaacaggtgcttctatgtcaacaagatcacgcacgatgttggaccgaattgacccagattatcgcgaggttggtcccaggacccccatgttggctgcggacccgaggacccacccgggtgcaaaaaggtgcggcacaaggagggctggtgttctttcccaggtcacaacagtgcgccggccggagggacgccaatgcgcctttttactaacggtggtgcacacaggcccaaaatgtgggggccaccggtgggcaccggaggtgacctccttttctcccccgagggttgttattaaaacacccaagattcccattgttaaaaaaaaacattgacacacgaaaaccacactttgtgcggcgccgcttgtcgccctgggaagaagcctttctttcacaaaccaccctgtggttggtggcgcccgcgcgccccgtgtgggttttggtcggccccgtggtgccccgaccgtgtgtcccccacgcgcggcaccctgtggcctgcctcactggtggcttggtggttctccacccatttaaacgcgccgggggcacccgcggggttcgttgaccaccccagagtggcgtcggcggccgtcggcgctctcacgggggtccaggagcggaatatcaggcggcgtgggcgc

SEQ ID NO: 595526 - DNA, 237 bp, Homo sapiens
  misc_feature (35)..(35): n is a, c, g, or t
aaaatgaactaatgttttcccttccccctgccccngatttttttttaaaagggaaaagcccctggaaaaaaaaattgcccaatcctgggccccaaaaaggggaaaaatttgtttttatgaaaaaagtattgggctttgaaactaaaaatctgtaaaaagttagttttgggaattttttttctgcggggggatttacaaattaaattttttttgctgggggataaccctttaaattta

SEQ ID NO: 595527 - DNA, 563 bp, Homo sapiens
gacagctggagtcaaaacaaacttaactcaaatatcttgggaacgaattcgcgctgatgaaaccttggactgtagctccactccggggaacggactcgccgggactgacagtgccggaagtgagctgcgggaatggcgcgtgcgactggcggctgcgccggaactgtgtgcgggctggacctcaattggagaggaagagggcgctggcgggtggtcctgggctccagaaccactgcaactggggagtggatatcttctgatgatctcctgatgagtgttcacatcggcatctggagatgagtataagagctcttaacgggtggatctccgtcactacaaagcaagtgagctggagctacagcagatgacagaaatccatcgggatatatcaagagagtgagactctgcctctctaccaccagacacggctggatgtgtcctgacgatggaaaatgttggagcgtccagtgacctcagctcctaagtctgaatcaggaaatgcaagaccaccacgagcctgaacatcgatccgaaatgcccggcagcagggggaacattgggag

SEQ ID NO: 595528 - DNA, 693 bp, Homo sapiens
  misc_feature (624)..(624): n is a, c, g, or t
aaaccatgttgctttctggtactacatgcattagcgaaaggttaagtaagtttgttctccactgaagtaatacttaacatctcagaaaaaatttgcatgtctgtagtttgtataaatcagtcatttcatattgcactaatatcagtacaaaaccgggtaggtttaacccttggtttcaataggtaatgtggttatttaacaaaagtgttctccccttggcaggtttcaagacggtaatcctatagaggcttaatccggttccaaattacacgccacttgtgaattatcccagagtagttcttctacgcatagctcacctttctaaaccccagttaacgcatgggaagagaggtagtaggtaggtgcagtgtgtggaagctggcaaacaagtaggccttttattcattgatatcttttcccaagtactggattttaaatctggtatgtatctgtctgatttttttttctaatatttcacgttgagctgctgtttttcttccatgcaatatggtatactcaatgtgtgtatagaagaagctggtgagagtgccctcctacataaataagcaatgtgcagtgtttggcatgcaaactataaaaaattaaatgtgtcctgattctatntcgtcaatggagaaacaatcataatctttctaaggcggtaatggagggaagaataggggttggtggctc

SEQ ID NO: 595529 - DNA, 547 bp, Homo sapiens
  misc_feature (1)..(1): n is a, c, g, or t
nccctcacggtactcaacgtcaatactacagccttgcattgtcattattagacttaaatactcacagtgcagcaaaatatttgagtcatctgagacccacatacccagcctccttttttcagctcccataccgtaatcaagtgtcctttccataatctatttagggccacaatttctccatttgtacagtttttactggtgattttgctctttcaaatggcctaagcctggggctgaaatgccgtctagtgctcctgaacataagaaggctgggatgtctctgatggacaaaatatatgtgttagataagctttgttcacgaaagagttatagtgtgctggccgtgagcccaatgtttatgaaataatgatatatagtaaagaaggtgtctttaaacagaaacacatatgcaacaagcttatacattggtaaattgacaaaaatgttgtgacctgaagcttacaggagcctaatccaacatttcccctaaaaacaatgattcagtatttgccaattcaatgtttatgatacatatatgaaatgtcag

SEQ ID NO: 595530 - DNA, 455 bp, Homo sapiens
cttgttgggacgacaggccaccataagaggatggatctgccgggacgctccctggttagtacaacagagcaggaagctcgactagaggacgacatgtgcttaccatgtagcgcgaagggcccacgcatacccccaggcagatgtgcccttgagaagtggggactgttggcaccaagaggggttgcctccggggtggccttcctggatggagctgcccgtgttgagcgcactgtgctctgtgtgggcaggggttcccagctgcttcccagcgctttcatgggcagccccctggagctccaccagcccaaggagccccaaaaccctcctgctgaacatgccatgaatttgaatgcttgaaggcatagctttaaaaaacaaaaaaaaaccctgcttagactgcagggtggtaggggaagtaagctttgtatttgccactatttttaaaagtatatttg

SEQ ID NO: 595531 - DNA, 776 bp, Homo sapiens
cgcatgttgttaacctctacagcacaggggatcatggttctgtgcctattgttacctgtagcttgtcgtactttctgctcagctttcctcctcgagtagtgtgtctgcagtctggtagatcctatggcccgcacacagtgttgatctcaatctatccagtgggtccaacgagggctgctcttgggtcgtccctgcctgccggtcgtctgttgtcatgtgagcccaaggagtgttgactgtcggtactctagtttcacgcacatctttatctcctggtgcagaattgacggagagcttctgtctgttgtttccttcgcgcgatcgtaatgtagctcttctgtgttcatcgagtcatccacgatcgatactgctttttcgaaatggcccagatctacgaccaattctagtggatacgatccggcccactcactcccttgatcgtgtgatgctgcgtgtgatgccataagattatgaacgggacctgtgttgccctctctatttatgcaaatacccacactcagatccagtttacctatgctgatccagcttctcccttgggcaggagttctcctgtgtcctctctcctccatccacctcccctccctgccatcacctcacgcctttctgttcctgtgtcctcaccttactcccctcaggaccctaccccaccctcttgaaaagacaaagctctgcctacagtagaaaactttttttatttaaccaaagcttactgttgtttacagtgagtttggggaacaaataacactcgaatcgtt

SEQ ID NO: 595532 - DNA, 398 bp, Homo sapiens
  misc_feature (48)..(48): n is a, c, g, or t
  misc_feature (169)..(169): n is a, c, g, or t
  misc_feature (363)..(363): n is a, c, g, or t
tataaccctgagcatcctgaaaatgattggccatgcaatttactgaanatggggaaagacaagactaaagaagggaaaaagcaaattttccaaaaaggaagggagaaatccaaaagtttaatctgaagaaagtagtcagttattcaaagtggggcctgtccgtgggttnttacgcctgtaatccaagcacttcaggaggctgaggtggccggatcacttgaggtcagaagttctagaccagcctggccaacatggtgaaaacccaactctactaaaaacaaaaattagccgggcatggtgtgtgtgcctgtagtcccggctactcagtaggctgaggcaggagaatagcttcaacctgtgagnagaggctgcaatgcactgaggtcatgccactgcac

SEQ ID NO: 595533 - DNA, 806 bp, Homo sapiens
  misc_feature (300)..(300): n is a, c, g, or t
  misc_feature (436)..(436): n is a, c, g, or t
  misc_feature (546)..(546): n is a, c, g, or t
  misc_feature (563)..(563): n is a, c, g, or t
  misc_feature (628)..(628): n is a, c, g, or t
  misc_feature (654)..(654): n is a, c, g, or t
acgagcaggacacttgtcagaaggatgcaaaaaaagaaaaaagtagatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttggatttaaataaaaacaacagcagcaggctgtccctgagtagttttgctgccataagttaagtcctcatgtgtacagtgcangccctgtggcccgcacttcagtaagttatcaactctcaccgctgtgaacctgccaatccgctgtaacaactctgcttaaaacaaaaccaaaccaaacttttaaaaaaaatgtgtgatccagctttctcttgccatnctatgtgcatgccgtaagatcagttggatattaaaaccatcataaagttcacaagattttgaaacaaattcttgagcttcgatacctaagacagacgatagtgatcttgnaaagaagaaagggggangggggaagctctattcagcaaaagcatataaaagtgtctttcaccagactttcttgggtggttangggagggccaaaaggtggttatagcntacttaaaaattttaatcccccacttgaaaacatggtttggaatggtgcctggtgaggtcttaaaggaaccgatttttaaccctttgcctcttccaaggagaaaggattgacccggggttttggaataaatttttccaatgccgccaatttt

SEQ ID NO: 595534 - DNA, 395 bp, Homo sapiens
  misc_feature (27)..(27): n is a, c, g, or t
tctccctactgtatcctagcactttgngaggctgagatgggaggattgtttgaggccaggagtttgagaccagcttggtcaatatagcgagacccccatctctgttttttttttttaaagaaattattgtctaagaaccagtgtcatcttccaaggagaaacttctagatacttgttttaggataaataagaaacaagtcatttctaaatgtgaattattttttaaatgcaattttttaaacattttattttaattatggcaatagacgtggaaaagactcttttttgatagtaggggagagcagaagaaacattgaattaagtacacagagattcttcagacctgctttaaaaacacatgcatacaaatgcacttctgtctcttaggaaacagt

SEQ ID NO: 595535 - DNA, 119 bp, Homo sapiens
ttaccgagcttatctagccgcgcagtggtgcacgcctggtttccagccactcaaaaggctgaggcacgagaattgcgtgaacctgggaggtggaggttgcagggcagctgagaccatgc

SEQ ID NO: 595536 - DNA, 1625 bp, Homo sapiens
ggcggggctacgagacggggaccaatgtccggaaggcgtgggtggcgtatgtgtgcgataccctgggtgacgtgggctagagtgctgagtcccaagccctgtgaaggcgtcgctgggagttgggcgagtgctcagtgggctggagccgagtagatactgtgagatcctaagtccatgaaggcggggctggtggcgcgtgttcgtgggtgcggtggctaagagaacgaggtaccacatgtccatgaatgcgtggctgtgagtggtgcgaggatcaagcccgtgacaggcgcgtgattggagctggtggcgatgacctatgtggggcagggtgttgacgagcagaggaccttaggccctgcatgatgcgtcgctgggtctgtgacgtgaagaccatgtgcttagcacttctatgtgatccaagtgctgcacacatggtgcgcttgcgactaggggtgacgccgattgagtatgcatcgacttctgcgacacagtgtgtgcgcgacggctgtaggcgacggggataaccacgggcacggacatagactaccgccaagtgaagaggcagttgtgttgaggagcaggtgggcatgatgacgcactagttgggcggtctttggagccccgtggatgtccggtacttgacgctttggtgtcatcatgaaggttcacgaacgaaaccctccatagttggaatctaagcctttagactcgcagtgccttcgtctagacattgttcttagcgtggcatccacacgggcagctagaatagcatgcagggatacttgaccgttgggagaagactacctccgggtcgggccccacaccaatgtagaacacctatgattagcgaaacgtcatgttactccaagcggttatagacaatttattggatgtacccttacctagcgacatatttccattcccttgacaactctgggtgcaaatgggtcccacctccatatggaaacaccacgctacttttaaaccaaaacatttggtgtgctatgtggggtaggccacattttgtgacgcgtctcggtcacagtacgtgaagacaattgagttgcttcccctttttggtggtatcacgcatgtgtaacctgacgccacggccctttgggactaccgcgacactcgaggaactgttaggacgggtcttgggcgtgcgcttacgagcgtgcgaaacgcgctcctgaggacggaaaacccattggggcccattttaccatgaattcgcgatttggtttcagtcgttcacgattagaccccgtttgtaaactaatcgccaggacaatagggtcaggcggatctacacaacaggtcgctattagcagatgttggcgccactattggtgacaacacccccagcggtgatcgatgtgtgtggctagagcgggtattaaaaacttggggcaaaggcattaatagagtagataacaggaacataatggcttgacgcaacaaggccgacaattgtatgactgcagtatactcatagggcaacagatcatagttatttcgtcgccataaaatattacgttagtaggaaagtgggtgtcccagcagacagtcgcttagaattacgagctagaaggcgtaagccgtaccaacatacttaggctacg

SEQ ID NO: 595537 - DNA, 220 bp, Homo sapiens
  misc_feature (3)..(3): n is a, c, g, or t
  misc_feature (6)..(6): n is a, c, g, or t
  misc_feature (21)..(21): n is a, c, g, or t
  misc_feature (90)..(90): n is a, c, g, or t
  misc_feature (122)..(122): n is a, c, g, or t
  misc_feature (219)..(219): n is a, c, g, or t
ggncgngccgcaggacgcttngaagcgcgacggcccttataatccgcgagtcggaggacagcaccgatttcaacgacaagattttaaatnagcccctcaagcactctgacttcttcaatgtnaaggaactgttttccgtgagaagcctcttcgatgcccgattccatctgggacacaaagctggctgtcggcacaggtttatggagccgtacatctttng

SEQ ID NO: 595538 - DNA, 367 bp, Homo sapiens
caaggttatcggaagcgtcagggagacggttgaatgtatctgcagatggttactaattcatcagacgacacagatcctctgctctctataattacctcgtctatgccttcaattctcagcacccgctgccgcagcactacaatctccgccaacatgctggagtagctaccttctgcctgaatcaccttgtcctggagactccaggagttcatcctctgctatctggaggttatttgtggcttcctccaactcatcaaggcggcgccttagactctgtagcttaaaccgcaagtggcgactggagccttctccttgcaccattgaacattcggccatgtctacctgccagccactgcgggctcctaga

SEQ ID NO: 595539 - DNA, 296 bp, Homo sapiens
tttcgcgagaactacccccaaaatgccaaagaatggggcaagggagaaggaccttattttcaacattgtttgaccacttggttaacgccccctcttttgtgccaaggccaccaccattttgttcaatccgaaagcattaaaaagtgggggggcaactcacaaaaggaaccaatgtttaaaatattttgtaatggggggccgcccgaaaaagggaaaagggcccccctctaaagtagggcacggttctctgtgataaaacaccaaaaacgtatctcttaacgcgcgagacaccacac

SEQ ID NO: 595540 - DNA, 487 bp, Homo sapiens
  misc_feature (41)..(41): n is a, c, g, or t
  misc_feature (71)..(71): n is a, c, g, or t
ggggggggaaaccccaaagggggggaaaaaagggggaaaangggaaaaggttttaaggcttccctgcgggngtggggattgggggtggtggtgatatagacgtggggacagagtggaaaacaacaaaaatataattattttagttcaaagttattgtgtcttgagttgaaaggcagggcagttagcaacacagcttagatttcagtactgcccctgaaatctgaactgtgttcaaagtctaaaacgtttaccttagcaaattcctcataaaactccatttggaagagtcccgagagctaatttgttaagtatacttgcaaaaggtagatgaggagacagataaaatcttattacctctttcagatgagaggcacttgagccctgctcagctatgagaataagagaggggaattaattctaattgaatacacttgttctcttatagctgttgttccccaccagaaccaaatgagcgcaagatctgaca

SEQ ID NO: 595541 - DNA, 468 bp, Homo sapiens
atcacgaaacaccgtcctatcttcgcatgggcgtagctatactatctgatcattcactgtccatcccgttccgatgacgagcgatcgtcgctacaatcgacattccctacatgtgcgctatcaggcatcccgtcaattcggtgccgccaatgaggcaaccaagagcttgggtcgcaccaagcaagccgccaagggtaatgcagctgcggtcctgtgcggcggcgctacccccagctaccctattttatgaggctgattcatccagtaaatacttaagggcacacctactgtgtataggctattttgctaggtgctggtgatagagctgtgactaagacactgtttctgtttctctctgagaccttagtagaactaatgatctgattgggaagttcaatcattaaatgagccattggaatatattagcactctagagatgtagagagtgccatggaagtgcatagcagg

SEQ ID NO: 595542 - DNA, 1913 bp, Homo sapiens
acacggggtgtggtcaacaactaactagctacgtgggacggcacacaactctggacgtgtgtggtttgatgcttccgaggcttcgttatcttttggttgttgtacgacagtaatgttcgcccatcttgcatcctgctctctgagtgaggtggtctaagctacgatactagccctagttgagttagtctatatgtcgtggctccgcgctcccccaacgcggtgtgagcagccacagcaaagagccgctgtggtggcgagggagcagaatgggctgttctgctgcgcagcatatggaaagtggttgcttgcgggtacacacacaatgagtgtgagagaatgtatttttgttcggttcgtattggtgaggaagacatccacctagagtgaagtgttccactattgaattggaggatgtcctctgtcgagactaggttttctgcttgcatctaggttgcgcacgcagtaggatgggtgtcctcacatatgcgctcgctcagtgagggctgccaatattcggtgggagcgcacgcacgcgagtggggtgcacctccacccttcgtttgttggggggtatatactccatcttggttggttgtgtggaccaacaactaatagtaagagttttttgtttgtgtgggggtggagtaatagtatgtcgcacggcccaccaatgatgctgttttcgtatttattgtggtatggatatcatccttcttttagtacgctacgacacgtcggggtagggaagcagcctgtgtttcgtcgaacctacgcggcggtgaaaatttgtgtgtttttttggggaagaaaacaacaacaaaagagaccgccttcttgtgtttgtagaatagaatatagtcacccgtcgtggggagtgttcttcgttccactacatgcactacctcctggtaagtttggtgcatgcgctgtgttttgtaccgacacacgtgtgaacaacggcacaccacactattttttattacctgcgctcaccctatctgaatagcgggacgctccgcggtagatagggagagttctcatctcggggggcgtgccctactatattttctccacacgagggataaagagacggtacaccacacaaggggtgtccagcgggagagttagtagatggaagagggtatgcaccgagttttattctgttttcactatgatgcacccactatgcaccaacaagtgagggcacacaacacaaggagtagagagaagaggacacactctcttttgagaggagagcacacatctcgggagagtgagaacgacacacacacacactcgtagctcatctttgtgtggggagagaacactgtgtgggacacaactcggggagaagaagtgtcaacactctctttggagaatatatatagagacccacgctgtttaatgtcgcacacacacagaaactcttgtgggaatcgagagagctcttgagactctgtgggcgcacaccactgtctcccgccacagaccactgctgtcgcctgtctctcactctctgagtgagagagacacacacagaagtgtgtgtgtgtgagtgtgacgacacagagatatgtcacacactgtgtgtgtgtgagacagtgagtgggtgatgtgagactgagagagtgtcagagcacaagtgtggtcccatagatctcattacctggttgttctcataacagcgttcttgccacaattctgtgggtaaataatagtagatacacacttgtaagaggagaattggccacacgttagatggcctgtggtagacctcttcccacgggaacacccacatggccacgggagcactggcacattacaccttgtcacccttgcttctaatttttgttgaaatgtatttaactgggccccacgtttctttaaatgtaaaatatttaattggaataaat

SEQ ID NO: 595543 - DNA, 454 bp, Homo sapiens
catgtgcgaggcttctaattactccaaaggccagacgcctcaagatctcaattgcttttcaagaacttatcttagggttttttttgtttgtttgtttgtttgtttgtttgttttgagacagagttttgctcttgttgcccaggctggaaggcagtggcacgatctcggctcactgcaatctccgttgcccaggctcaagcaatcctcccacctcagcctcccaagcagctgcgactacaggcacgtaccaccacaaccggctaatttttgtttgtaagtgtgtgtgtgtgtgtgtgtgtgtgtgtgtgtgtgtgtgtgtgtgtcgtgtagagacagagttgcgacatgtcgcctagggtgctctcacgctcgtgggcacaagtgatctgcccgccgtgcgctcacagagtactgagataagggtgggagccacgatatgtgcgggacaccgagc

SEQ ID NO: 595544 - DNA, 426 bp, Homo sapiens
  misc_feature (133)..(133): n is a, c, g, or t
  misc_feature (137)..(139): n is a, c, g, or t
gacgttagatcagtcctatacataaatagctgatctcataagtggttttaaggatgctggcgggaggttgaaattgtattggtggagtctcctgccaaagaattcaaagttggaagatgaagaattcaggccnaagnnntgataaatatcaatgaaaataagagagatttcacagataaatgagaggaagtattacagaatgggtaaatatgcaagcccttaatcaagtctgggtttcaattctagctccgtcactgtatttgcagatgatcttggacaagttacttaaactttctaagcatagatttcattatttgtaaaatatagtcttagagtagctagccaagacctttagatttccaagtataaattaaaagactggtcaaatatgtctcccaaactacagttttcacatagcgagctttc

SEQ ID NO: 595545 - DNA, 278 bp, Homo sapiens
  misc_feature (12)..(13): n is a, c, g, or t
  misc_feature (24)..(25): n is a, c, g, or t
  misc_feature (30)..(30): n is a, c, g, or t
  misc_feature (61)..(61): n is a, c, g, or t
  misc_feature (68)..(68): n is a, c, g, or t
  misc_feature (99)..(99): n is a, c, g, or t
  misc_feature (138)..(138): n is a, c, g, or t
  misc_feature (173)..(173): n is a, c, g, or t
  misc_feature (176)..(176): n is a, c, g, or t
  misc_feature (178)..(178): n is a, c, g, or t
  misc_feature (227)..(227): n is a, c, g, or t
  misc_feature (246)..(246): n is a, c, g, or t
  misc_feature (249)..(249): n is a, c, g, or t
  misc_feature (261)..(261): n is a, c, g, or t
  misc_feature (265)..(265): n is a, c, g, or t
  misc_feature (267)..(267): n is a, c, g, or t
aaggagcatctnnactccgagaannatgtngttctgtaactgccccagatagtgaccccgngagtggntctcggtgctagatatgcatgactaaggttnatgctgggcaaaatgtagatgatctttcattatgttgtnggcagcgtctttctctgcctttgctatatgcagtncancngtaagtccttttgctaaaatgagttttgtttgacttctgagatccaagngctgattgttgttaaaaantanaaaaaaataatntctngnatgggggtcct

SEQ ID NO: 595546 - DNA, 895 bp, Homo sapiens
  misc_feature (1)..(1): n is a, c, g, or t
nggaatgaaagagaacgaagctgcttcagggaaggtatcataatgtactgtggtgtcgacagcctagctctttgtggcccccagcctgttctgctctgcccaccacattggtttgggggcaccagattgcgctcctctgatggggtttttcttgcccccagaaggaggcaagtcggtcgaaatttctaacaagcacggcggtgtctagatttcccggcagggtatcactgctgttctgccatgcaaaaaaaacatgtgggtccgggacagcatacgtttttcatacgtttcgccggaaggattctagaagaaaaagcgttgggtcgcggcgttcttacataaaagggggcttgcgaaagatactgtttatgcgggtgcgcgacaaaaaggatgtcttgtctgtcgagagaagggaggaattatctttccagaaagagtgtgctgcgcccgcaacatcattgtgtcggggtcggtgccccgccccccccgccctgtctctcctttgatatgtttagtcgccgaggaaccccgccacacctttgtttgacccacagggctctccgtccttccttgtcaagacccctccccccctgttgcaggtaacaaagtacttttataacatatgagaggagcagagtttagacccagcacagtctctaagggcgagggcagaacttagctgttaagcaatagtaaatttctggctagatgggtttgattaataagaaagatacactgtggatatgggcagccttgcaaaaccgaaactcgcttggagggggaaagaggtaacataccataatggatgccaaacaccatggctcattgtgaacaaaaacagtagacatcccccttattcttggagaaaaaaaagaggaccccgaccacaaaaaca

SEQ ID NO: 595547 - DNA, 1061 bp, Homo sapiens
ggttctggagtctcgggacccgacagccggcacagggtcgccccgactccttcgcccgccatgccctgggccctcgcgtcctccgtctgtcgctcttgtgcggtcgcgccggcgacccgcgttgcgggacacggcctcaagctgaacgcacccgcggtgaatgcgatacctggtagggcggccatggctggttggcatcgatgatcgtgcagtcaacctttccgccaacctgagttactgtgcaagactgcagactgcaggacgtggtactgagtcgcttcgtcgacccagccagcaggctaccgagtggcagtcggtggacgtgcagatgtcggctaggactggattcgcaagcctagtggctgtccgtggagccgtgtagccagcgtgcgcttagagctaccctgacgtctacagtgttccagtcctccaagggacggccagtcagggtttcggagatgttcgatgttcctcatgcagaccacagtgcgggatgcccatgggcactggcctggacagcactgcgtgtggcttgcttgtgcggccttgggtcgcttggctgttgccctgaggccgtaggttggtcgtgtgccccatgtgagaccatcacaggtgaagttcattccactgacccagactctcctccaaatcctccaagttacacgaggatttctttccacgggtgttagggcagattgtgcggggaatcaaggggctgacactggggacgataccatgggacttcacaagaccacttgtctcgtgaagacagggcttcaaacgaggccatacggattattccggacaatgacgctccttgcgcaaatggtaaccgaggggcaaaaacccaacaagccatgaaccttttgatcaacatgtagatcattaggaacctatttgcactgacccatccagggttattggaaaggatcctatggacatttgattagaacccgattcaaaggcttggagtctccacaaatcacgaaccgtgtgtcaatgtactgtagaaccaagaatggagagaacaggaatcaaaggccagttaccccgagcagaca

SEQ ID NO: 595548 - DNA, 395 bp, Homo sapiens
  misc_feature (145)..(145): n is a, c, g, or t
  misc_feature (162)..(162): n is a, c, g, or t
  misc_feature (166)..(166): n is a, c, g, or t
  misc_feature (170)..(170): n is a, c, g, or t
  misc_feature (173)..(173): n is a, c, g, or t
  misc_feature (192)..(192): n is a, c, g, or t
  misc_feature (194)..(194): n is a, c, g, or t
  misc_feature (198)..(198): n is a, c, g, or t
  misc_feature (209)..(209): n is a, c, g, or t
  misc_feature (215)..(215): n is a, c, g, or t
  misc_feature (230)..(230): n is a, c, g, or t
  misc_feature (242)..(243): n is a, c, g, or t
  misc_feature (247)..(247): n is a, c, g, or t
  misc_feature (252)..(252): n is a, c, g, or t
  misc_feature (258)..(258): n is a, c, g, or t
  misc_feature (265)..(266): n is a, c, g, or t
  misc_feature (268)..(268): n is a, c, g, or t
  misc_feature (270)..(270): n is a, c, g, or t
  misc_feature (272)..(272): n is a, c, g, or t
  misc_feature (283)..(283): n is a, c, g, or t
  misc_feature (287)..(288): n is a, c, g, or t
  misc_feature (290)..(291): n is a, c, g, or t
  misc_feature (293)..(293): n is a, c, g, or t
  misc_feature (295)..(295): n is a, c, g, or t
  misc_feature (300)..(302): n is a, c, g, or t
  misc_feature (304)..(304): n is a, c, g, or t
  misc_feature (307)..(307): n is a, c, g, or t
  misc_feature (309)..(309): n is a, c, g, or t
  misc_feature (315)..(316): n is a, c, g, or t
  misc_feature (332)..(332): n is a, c, g, or t
  misc_feature (336)..(336): n is a, c, g, or t
  misc_feature (347)..(347): n is a, c, g, or t
  misc_feature (353)..(353): n is a, c, g, or t
ggccccttcccagcatgtcagggaaaatccctgtcccccaattccaatggattttgtgctcttttttaaaaaaaaaaattttttaggggaaacatgaattttttttcaatgtagcccctggggaatgaatgaaattttgagcttnttcaatacgtaaaattnaatntatnccnctgagggagagaccctttntnaaanaagtatggccnaaagcnctttaatgctgctgncattgttgtttnnatgntcatntgctgnagcgcannangngntgacccagtgngttnntnntnangtatnnnangtnanggattnncctgagttactcctgnatcnttgctcataanattggnaactaaaataaaacctagttggaaatccaagagaaaaaaaaa

SEQ ID NO: 595549 - DNA, 345 bp, Homo sapiens
ctctgctatatctgtgctgtacagacacaaaactgttctgtacataccctttttatttggctacttccactcaacatcgtttatgagatccatctgggctgctgcattagcagtagctaattcttttctatcactgtacgatatttctatcgacagaacatacagcaattcattttttctttctatcgttgacggacatcgagctatttccaattcaggctatggcaaaaatcacagctatgaacacggacttgtcttctgcactcgcctctctggtgcatgtctgcatgcctctccggcaggcgtgccatgtccagggctgtgggctggcagaacggctaccga

SEQ ID NO: 595550 - DNA, 163 bp, Homo sapiens
tcacaccagtgatgccctggtcatgaactacggtgctctctcttctgcttcgggaaggactttgacaaggtcgattcgttcctgggcctggtgcagtgccgctctgtggtggtcagttgtggattctatgtgccctagtatcatccggtgacccgtcccatcg

SEQ ID NO: 595551 - DNA, 92 bp, Homo sapiens
ccaccaagccaaaggattctttttctattttcattctcctcgaacttcgtattggactatgtccccctctgtgcccttccccctcaaaccta

SEQ ID NO: 595552 - DNA, 110 bp, Homo sapiens
ttgtcatcgcagattgctcgggggaataggttatgtgattaggagatagggttaggatgagtgggacgaagaaagagaggaagtaaagttaacttatgcctttgtgggtt

SEQ ID NO: 595553 - DNA, 425 bp, Homo sapiens
  misc_feature (23)..(23): n is a, c, g, or t
  misc_feature (31)..(31): n is a, c, g, or t
  misc_feature (54)..(54): n is a, c, g, or t
  misc_feature (218)..(218): n is a, c, g, or t
  misc_feature (387)..(387): n is a, c, g, or t
ctttcccttagtcctcactgagnctagttcngggtgaaagtacccttcccagtnaaacccttaccccagtccctgttcttgaccctcatgctctgggtttattgctgttgttgttgtcgttacataatatattgcctactattaaaaatccttaagatggctgggcgcggtggctcatgactgtaatcccagcactttgggaggccaaggtgggtggntctcctgagatcacgagcttgagaccagcctggccaacatgatgaaaccccatctctactacaaaaatgagctgggcatggtggcacacatctgtagtctcagctacttgggaggttgaggcaggagaatcgcttgaacctgggaggcagaggttgcagtgagctgagnatttgccactgcactccagcctgggtgacagagtgaga

SEQ ID NO: 595554 - DNA, 140 bp, Homo sapiens
cggaccccattgacctttatcccctttagtcatagcgattttgccaacgactttggtttggtcattcttatcataaagaacaacagaaacactgtctgcacttggtgaccaaactgtcaaatcaacacgcgctccattat

SEQ ID NO: 595555 - DNA, 102 bp, Homo sapiens
ctccagtcctagtgctaccatggttctcagacaccatcagtagggttacagaggcaccaaggggtatcagtgccctccagagttttagttagaggaaggtga

SEQ ID NO: 595556 - DNA, 437 bp, Homo sapiens
  misc_feature (67)..(67): n is a, c, g, or t
ctggggttgtcctcaggctccatgagcagaagagcagcagagcagtgtggcagaggagagaggaganagagtgtctgaacatcgagaggagttcggctggggactgtcagagagatcagccatgggatggccaaaccccaggggaagattatcttctcactccatccgctttccagctccccatccatcctgctgaaagcctcctccatcattcaataaaatctctgtattcaccatccttcaagtctgtaggacctgattcttcctggatgctagacaaagacccgggtaccaagaggacagggtgtaaaaggctgccaccctgactctccactgagctggtttaacacttagccatccgcggacagcaactgctaaaagagcattaattgtaacacacccctagatgctgccatggggctagagcccaaaagcgc

SEQ ID NO: 595557 - DNA, 264 bp, Homo sapiens
cgcctcccatgttcaagagattctcctgcctcagcctcccaagcagctgggattacaggcgtgtgccaccatgcctggttaattttggttatttttagtagaggtgggatttcaccatgttggccaggctggtttcgagcttctggcctcaagcaatccacctgccttggcctcccaaagtgctgggattacatgcgtgagccacgcgcctggcccagcctttctctttctgacttcacttgcccacctgtgcagtgggaggac

SEQ ID NO: 595558 - DNA, 351 bp, Homo sapiens
  misc_feature (69)..(69): n is a, c, g, or t
  misc_feature (75)..(75): n is a, c, g, or t
  misc_feature (114)..(114): n is a, c, g, or t
  misc_feature (132)..(132): n is a, c, g, or t
gagcgaaagcctgggtcgcacttgggcccaccggaaagtggaagtcgtctgggtccagcggctctgagntgatcngccaggcaagcgaaattggcattctcgctacactgcccngtttggggaatctgaatngagtactatgctatgtggctaaactggtgtcctcactacgtggcaataatattgaactgggcacgctgcggaaatactacagagtgtgcacactggctatcttgatccggtgactctgacatcttagagctgccgaacgactggtgaaaagtaaaccacctacaaatttcactgcaaacttaaactgcaaattttcctttaataaaatttgcttgtttt

SEQ ID NO: 595559 - DNA, 107 bp, Homo sapiens
atccatattgaaggtggtatcatcggtccgcggctggaaatatcgtcttcaatgaaggaaagaaatcgacagaccaggcgtgcatgccagactacacagctgctcag

SEQ ID NO: 595560 - DNA, 447 bp, Homo sapiens
gttggagagaattaaagccagaggatggcgctgagttcagcgtccccattaacggtacggagtttgacgcatgaagccagaaacaccctcactatcacttcctgacgataacgttggcagccgcgcggtgaagcgcagcaagcccggttatcagctacgccgcagccgtatcgcctggctgctggtggcgccatctcttctgttactggccgccgttgcaggctggccgctgttccgcacactgttttacagcttcaccgatgccatgctggattcgcccgatgattaccgttttgtcggcttcaccaactacattgacctggccgacggtgcccattattacggcgtcctggccgatccgctgtggtggaaggccgttggtaacacgctgcgtttcagcgtgatgtcggtgtcgcttgaactggtgttcggcatgctgcttgccct

SEQ ID NO: 595561 - DNA, 119 bp, Homo sapiens
  misc_feature (72)..(72): n is a, c, g, or t
accagatccggcgttgtacagacgacgtgcggccccaggactgctaccacggcgcaggggagcagtaccgcngcacgtcagcaagacccgcaagtccagtgccagcgctggttcctgag

SEQ ID NO: 595562 - DNA, 396 bp, Homo sapiens
tttttttttaattttttgagtacagagtctcactctgttgccaagctgaagtgcagtggtatcatctcggctcactgtaacctccgcctccagggttcaagcaaattctcctgcctcggtctcctgagtagctgggactacaggtgtgtgccgccacacccagctaatttttgtatttttggtagacacggggtttcaccatgctggccaggatggtctccatctcttgacctcgtgatccgcccgccttggcctcccaaagtgctgggattacaggcctgagccactgcaccctggtcaatctttccaaggcctagttcaaacatagccttgtctatgaattaatttctgtatctcatcactcaaaattaatcctttcctgctttatatacccac

SEQ ID NO: 595563 - DNA, 157 bp, Homo sapiens
tatgtctgcagggttcgatgacgggctactcctcatttattcacctcagcagttttgttcttcgcaggcttttactgcgccttttaccactccagcctagcccctaccccccacattaggatgggcactgagcccctcaacatggcagatcctgcta

SEQ ID NO: 595564 - DNA, 511 bp, Homo sapiens
ggcgataaggctaggtacgaggctgggtgggaatcggcgatgacacaccaggcggttggagacagcgcttacgaaaggcgtgaaaagggagcaagaaaagtggttgtggagtgctaagaaagattggtatgatgtgaaagcacctggctatgttcaatataagaaatattggaagacgctcgtcaacaggaccaagaacaaaattgatctgatggtctcaagggcggtcgtgtgtttgaagtgagtctggggatttgcagaatgatgaagtgcgtttaagaaaattcaagctgattactgaagatggtcaggtaaaaactgctgactaaaactttccatggcgtggatcttacccgtgacaaaatgtggtccatggtcgacaaatggcggacaatgattgaagctcacgctttggagttggggtcagactaccgatggttactggcttcgtctgttctgtgttggtttactaaaaaacgcaacaatccaagcatttacccggggagactct

SEQ ID NO: 595565 - DNA, 766 bp, Homo sapiens
ccaacattctggtggtttccttgctacacccgtcgtggcgccattgcccagagtgtggctcgccctctcacacttctcggtgggaggtggtccccttgtgccccgccccttcatgttgcccccggcaaagaattctgtctcttggtgccacccacaggcagtgtgtgctagctctgtggtgcctcgcccagaatatcactccccgatgcgttgtgttcggtgatgatcaacatgtgttgtccgaaatggcgctcgtacacaatggtgtccgccccctgtcttcttctatgggggcactcacctcgctcccctctcgagttgttccctcccctacgagcggtctgccccctttacgagagcgttttgataatctcccccccgtgtgtgacccgcccctatctcgtgtattataagagcaactcacacatctcacccaaaaaacatcttcgctcgccaatctgcaatcctacgagcagtacaaccaccccttcgccccccttcgctcacatgttctttcccgcggtgtatctcccattgattctgtgtattatccgtagcccccgcccgtgagcgcggtggtcacactcgtccggccctgtagaatcctgttggagcaccggacgtccctcatgaggggcagcctcacgcttcgtctcgcagcgcagccaccgtcccgacgccgcaagtctgtatgtctagtgaggcgacggactgcggtccgcactcaactccactactagcatcaccttatacgaagccacaatcg

SEQ ID NO: 595566 - DNA, 849 bp, Homo sapiens
gcgtccagaggatccatggaagaatgtgcaaggatcccttcaactttaagtgattgcattatagacagaatgtgttttgtctttccattgttgcgtatctgtgtgatctttcattactcttatcttacagttagttatattctttactatgggagcaaaataatctgctgaaatgaattgtgcctctggttaatcaatctttatttcctttgtgtagtaattgcctcaaactcctgacctcaagtgatccatccgcctcagcctcccaaagcattgggattacaggcgtgagccaccgcagtgggccgaatattattatgtgtgttggaatctgctgcggactacaagtatgttgcgtgactccactaaagcatttcgagaagtgaatttgtaacgctctaggtaggattggcgctagtattctatttcgctccgagcactgagtgtcatggcgttgaggtctcgtggtcctataagccaaattaatagtagagccgttctgccccactgctggaggatcactgggaattacaaggtcactgagccagcacagcgggccgaaggatcattgaccgaataggggcgcgggccgtggggaagaccaatgtttagtgtcctgtgaaggcgcagggcaaatgtaaggagaaggtgggaagttaacacgggggtagatagggttgtcgccgagtttccatacaactgagatagtggtggttccgtatatggcgtagtgtttatttaaagcaagcatgagatgagtgatcgtattccacaatggggaaaaaaaataagaaaaaagattcttccagaggggtggctggaagatcgggtccatagggggagagaaga

SEQ ID NO: 595567 - DNA, 110 bp, Homo sapiens
agcgacccgcgctcactgggattccggtacttcttttcttttttattttccacttcccaggggacagggtttcacttcgcaaccaggactggggagagacggaaaaatcc

SEQ ID NO: 595568 - DNA, 378 bp, Homo sapiens
tgagaaagcacacccgcacacccctgaccacgtgatggttcagatgaccacactttagtcgagcaatcgcggccttttaggttccgcaaacgcaccaaagccgaagatccacacccgatcgcttaccgacctgacgctcatgaacacaacgccatggcatgaacgctcgccgacgagcacctgggccgctcgcgtcgtaagtgccaatggaaaatacctgctgaccctggataagccgtttctcgaggacctgatcagccaaaccgatgtgggcggcaaatacctcaaactactggatgacaaactcagccccactgccacctccgacgaagccagggtgctgcccgacgcgtggaaaaaccatctgaaggcaaggat

SEQ ID NO: 595569 - DNA, 758 bp, Homo sapiens
  misc_feature (506)..(506): n is a, c, g, or t
agctactcgggagaataaggcagaagaatcgcttaagcctgagaggcagaggttgcagtgagctgaaactgtgccactgcacaccagcctgggtgacagagtgagactctgtctaaaaaaaaaaaaaaaaaaaaaaaaatttgattttgactaatgactaatgaaatgggttgtgtggaagaccttgggtgaccaaaataaaatgcattaacttgtgcaagtcaaatgccttgccacccaatcttcattcttgtggaatttttgaaattgggccagaatagccagtctcaaaaaattctccatccccgaaaaacacacacgcaaaaaacaaaacctttacaagtagtgtcccttatgtagcccctttggtcctctgcaggggaaattgcattccattaccttaccattaggatttctgcagagtatttcattggtacttttgtccctagcagtcctccggtctcctcttgcgacagaccaggggttctcacctccgggtctctcangaacctgggacgtcccccattacgcccctcatatgggctccatttgcaggccttcaaccttccccgggggtttagggtgatccctcccggtctcaagtctcccttaatagctggggcactacaggcgacacaccaccaatgcctggctaatttttggtagttttgtacgagcatgtgcgttcacccatgttgcccaggctggtctccaacttctgcgctcagcaatctgcctgcctcaggtttcccacttgc

SEQ ID NO: 595570 - DNA, 155 bp, Homo sapiens
ttaaatgaaaagtcatatcatatatgagatagacagtttttatagggtctataaatttaagatttcagaagagtatatggtgtattccctctgtaatagatccatatctgttgtcactcctatagtccttttgttgttgtttggtaggcatgggt

SEQ ID NO: 595571 - DNA, 237 bp, Homo sapiens
  misc_feature (14)..(14): n is a, c, g, or t
  misc_feature (16)..(16): n is a, c, g, or t
ctgggactttaagngnaaagacagcattaaaaataaattatgctgtcaatatacaaaaaatgatcttttcattataagcatatataaagcctcctgcaactattacatatcactttatcgaatccaaacttttttgcttgcccccttttgagggccctagcgtgtgacatcctcattgaggacataagcctttagagatccatcaattcatcccttttatttaacagataaaggagg

SEQ ID NO: 595572 - DNA, 200 bp, Homo sapiens
  misc_feature (101)..(101): n is a, c, g, or t
  misc_feature (104)..(104): n is a, c, g, or t
  misc_feature (169)..(169): n is a, c, g, or t
  misc_feature (193)..(193): n is a, c, g, or t
gcacgagattgactgtaatattagactagcagaaagggagactttgagtcatcaaatcccctaataaaataggttctttaggctgggtgccatggctcacnccngtaaacccagtgctttgggaggctgaagcaaaaggacactcaaggccagcagtttgagatcaacntgggcaacatagtgagaccctgtntctccca

SEQ ID NO: 595573 - DNA, 145 bp, Homo sapiens
tgtacggcaggagatcaacacactgcatactgtccggcaagtctgtagaggtcggcagctgccagagtgacaggaactccagcagtgggacggcatgctgctgtggctgagattgcgtagcttcaccaccagaacaggcagcgcc

SEQ ID NO: 595574 - DNA, 2952 bp, Homo sapiens
  misc_feature (919)..(920): n is a, c, g, or t
  misc_feature (1096)..(1097): n is a, c, g, or t
  misc_feature (1100)..(1100): n is a, c, g, or t
  misc_feature (1102)..(1102): n is a, c, g, or t
  misc_feature (1108)..(1110): n is a, c, g, or t
  misc_feature (1731)..(1731): n is a, c, g, or t
gccggggacggggcaggggcggggcgcgagcgggagaccagagagccggagccggatcccgatcccgagtccgagccgccgccgccatgagctgccccgtgcccgcctgctgcgcgctgctgctagtcctggggctctgccgggcgcgtccccggaacgcactgctgctcctcgcggatgacggaggctttgagagtggcgcgtacaacaacagcgccatcgccaccccgcacctggacgccttggcccgccgcagcctcctctttcgcaatgccttcacctcggtcagcagctgctctcccagccgcgccagcctcctcactggcctgccccagcatcagaatgggatgtacgggctgcaccaggacgtgcaccacttcaactccttcgacaaggtgcggagcctgccgctgctgctcagccaagctggtgtgcgcacaggcatcatcgggaagaagcacgtggggccggagaccgtgtacccgtttgactttgcgtacacggaggagaatggctccgtcctccaggtggggcggaacatcactagaattaagctgctcgtccggaaattcctgcagactcaggatgaccggcctttcttcctctacgtcgccttccacgacccccaccgctgtgggcactcccagccccagtacggaaccttctgtgagaagtttggcaacggagagagcggcatgggtcgtatcccagactggaccccccaggcctacgaacccactggacgtgctggtgccttacttcgtccccaacaccccggcagcccgagccgacctggccgctcagtacaccaccgtcggccgcatggaccaaggagttggactggtgctccaggagctgcgtgacgccggtgtcctgaacgacacactggtgatcttcacgtccgacaacgggatccccnnccccagcggcaggaccaacctgtactggccgggcactgctgaacccttactggtgtcatccccggagcacccaaaacgctggggccaagtcagcgaggcctacgtgagcctcctaggtatgcctttgtctgtctccgtcaggaaaggtgtgggagtggatctgggacgggcccatnnccngncagtcnnntccacacccattacctaatgtggctctcatatcatctgggtgaggaagggactgtcactcccactctacagaggaaaagaatgaggctcagagaggtgaagtaagctgctcaggattgcacagctggtaagcactaagctaggattctcgcctggatcctgctgctttcaaaaccattgccttttccccgcctacctccgatgagcttcagaatcacctgggatgcttgttaatatccaaattgcaaatcccagggtgtccgattcagtagatcttggcgggctcaagaatttgcatgtctgacaagttcccaggtgatgccgatactgtgggcctggggacccctctctgagcatccgtgcaccccatcctgccttcctgggggacccaaagcacctcatgaccctgctcattcctaaaaagacctaggacatctagtcccatgttatggatgtgcagacaaagacacgggtgcaggaagactttgtgaggggctcggggtgaccccttcggcacagggcagaggctcgtgtgtcctgcccactgcctggcagagcctccaggtggggtgggcccgggacagcaggaaactcaggttccctttccctccgagctcgcggnccacatctctcttggggcccacatctctctctggccccaaatgatgagccaggagcactgtggccacacccaccacaggggctggagtacacgagctaccaaaaaggagacttcttttccagtccatgggattttagaaggatcctaaatgtcaccgaatcagggcctcttgttataccattcaaggcactgaggcccagagagatgacgtggcggtgagaggtgtcggctcgacaaggcacctcccgctgctgattggattggagaagggagccgcccagagtggcgtaggttcggcccttccgagggcagctcctgtgtgctgagggctctgctgctctgagatgccgcgtcccttccagacctcacgcccaccatcttggattggttctcgatcccgtaccccagctacgccatctttggctcgaagaccatccacctcactggccggtccctcctgccggcgctggaggccgagcccctctggccaccgtctttggcagccagagccaccacgaggtcaccatgtcctaccccatgcgctccgtgcagcaccggcacttccgcctcgtgcacaacctcaacttcaagatgccctttcccatcgaccaggacttctacgtctcacccaccttccaggacctcctgaaccgcaccacagctggtcagcccacgggctggtacaaggacctccgtcattactactaccgggcgcgctgggagctctacgaccggagccgggacccccacgagacccagaacctggccaccgacccgcgctttgctcagcttctggagatgcttcgggaccagctggccaagtggcagtgggagacccacgacccctgggtgtgcgcccccgacggcgtcctggaggagaagctctctccccagtgccagcccctccacaatgagctgtgaccatcccaggaggcctgtgcacacatcccaggcatgtcccagacacatcccacacgtgtccgtgtggccggccagcctggggagtagtggcaacagcccttccgtccacactcccatccaaggagggttcttccttcctgtggggtcactcttgccattgcctggagggggaccagagcatgtgaccagagcatgtgcccagcccctccaccaccaggggcactgccgtcatggcaggggacacagttgtccttgtgtctgaaccatgtcccagcacgggaattctagacatacgtggtc

SEQ ID NO: 595575 - DNA, 218 bp, Homo sapiens
tgggagagggggtctcagcacatcacgggagaagccaggcaaggaaacagatccctcagcaccttcttggaaatacaaagattggaagaaggtcagagcagatggtttggtggtggttcttctgtgggctaccaaggaagtcacaagtgatgacagaccgtacaagatgtacagttgggacaaagaggtacagtttgtacaacagaaaggtaaacgat

SEQ ID NO: 595576 - DNA, 1895 bp, Homo sapiens
  misc_feature (919)..(920): n is a, c, g, or t
gccggggacggggcaggggcggggcgcgagcgggagaccagagagccggagccggatcccgatcccgagtccgagccgccgccgccatgagctgccccgtgcccgcctgctgcgcgctgctgctagtcctggggctctgccgggcgcgtccccggaacgcactgctgctcctcgcggatgacggaggctttgagagtggcgcgtacaacaacagcgccatcgccaccccgcacctggacgccttggcccgccgcagcctcctctttcgcaatgccttcacctcggtcagcagctgctctcccagccgcgccagcctcctcactggcctgccccagcatcagaatgggatgtacgggctgcaccaggacgtgcaccacttcaactccttcgacaaggtgcggagcctgccgctgctgctcagccaagctggtgtgcgcacaggcatcatcgggaagaagcacgtggggccggagaccgtgtacccgtttgactttgcgtacacggaggagaatggctccgtcctccaggtggggcggaacatcactagaattaagctgctcgtccggaaattcctgcagactcaggatgaccggcctttcttcctctacgtcgccttccacgacccccaccgctgtgggcactcccagccccagtacggaaccttctgtgagaagtttggcaacggagagagcggcatgggtcgtatcccagactggaccccccaggcctacgaacccactggacgtgctggtgccttacttcgtccccaacaccccggcagcccgagccgacctggccgctcagtacaccaccgtcggccgcatggaccaaggagttggactggtgctccaggagctgcgtgacgccggtgtcctgaacgacacactggtgatcttcacgtccgacaacgggatccccnnccccagcggcaggaccaacctgtactggccgggcactgctgaacccttactggtgtcatccccggagcacccaaaacgctggggccaagtcagcgaggcctacgtgagcctcctagacctcacgcccaccatcttggattggttctcgatcccgtaccccagctacgccatctttggctcgaagaccatccacctcactggccggtccctcctgccggcgctggaggccgagcccctctggccaccgtctttggcagccagagccaccacgaggtcaccatgtcctaccccatgcgctccgtgcagcaccggcacttccgcctcgtgcacaacctcaacttcaagatgccctttcccatcgaccaggacttctacgtctcacccaccttccaggacctcctgaaccgcaccacagctggtcagcccacgggctggtacaaggacctccgtcattactactaccgggcgcgctgggagctctacgaccggagccgggacccccacgagacccagaacctggccaccgacccgcgctttgctcagcttctggagatgcttcgggaccagctggccaagtggcagtgggagacccacgacccctgggtgtgcgcccccgacggcgtcctggaggagaagctctctccccagtgccagcccctccacaatgagctgtgaccatcccaggaggcctgtgcacacatcccaggcatgtcccagacacatcccacacgtgtccgtgtggccggccagcctggggagtagtggcaacagcccttccgtccacactcccatccaaggagggttcttccttcctgtggggtcactcttgccattgcctggagggggaccagagcatgtgaccagagcatgtgcccagcccctccaccaccaggggcactgccgtcatggcaggggacacagttgtccttgtgtctgaaccatgtcccagcacgggaattctagacatacgtggtc

SEQ ID NO: 595577 - DNA, 111 bp, Homo sapiens
aagtacagtaactttgcatatgtgggctaattggggcttaattgtgaaaatgaacaatggaagaccataaggcaataaggccaaatcagagcaagaagaggagccaagatc

SEQ ID NO: 595578 - DNA, 935 bp, Homo sapiens
tcaccttcgtgaagccggccttcgaggagttctgccgtggtgacaaagaagtatgccgatgtgatcatcccacgaggcagtggacaatatggttgccatcagacgcgtgatcgttgcagcacatccaggacattctgaattggtgacatctgcatagatgtgcaccgcaggagggtccaatgtggcggatgttacaatgcggaccgttttctgagccggggaatcaccgtgggatgcatgacctctggcaaacggtcacatttggagtccagcagcggaccccactgaggggctgtcgagcctcgagggcaaggtcgtcccggctcgcggcaatgtgtgttcagggactgagcctggggacgcccaactcagacccactgcttcctctcggggcaacgccaggggagtgttagcagcgaggccttcctcactcaggagtggaaactcagatgtgtcactcagactcaacttgctgggacactgacaggcgttcctgaggttttcagccacttaggctcgttgcggtttaaagatccctctaggtcactgagaaatgccacagaatgtgcaggaagcctgggaggcttctgtgaggaatgtgaggcacattatcgggcgcaaattgaggagacagcctagacactggctggcctgatgtttgttgacagtgaacccacagtgggcagagagtttttccagtctgatctggttcttacacactcacacacattactcaaacagtttgtgaacaagtatcttcactttttacctgttacatggtctcaggttttcgggttctggttcataaccaaggcgtggtgtgggcctacaagctaattatgaccagtggttgcgtcacggtggctaacgatattgggacctgtggtgtttcccctgtttgccaaggcgaccaggcatctgtaaccgcataccag

SEQ ID NO: 595579 - DNA, 465 bp, Homo sapiens
gtgcgaccgaaagggtggaattatcggaggtgagatgttgaaagacgcgtccaagtaagcaagtgactgggaaaatcacagagcttaactatgtcacaggtatctccagagatgatgccgtgcacataagcgtcggtgtagcacaggcacatcaccacaggagtccttctcgcgtcaggatggcaggcattacacccactcacgctggaacccagcagacagtgtgggcacagtgaattcctgcccgtccattgaactgaaaacaccaccacacttggagtgtctgaaagcctctctcatctgcacggaggggaaaggggagatttctttgaagtgactgcaggttgctcatcagaaaccacagaagccagaagatggggaaacagtgtcgatttttaaagtgccaggagacaagaaccactctcccagaaccccacatccagcgttgcggccgcggggtaccga

SEQ ID NO: 595580 - DNA, 650 bp, Homo sapiens
acttatggccgggggcggcagtgccagaaagccgaatatggcggtccccggggcgctgatcctacgggagagccccagcatgaagaaagcaggggcactggtaaatgcaatagattccggaagatttccacggttggttaattggattcttcaaaaacttcacctgaaggctgagagcaggttcagggaagaagaggaagaaaaactttaagcgggattttctctagaggaaccagatctttacctaggtcttggaacaatatcatttattttagaacaggcaggggatcacaatgggaagccaggaactttgcagcagcaattagaggacattcatcttagaccaggcaaagctgaagcatttggcaatacttgggcttctatgggtcaaggaacaggtgaaaaggtccggcagagaattctggcttccttgaagctagagactggtggatggcagcttaacccttaaatggcttaatttggttaagcaaaactcctggagaaagttcttggggaaatcaatcaccaggaagttgtttgaattctataacaggctagagccttttccagcccaaggtgaattccctaccatgaggtttcgaagaccgcctttttcaataggcttctgccacctcattatttggcatgga

SEQ ID NO: 595581 - DNA, 266 bp, Homo sapiens
gatgtttaccgtgtgttaaaaaacttcctgggtccttccctgaacaagcctagtccaacatttttttccagtgagtcccatcctgggatccagtgtataaatccaaaatcatgttttgtgcataatttttccaaaggattttattttgtgaactatatcagtagtggacctttccatataatgtaaaaagattttcatacaaacaatgcaacccactatccaagtgttataccaactaaaaccccccataaaccttggacagtgga

SEQ ID NO: 595582 - DNA, 1080 bp, Homo sapiens
gcaaccccgctctgaggaaaagagtcgacaacaccaccccactcttttgaagaaaggccgcgccactcttctgtctgcgtgtgtgtcgacaagagatatatagaggggcggcgccgcgggaaaaaagtcgtgtctcttttttgtgttttttgtgctgtgttttctctgaagagcgtctcccgaccactaagagagacgtcttctgtggtggcgtcctgaagactctttggtgaagaaaagaggggtcggagcccctccctgctgtggcgtataaattagtgtgtgtggggggctctcgctgcacagcggggagacacacgctgttccgggagtttcctccccctgtgggggggcctctctcaacacacagtgccccacagtgtgttctcacccacagcggtgtgctcacccgctgttgtgtctcttctgtcgcaacaccacccctcgcgcacgctggtgtgtgtctcttgtgtttgtggtgccacacgctctcaccaggggcgagaccccctggtgtggttgtctttctttattagtgccgccccgctggcggccctcttcttctctccctcttctttctctctgtgcgccacacggcacagtgtttttgtggcgtctcacacagggggggctctctcaacaacgccgcccgcgcggtgggcgcgcccgctctatatagagagcgtataccccccctggggtggtgttcttgcacagagagttctatttgtcgaccgccccctatatgtgcgccgctctctctagagaccacacaggcgcgcgacagatgagcgcaccctatatctacagggcgcacgctgttgcgctctctctcttctccacatgagaggtgtgggagagaaggcacacacacagggcacagcccccaacagagaggagagtgtctctgtgcccgcgtgtctcctccccggggcgccacatgagatggccacataaaatttgtcccttgttgggtgtttggaattacacgggaccgtgtttggcttaaaagagacttgggtctaacccagaaagttttgtttttttaagaaaattggtgaatacctggttttcctgtga

SEQ ID NO: 595583 - DNA, 296 bp, Homo sapiens
cggtgtgagtgtctagagcatcccctcctgcagatgaccaataacactggtgcagagctcagtcccgcagggcagcagccctgccaggagtgtcaggatcaggagatgaacgggtcatgatggaattaaaccacctgaaggacaaagttcaaggttgttagaagacattgtgcctgactgaacatcacagggaaagcctcatggagatggcaaggtgccttgccaagacagggacagacctgcgcggatacgcgtacgagcctgcagcctgtttgaacatcttctcaagcgagcac

SEQ ID NO: 595584 - DNA, 789 bp, Homo sapiens
actctcaatgtaaattgtttttgaaataagatcttaagaatacaaaatgtagacagattaatattcagggtgctgtacttttgagccaatatgtagcagagaaaaactaagtttctctgtggcagtatttttatgtgttgggctatttgcccaggaaattatctgaagactaagaattcatatgtgaagtgtaatgatactaatcaaagagtgagtaaaatttccattggctaccatatatgtgtgtatatatttatgtatgtatgtgtgtgttacatatttgagacagggtctcgctctattgcccaggctggagtgcagtggcatgatctcagcttactgcagcctcggtctcccaggctcaagcgatcctcccgcctcggctcccgagtacctgggactacagacaccaccacacctggctaatttttttattttttatagagacacagtctttccatgttgcctatgttggtcttgaactcctgggctcaaataattttcccaccttggctccctgtagtgctgggattacgggcataagcccatgtgtcaggccccatgtattgttaatagtgaatgttggttttcattggtttacttttcagtttattaaaggatactattacagacacaggaatttacatttcaaagtcattttgacaaatcagtgctggcttttatttttctcctttagcacatttgtatggtacttcagagaaatttttaatacctttaaatatggtcatgaccataatggaatatactatttgtttttgaaaataatga

SEQ ID NO: 595585 - DNA, 525 bp, Homo sapiens
  misc_feature (14)..(14): n is a, c, g, or t
cactgaaataaacnccaattcaccattatgaagtcaaatcttataaacaagcttggaaacccaatcccaaaatccctcagatccacaccttatacactcagtgactccatgtcttatgagcccatggtgacccatgccccagggttggggtcagaagaatccaggggaagtgcaatagcaaggggactcttcccacagccttttttgagggttcttcagtcctggctaactctgcattccatttatgatgcctatgaggaatacaagaggagcttcaaataagcactgggtatatgagcctggagctcaccgaagtcagagggggatggacatgtgggagtttttagcatgtgggtaaccatagcaaagccttgcaaattaataagggcccctttaaataaaaaaaatttccattataattttggccagccttcccaaaatagactttctgcattattatgacaatattttaattttgaaattttcataagatttactctgttgcaaattagctgttaaaactta

SEQ ID NO: 595586 - DNA, 427 bp, Homo sapiens
tgatgcatgcacacacagacacacttgatacacgatgacaccttgctctgtatggaaacatctaaacatctcgtagatgactatgcaggctgtatggctaccagtatcctgtctgaggtgtatatgttaaattcgagatcagtttgtatgtaagggactcttgtcctatgtaacagttaaggtgggccgggtgcagtggctcacgcctgtacatcccaaaggtgttctttttatcttcgggatattaaccctttatcagatacgttatttggaaatattgtgtctcattctgtaagtaaacttttctctctgttgcattgtgtctttggatgcacaaaaattcttaagtttgatatagtcccattgatcttatatagctttggtatcctttccttttggcgtcatatccaagacattctagccaaat

SEQ ID NO: 595587 - DNA, 267 bp, Homo sapiens
acaaggcaagtatgggtaaagaaactctggctttggttagtaaccacattccagaatattagaactggggcaggctatggaacctccaggtgaaggaaaaggtcaaatcagagagaaatgccatgatgtgcatttttgaagtgcaaatgtttgagtatcaggaaagacagtcactaactttcagcaagctggttcatcatgctgactttataaatacatttatataatcatttataacacaagaataaaagtatggatcctgtccca

SEQ ID NO: 595588 - DNA, 589 bp, Homo sapiens
  misc_feature (104)..(104): n is a, c, g, or t
  misc_feature (247)..(248): n is a, c, g, or t
  misc_feature (253)..(253): n is a, c, g, or t
  misc_feature (260)..(260): n is a, c, g, or t
  misc_feature (265)..(265): n is a, c, g, or t
  misc_feature (274)..(274): n is a, c, g, or t
  misc_feature (283)..(283): n is a, c, g, or t
  misc_feature (285)..(285): n is a, c, g, or t
  misc_feature (290)..(290): n is a, c, g, or t
  misc_feature (297)..(298): n is a, c, g, or t
  misc_feature (300)..(300): n is a, c, g, or t
  misc_feature (317)..(317): n is a, c, g, or t
  misc_feature (371)..(371): n is a, c, g, or t
tacagtgtccaatgatctcacttatgcacacaacgtggcggcacagcgcaactacatagctcttgccagcactactgtggagaccacggaccctgaaaaggagntggagccggctctggagctgttggagcccattgaccagaagtttgtggctatcagtgacttgtatgagcccattgatgatggttgtgagagccaggtgttctgttcctgctcctacgatgccaccacacactttgagacaacnngcaangacatcnaaganatctacaancgcatggcngncacgnccttganntngagaacatgaagcgcanacagaacgacgtctttggagaagctgagcagtgattgtggccgcccccagcccntgctgccccagcctgtgtctgttctcctcgagggctccagcatcctctgcttcccccaccacgttcccattaaccaacttattggtccactggacacaatctcttatacctatgacgcgtaggggctgtgagcagagtgggggggtgggatagtcctcctctttcgtttggcccttccttatcctaggaaaagagggttcctctccttgtgtgtgtct

SEQ ID NO: 595589 - DNA, 209 bp, Homo sapiens
caccatgtgctggctggacactttgtcacttttgaagcatgttactaaatgtcactgattaaaaaaaaaaaaaaaaaaaaaaaaaaaaaaaaaaaaaaaaaaaaaaaaccccacttttttttttttgcgcccctggggtcacaccggggggcacacaggggggggcccggggggcggggagaggggggcggggcgaggggagcggccca

SEQ ID NO: 595590 - DNA, 198 bp, Homo sapiens
caccctattgtctacgagtgaatagagggataggcttagagcgcgaactattatgctttgttgatggaatctatggaagatggggactattgctactatgatgatggatagcaatatggcacggacgcctcctattttcttagcgactgatatgataatagtgtatgctaataggaaatatcattcgaaggtgccata

SEQ ID NO: 595591 - DNA, 764 bp, Homo sapiens
tccgatcgagcggagtctttgaagagactgtgaaagaccctcaacaggatttcacgcagaggctgagaagattgggggcagctcctacctcgagggctgcctggcctgcgccacggcctacttcatcttcctctgctatggagacccactagttagaaggtggcccctcccgccccaccgtgcatccctatccctcagggactgccctgatggacttgtctcatccttgatctgtgctcctctgttttgcaggttctcaagcaagattggcccgctacatccaggagcagaatgtagaagatctttgacacctcgaggtcctcctacttacatgaccctgtggagcgtggggagtgacggttgattgacatctccatctacgaggaccggtgacagcagatggcagtctccagtcgatgcggccagtcgatgcatgcgagcacgttggacatcaatgcacgcgggtggcgtggctggtgagggtcgaggggccctggtgacttggccgagagtccctggtatggaggtgtatggccggagtgatgggcccttgtcatcaccttgccgtgccgcgcttgcgcctaccagaagactcccgtgttctgagatcatttcatttggagctcacacctgcatgtcccggtggtggggaggagaggagatgaccgtgtgcctcactactttcctggtcggggccatcgacacttatgcccacctgatctcctcatcccccctgtcatggattcatggccatgtaccctgga

SEQ ID NO: 595592 - DNA, 171 bp, Homo sapiens
tcaagctcggtacccgtcttgggactgacccgagatcgacagatcgctgcgtagcgtgttctcgccgtagaactggtggaatgcacggccgaccggcgacttggtgaacgccacgccgccggcatggcccggcgtatgccaggaatagttcgactcggccgcatggtgggt

SEQ ID NO: 595593 - DNA, 87 bp, Homo sapiens
catggatttgctggtgcagtacaactaggcttaatagggacatgcaatgcaaactaaaatagtaataattttcccatcagaatggta

SEQ ID NO: 595594 - DNA, 245 bp, Homo sapiens
ccgtcgtctagaggatcccgtactgtggtgtaccgtctgctaaacggaaactgaaacaccattccccctgccccctctccccccgtgtattcctgccatcacaaaaacactactgcaaagagagaacataggaacttctttctcaatatctcaactcttttgcaagctagagtgagatgaatttttgtaacaaggcaatgcatgacacgtagttaaaacagcacgttctctgtacgctggaactg

SEQ ID NO: 595595 - DNA, 112 bp, Homo sapiens
tcgccagaatcactataagggagtcgtctggatcgagaggcgcagtgtccagagggcgaaggtgggtccactctccctctgccactcccttgtagaaggagccgatctggag

SEQ ID NO: 595596 - DNA, 430 bp, Homo sapiens
  misc_feature (52)..(52): n is a, c, g, or t
  misc_feature (64)..(64): n is a, c, g, or t
ggggtggtggctgccatcaacccccaaaatgtggttacgtttaataaggagntggggccattcnaagtgtttgtccgtgtgggccagcaagtgaatgtggtgggccaggttggcaacccaaaaattttcccggggttccaaaggaaaacaaccccagggttgttggccccgggggaaggggaaaaattggcccctgaggggttttttccggtaccccccatttgggggggttttgtttcccttgggaagaaccccaataaagattttttaggggccccccgggggttttgaacggcagttgatgttatcagcaggccaggattcctgctgccaaggggggaccggggggaaaattttggggggaattgtgccccccggtttttttgttacggagggaaaaaaggttgttcaaaaaaaatttttttcccca

SEQ ID NO: 595597 - DNA, 267 bp, Homo sapiens
ctcaaactcctgagctcaagcagtccacccgcctcagcctcccaaagtgctgggattacaggtgtgagcctccgtgcttggccagcccctttttcttttacttactatgattttgagattcaacaatgttgttgcatcagtagttcattcccttttattgctgaataatgtttattatatggatatgccacatttgtttatctatttacctgctgatggacattttggtctgtataaataaagctgctgtgaatattcttgttcagg

SEQ ID NO: 595598 - DNA, 1157 bp, Homo sapiens
aactgcatggctggtcctggcctggagttttttggattctctctctctctctctctctctctcagcacacacacacacacacacatgccctgtctcgcgcctgatgtctcgccctgctgtgccgtggtgtgctgctggggtcatgctgcgtgcctgctgtgtccagtgacatgggtctgtgttcctgcctgcgcatgcgcccatgtgcccatgctctgtccatgatgtcttgctgtgacatgctgcactgtccatgtgcacttatccccacacatgtgatggatgcctgtgtgccacctctcacaagctctctgcccttgcagacgcttggcctatgtgtcatgtggatgtgcatgtgcatgcatgtgagcatgtgctattcttggtgcctactgtaatgccctgcagcttggccctgcgttgcatgcttactgtcttgccttgcatgcccagactgtcctcctgtgtcctcctgatgcccccgatctccactggaggggacgcagcatttccagcccagccctccccatcttcacctcgcactcccctgacacacttgtggagcctcccttgattcctggtgacaccctgctgcttgtgcggggatgttatgcctaacttgcacctgcttgtggtgacccccctttgtcccatgtgcttgttactgcagttgttggcacaatgtgcattcctggtggatgcatgtgctgattgcccccaaaatgctgttgggaagaccccatgcccactggctactactcccccgagatggacctgtgttgcaacggcccaaggatacgacgggattgttgtcggggcacaccggttgttgctccttgctttgctcaaggtggtcgcgtctcatccccagtgcttggtgaagcgtggtccccccaaaggcttcttggcttgggcctatcccgtcttcccacctacctaccaagttgggtgggggtggttggggtggggctggcccaaacctgcactgcatttttggctccttccttgcaactttacgactggtacgttggataaatttggtgcccagatgtgtccccttacttgcacgcccccaaaacacatccccttatggccttgagccccttgggggccccccaagcagcccatggattttcagcccccagggacctccccag

SEQ ID NO: 595599 - DNA, 223 bp, Homo sapiens
gcgacagggcgcgggaggaggggaggagagtgagaggaaggaggggaagggtcagggcgcatccgatgtatttttaaccttttctgtattatagagactgcaaggaaaatagaataaacaacgtctatacttggggggtgggggctaaagtccacatatgcacatgcacattgagtgtgtcctatgatgtggaactcagacctactgaggagtatctgtggct

SEQ ID NO: 595600 - DNA, 147 bp, Homo sapiens
gttgggctgtcgtgcgaggcttcgggatctgatgtctgccggcgaccagtgtcaggctgactctgctttctgggtgccgtccccagtgtccctgatcaggcctggctagtcagagccctgggatgataaggtaagcaggagccaccg

SEQ ID NO: 595601 - DNA, 876 bp, Homo sapiens
  misc_feature (561)..(561): n is a, c, g, or t
gatacggggagttcctccttgctctcgccctactctttctggtgtagatcgagctaccctctaaaagcagtttagagtggtaaaaaaaaaaaaaaacacaccaaacatctcgcagccacaaaggggatgaaatttctttctggggcatcctcttggttctcccggtaactggatcggtctggctccctaagagtccttcgggaagctttttatccctaagaggagaccatcagtcaccggggaaatcggtgctggatcacaggagctggggcttgtaatgtgggagactggactggcctatgaatttggctaaaatataaaagcaagggctggtcctcggggatataaattaagcttggacttggagggaaacaggttgccaaattgcattgggactgggtgccagggtcaactaccttggttggtagactggcaggcacccgagaagatattttaccgctctgaaaagaaaggtgaggcagaaaattgggagatgtaagtatatcaagtaaaataaatgctgggggtaagacaataacatccagaatgtgtgggttacanaaagatcttcagatggacaaagacttctgggcacgttgaattctctcggcctcttgtctgggactacaaagggggactttgcttccttgcaattggacggaaggaataacccttggcatatgggtcactgggcgttccggcacgctgggaattgtggtcggtgccccttttttactcgggtactggccaccaagtcgggtgcgggggttcacaacaccttggacagttagctggtcgcttacaatactcgggccaacacctggtcttgtgcctaatcgaacacggtatcacaaaccagtaatttggccctcggcg

SEQ ID NO: 595602 - DNA, 113 bp, Homo sapiens
tgacttctgctctagtatagagaacgtctctggaatgtgatcctgggtcaatgagtgctctagtagttgttgggtaagttacagaaactgtggtttggttttctttatctgga

SEQ ID NO: 595603 - DNA, 1102 bp, Homo sapiens
agatggcgacctctctgggttccaacacctacaacaggcagaactgggcaggatgcggcacttccccgtttctgtgccagacatgtcttggagaaaacccatcatcatccgcaatgcaccaacagaacaagtcatgggaaggcacatgcaacactctgtgccaggcccattcacagtgctcttcgcatgggtgccctggcagctccgcgcatgcgttctcgacgcaagcactgcacagtgtgcccaacaccatggcagataaattgcaagacatgtcgtgtcagcaccatgcctctttcagaccctagacgtatggccatgacccgatccaggattccgtgacgcaggcacttgtcttaataaacgatgaacatgccaacagtcagcatgtcacacacaagcagtactactacaccagcaatatggcagcagagagatctactaacctctgatgcgcacccacggaccagttatggcatgctaggcgagaccacgccacatctcacacagctgcacatgctcgctcaacactggcccggaacgcacaccctacatacaacacgggaactcgaccaccacaatttggctcccttctgggtcgcaaaggagagttgataagagaaggaagaggcaacggcacaaacagaccacgagcaagcactacacgataccacactgaacccctctgacagaatcaagaaatactaacacagaccggaccacaacgagcacatcaccgaaaccagactaacctgaccaagcctacaaacagccggccttcacccaaagcaatcggctgcacccaaccagagagagatagacacatacacaacagaagactgaaagtacagcctaccatgaatacacccaccgtcaacacagtctacacacacatctctacctagaaccatcactcaatcacactataacacaaaacacaacaacaataatagcctaaacccatatctaacacaaaataaaacaccatcaacatctacttcttcatattataactacaatacaacaacaaaaaacaatacaacatcactaaaaatccaaccaaaaaacatcacaccacccaaccacaccaaaaaacaaataa

SEQ ID NO: 595604 - DNA, 1077 bp, Homo sapiens
  misc_feature (587)..(587): n is a, c, g, or t
  misc_feature (724)..(724): n is a, c, g, or t
gctttctttcggcagccttacggggcccgaagcccgtcgtgtgaacgggtgcagtatctaagccgtgagcggggtatcaggcgggccggcgagcccctcttcatgacctccgagtgccgccgggcctctagagatcagacatggccccaggaacttgaaaggacttggcaggagacgagcatgccacgacgggcctcgcggggacatggtgcagcggtcgctgaagcatgttgctgggggctcggcgaccgtggcctacggtgtgcgcgaatctcgtgattcaccgttggcatagggcggcgcgacagacggcgcatcttgcgttcaaatcggatcggtggcatgtgcagcaggtacacgtatcctggaccgtagggctcttcaagtatcaaggatctcgcttggattccagctacctcgcattagtctagtgagcgattactgggccaggactctcgagaagagatctcgctccactctacagtgcatcgcgaaaggaaccatagcgagatcggtgaatagtctgcccttgcagagtgttggtcttcgatcctaatgctcagggagctttcactagctagtgtcanctgagcagccttcaggggcctgggacttacgaagagcaaacgcagctggttcgctcggtcaccatctgttcatagacgagagagctggcgtcaaaggagttgtgagtcggccctaaagcttccaatagcctcgacanaggcttcggatcaagcccagagcggggtcccacaagggttattccacgttgatctcggaagtaccccggccctgagtgaatccttggaactacggaagaaatgtggggccctagaggagagccattttccagagccaccgttgctaggtccgccttggggcaattgtgaacttggttggtgcgccatattcctagcgagagggatgtgtcattgggcacgtcattttaacgggccccggtagacgaagtttaccgagctaagggcttgtggctctggtttgatggaataggagcccaccaagcagaaaggttgggtcaccccacacgccattgtggacagggaccccccaagg

SEQ ID NO: 595605 - DNA, 696 bp, Homo sapiens
agcgggggggcgcgcggctcaaggctcctggaaaagaccgtccaccgcctccgtgctggcggtgtggacggcggaactcaggggagaaaagcgattcgagtgtgtggataatcactatctactggtagatgattccgacattgagaagatagggaaatagactggcacatgatgcagaccgtggattccatggttgaggttggaatactgccggtaagtgtcgccagaatagtgggtcaacgatggatgatgtgtcatcatgcagcttattgaggcacgtagcactactggagaactatgtgcaaacatctaggggtgacctggtcccagacaggtggacagtcggaggggtggaaagagcactgtctcgaggtgccaggtgacggcggggtcttccatggcaggtaccgagatacacgtccatagaggagctccggtggcctagtcgctggacatacggcatgcctgtgcgctgagacctcatgtctccagcttacttgtggcaggaacgcgcagcacagtcttaatttcgtgtccttcgcctgtaagaatcaacactcgacgtagccaagaatgtggggtgggtgggccgtggaggccgtcgacggtgcgcttggctggtgtggttaacaattccgcgctagaaccgattgttggtggaactgctaccgttgggtttcgagtcacggaacccga

SEQ ID NO: 595606 - DNA, 205 bp, Homo sapiens
ccccccgggtccccccggggggggtaaggggttttttcccccccccggccctggggtgaaggccggaaaataaggggggccagcccccctcccccttttctttttgcccccgggttggggggggggggatgggggtttttttttttttttccttttgttttgaaatttaaggatgccaaaaaaaaaaaatcccggttttttccca

SEQ ID NO: 595607 - DNA, 228 bp, Homo sapiens
actgtaggtagtaatgcccaatcccacttgccggatttcataaaacgccgcattcatttttgatagtactgatcccgtgcaataaaccttcgccacgtagatgccgtggaatcgaatgatctagttccatactccttgagccagtagcgctggcagcgtagtgcccttgaatagacgccttgcaacaacagacggtacctgatactatgtcagaatatactagtacgc

SEQ ID NO: 595608 - DNA, 140 bp, Homo sapiens
ctgcttggaacatcacctcttcctctacccccaactcttgtcccattcttcctcatccctggtgtatccatgaagaatcacatcgaaaaatacccattcgtgatgaccttttgccttctttgcattttatgcaattgaaa

SEQ ID NO: 595609 - DNA, 342 bp, Homo sapiens
gttatagtcaatattaatatgctaagaagagaataaaatcattgttacaaactcaaagaatgaacaaatggaaagagagtcaaaaatgggccaggcacagtggctcatgcctgtaatctaacattgtgggaggctgaggcaggcggatggcttgagcgcaggagtttaagaccagcctggccaccatggcaaaaccctgtctctactaaaaatacaaaaatttgccaagcgtagtggcacacacctgtaatcccacacccgcttctcgggtggctaaggcaggggaatcctttgaacctgggaggtggagacagaggctgcagtgagccgagaacatgccac

SEQ ID NO: 595610 - DNA, 156 bp, Homo sapiens
agacgacactgcgttagatgctatcgtcaatggaaactgtgagatacttcattagtctcataacgagaaatataattaaccttttatttatttatttattttgagacagagtctccctcagtcacccaggctggagtgcagtggcgcaatctcggt

SEQ ID NO: 595611 - DNA, 759 bp, Homo sapiens
gcgaccgttgactatgctctacaaacgagaaagacatggaagcactatacctatctattcggcgcatgagactggagtccgtaggcacagctctgagcctccttattcgaggccgagctgggccagaccagggagaccttctaggtaacgaccacgtctacaacgtaatcgtgaccagcccaatggctttggtgaatagatctgtctgtcatagtaagtacccatctatgaagtcggtaggcttgggcaacttgacatagttccgcctaataatcgggtgcccccgatatggcgtttccccgcataaacggacagtaaagcttctgactacttaccgtccggctctctcctactcctgctcgcatctgcgtatagtggaggccggaagcaggaacaggttgaacagttctaccgctcccttagcgaggggaactactcgccaggcctggagcctccgtagacctaatccagtcttctccgttacacctagcaggtgtctcctctatctgtaggggtcatcaatgtcgatcacacagagattatcaaggatagaaagcccgcagtaacccgtgcccgtcgagcgcaaagttcctatgacctaatgaccaataacttatagactaaaccgcagagagaagcaagaggcagaagaaggaatggctgaccactaaccatccagggggacatctgaatgcgggggcgggggagaaaaacaggaactggaaggccgggagcggtgagactaagattcccgggcac

SEQ ID NO: 595612 - DNA, 527 bp, Homo sapiens
ctccagagtttgggagtagggatgactcaccccacaaggtgtcattaccagctgtccagagcgcagcacacaacttgaactctgtcacctttctcagagtaagcactagcaacacatgtgatcggacaggacatggaggctcacatacttgtaagacacctggggcgcaaaaagtccatctgagttcgattctggctcaggcctgaggcgtagcgatgtggtccacagtgctggctccagtgatgggcaggcccaggactttcacaacatctgtgatctattggcaggctctgacaggcggagcatcatgatgtccttgctggttttcctggaatctggtctaaggctttgatgcttcagaaggctcatattgtagagcgggtgtgggaagctgtggctgacagggaccctctggcctgtgtcttcaggctcaaacaggttgtgccgacccagccagacctggctattcctggggaggaagggggtggatgcatgaggagagagaaaatggggaaagggatggatcg

SEQ ID NO: 595613 - DNA, 372 bp, Homo sapiens
gttccgcatactcctacagatcatcagatccggacatgtcaggtctctcagcacatggactagcattcacaaacgcacaatgtagctacactacagccccccatgcccaggcacagtttgttgctagctgtaacaaagacacactcagtattgtgtacctgcagccaacaccacctcctgtgctttcaacaggttcactcacccaagaggccagcacaaccacgaccgagtgtgtactcagtggcccagacaccccccgaacactggcactgccacaaggccctgaaggagtagactgtggggcaaagaggacaaactctccctcccctaagggacccggctcactgggcctccttcggaggttattggcat

SEQ ID NO: 595614 - DNA, 148 bp, Homo sapiens
gtctaaggggcgaacgtagggtgtgaagtatagtacggatgctatatgtccaatgatgttaaaagggtagcttagtggttgtcctccgattcaggttagaatgaagaggtctgcggctgggagtcaataaagtgattggcttatcgag

SEQ ID NO: 595615 - DNA, 191 bp, Homo sapiens
  misc_feature (9)..(9): n is a, c, g, or t
  misc_feature (138)..(138): n is a, c, g, or t
  misc_feature (141)..(141): n is a, c, g, or t
gggctgcanggaatttggcacgtggaacgaatggcggggtagtctgaagtcgttgctgtccagttggggaaggcgaacttgagcccgtgcttctggccgaagcggaacaggatgttgagcagcgtgctgctggccgtnttntgcgtcttcatgaacacgatgtcccgccgcggctggcagcctcccgccga

SEQ ID NO: 595616 - DNA, 299 bp, Homo sapiens
gtcgacgtggctgatgcctgtaatacctcccgctggagaggccgaggcgtgggagatcgcctgagttcgagagtttgagaccagcctggtcagcacggtgaaaaccgtctctattaaagatacaaagatgagccggatgtggtggcacgcgcctgtaaccccagctactggggaggctggggcatgagaattgcttgaacctgggaggcagaggttgcagtaagccaagatcatgttactgcactccagcctgggcagcagaatgagacggtctcgcaaaaaaaaaagaaaagtcgacg

SEQ ID NO: 595617 - DNA, 534 bp, Homo sapiens
gggagggaagctttgcctcctaatccgagtggctaatctcaggaagagccttcttattggcagtcacatttatggacagcttctgaagaccacagtcactcctgaaggagagacattattgttggaacagatcaatatcaacgttgtagttgacgctgggaatgagaatttgattcttcatctccgccgattgacaatttaccatgtcattgagtcacaacaggcctttcgttccacatggcaacgcggagagccttctccaggaggactgtgaattagtggtgttgtaatgcatggcacagtggagtccaccagtgctacctgccgaagtccggacatcctatgtcccagagtgaggtgcgtttggggctaccgattagctcccatagtatccaagacaaaggaagggaaatagcagagtggatttccataactttagcaagagagtggaagtggagaccggtcaatgtgccatgtgactttataatgagaaagatgtcagagacgaggatgaagagaggatatgagaaacaa

SEQ ID NO: 595618 - DNA, 255 bp, Homo sapiens
ctccttggcagagctagaataggttggaattaatttccagattattttcctgggagattttattttaacgatgtgaatgttacaaccatttacagttacctgtaatgggcttgatgatctgcatccccaacagtatgttcctttagttagtgttagttcatttgagattcacagatatatgcccatgtagcaacagtctgctgctgtctttcacaaacaaaaaaaaggtttcaattttttaaaaattgggcttta

SEQ ID NO: 595619 - DNA, 766 bp, Homo sapiens
gctgctctggtagtggacctcatcaatcactagcgccacgagtctctggcccagttacaatgccaagctggacacacggctcctctacgcgctgtgtccaaatagcagtaggagcagattgtctaggaggacagcgtggaggcaagtgggcgcaccagtcttcatggtctatcaccagcagtaccatgacaagagccgcgagtatgaccatgctttatgaagagtacacacggaccgtcccaggagctgcagatgaagcgtactggaattgaggccttcaatgagactatcacgatctttgaagagcagggccagactcacgagaaatgcacgcaacggaatacctggagcgcttccgggcgctgcagggcacacgacgaacgacgatgcaaacggatcctgctgaactccgagcggctcaagtcccgcaccttgccgagatccatgagaagccgcacgaagctggagccagcagctgcggggcccaggacctcggcaccacagagagatcgacaagccgcatgaacacagccctcaagccggacactcatgcagctagcgcaaggatccggaggaccagtaccatcgtgtggctcaccccagacaacggcgcccggccacgcaacgaacaatccaacgacgctggcttggggactcccaccacgtggcagactgagagacgcaaggaacgcacgctcatggaagagacgacggaccgaatctccacgccaccaacgaaggcaaacgccactaggggcaccgctgg

SEQ ID NO: 595620 - DNA, 322 bp, Homo sapiens
ttaaattcgctggcaggtggagtctctccaatctcatcgaatttagttgagacgagggcgtttgctatgatactcggacgtggcatgattaatgggacaatcttatcaaatatggcttccacagacacaccacatggcccgccgtggacttccgtacaactcactggaagaaatacacatatttgtcctttgcaagcatcctcagaaggccagtcattgtcgtttctagacgacatgctgcgaagtttggagtcaggttccactttcgcccctttgagagtgggtggaatttacttggccgtctccactggtcctgcccagg

SEQ ID NO: 595621 - DNA, 534 bp, Homo sapiens
  misc_feature (41)..(41): n is a, c, g, or t
  misc_feature (67)..(67): n is a, c, g, or t
  misc_feature (528)..(528): n is a, c, g, or t
ccggcctaccccggattaactcccctatccaaccgggaagncctaccccggcctttcccgttaatcnctgtagcccattcccctcctgtgaacacattcctccatataggggaaatgggtatgcacccctctactccccccaaaagaaagaaaacccacaaaaacacaggcagtgagaaaacccagctaggctagatcagtgtaatgatagcccagaataagatgtattgtaaagtaaaagtctgattgaagcataatacaatcagttgatttgatttaagcttttctagtgtcacattctagtcatagtattttgcaggttgtaaatggcgttaaagcaactcagatatacatatgaaataaaaatctgaaataggggttctgtatggcccataatataaaaatataggccatctggagaatgcaagagggaaagcatggtaacttctttggagggttttgcctgatgttaacttacatcccttgaacattctcagctagactgacattctgtgaatatatcattantagaca

SEQ ID NO: 595622 - DNA, 577 bp, Homo sapiens
ctgcttgaagaactgttgtaaatggagtttagatagcagaactctatgatagcatgtatgaagttcaccatttatgaggcctagctacagcaagagggaaatggggcaccatgacctagcgtctcctgtcatgccaaaataagtacagtcccactgacacccaggcacgattgagaacagaatacaggaggcccaacctaggctagttgttcacatagaagttaggaagtgtccgcactaggttattggaatcataggctttctagctttggtttcatctctcctttgcctcccaaagtgttgggattacaggcatgagccacagcgtccggcccatattgatgcttttgacactttattgtatatagctacattttctactgtgtgtattaaattagtttggaatcgaaagagcaagaaagttgttttttttcccccactctttgaatataaaaaaataaaaatcagcacgagttagctgctttttccatagtatggacctgggaggcggaggttgcagcgagccgagatcaagccactgcacgccatcctcagtgacagagtgagactccatctc

SEQ ID NO: 595623 - DNA, 402 bp, Homo sapiens
ctggcccccacacccagttcgagcagtgggtcatggaggagcgtgtggactgcctggagcagggtggccgaggcagcgtcctagcaggtcatgcccttcaccagcgcgtctgaactggtgaaggtgtcagccatgttcagccccaaggtggatctggccatcacggacctcatgctgcccctgggccgacaggaggctgctagagccattgatgcactctgaggggcttgtcatggccgcactgggggctggggactggcgcaaacgcaggcgcctgcaagggcatggatgaaggatgatgcatcgagccttacattcactgcacatggtgcgagcctatagcggctttcagagacgcgttcgagactcctgacctacaggatgtctcccggtttcttcttc

SEQ ID NO: 595624 - DNA, 215 bp, Homo sapiens
cccacagactactttttgctaaatggtatcaagattttctcgttgttgtcagcacgagagatgcgtctctaacatctcatcgaccatgtctggaggtcaaatcgatgattgtaaacttgctgaaataaactgctcctttcttgcatggctcgatgagcagtaggggtcctctgcgtgattttgcgtacgattgttaggattgctgcataaagccg

SEQ ID NO: 595625 - DNA, 358 bp, Homo sapiens
atgttacgacagcaacgtaaacactcacaatgtgttatcacctgaaaaagagaagcagatgtcagagccactagatcaaaaaataattaggtcagatcataatgagcatgatgagaaggcctgtgtgctacaagtagtctgcaatggactccaagaatcgaacaatgccatctaatataccatataatgtagaatttctccatcttgggaaagtctggataccagattacctgaggaagagactatatatagacttgcatgccgtagtccggataactccagtggaagttacccctaaaattccaagatctctaaggtgacaacctagagatgaatttaccgtaagacataaccgcgg

SEQ ID NO: 595626 - DNA, 182 bp, Homo sapiens
tatcagacatatttgggatggctaaggtgagtcttcatccatgatgctgaaatgcagaagtcagcacttcagattatcatcaattgtagtgtagtaggcccagataaccgaatatccagtattggtaaatattatactctggtactcctacggagacaagctagcctacaggaaccctaaaa

SEQ ID NO: 595627 - DNA, 124 bp, Homo sapiens
tttaatcgttgacaacgaacctttaatagcggcctgcaccatcggcgatgtcctgcatccaacatcgaggtcgtaaaccctattgttgatattgactctacaaataggattgcgctgtttatcc

SEQ ID NO: 595628 - DNA, 361 bp, Homo sapiens
ggcaccagcctgaggaaatcgacggggacaggctcgccgacttgcccctcaggtgcgatgggccatacccataggcagatcgatcatgggatgggtggagatagagatgatatggaaatattcatggaaggagatgagagaaatcagaagaaaacttagggagctgcagttcaggaattgtctgcgtatccttactcggggagctcgcttatctccatgacccatcattatgaattttggcctatgtccttgactcctggcatttatcatgagatttaataactgtgattcccgctgttttcttttttccttgcattttcctaatatgccttttctgatccgtctgcaaggaacccacgcc

SEQ ID NO: 595629 - DNA, 1326 bp, Homo sapiens
  misc_feature (515)..(515): n is a, c, g, or t
cccagttatagttccggggggaatggtggccgaaggttgtgcagcggacgcgtggttcgcctccaccgcgcgccttggttgttcccataccgcctgttttcctcacccgcagccaaccggttcggtttgccagagggtttaaccttttccgtggggcccatccttaattccccccaccaggaagttcccaggaaaccgcgtggctgggccataaatcctgtagtccccttccgcttggcgccaccaaagttgggtgctgcctcaactttaagggccccccagtgtcccttcggttgggaactgtgttttccacggggtgtcccacaggacgcttcgaggagcgccatgtgcccgaggaattattggcccccgggtgcttaatcccggccccccagcttgcttctttaggacccccccccatttttagtgacttattgggaggaccccagcctttctttgccacacagagttccccccggagatccataaggtctcacacccccaggcggtggtgntgctgaacacacacatccagacaccacagcaccaataggggtccccacactgcctcatgcccaagctttgccgcaacaccgcttgccacagactatacattcccttggcctctgttcccagcgcacccggttgtccccgcacacagtgtatataaacatatatatgtctctcccacagaggaggagtttctcgcccaatactctctctcagccacacacagtctcttaaatgcgcaccaggcccacccaagagttcaccacagagcgcacaccagacacctgtcctggttctcagagggcaccaaagagttctcaggggcacacctttgggacactgcgttcacacatgtttgggcacatcttgccccgcgctctctctcacacagagcgccacaacgccacaatgtttgggtgtaaccgggcgctgtttccctctcttatattcacaagccacatgccacccttaactctcttgcggtgggtaaaaatctcacctggccatagtttgtttgggagagattgataaattccagagaaaattctttctcaaatagctcggagatcttcccagagagatccacctcccgttctttaagagttggatggaagacctggtagcggtgttactaccagccccaccctagctataagaggctgccccagaaacgccagttacaccagtgccccccggttttcccaacatgtttaaaaattgatccgggacccatgaaaagaaacattgtgcgttctcaccgaagaaaaatatttaaatatcggaaaacttaaatattatggaaaaaaaaccttgcca

SEQ ID NO: 595630 - DNA, 142 bp, Homo sapiens
  misc_feature (24)..(24): n is a, c, g, or t
  misc_feature (52)..(52): n is a, c, g, or t
gaacaccagagaggccggactctnaccatggtgtccctgggctgtggctttntgggccctgtggtaggaggctggtacaaggttttggttcggttcatccctggcaccaccaaagtggatgcactgaagaagatgttgttgg

SEQ ID NO: 595631 - DNA, 468 bp, Homo sapiens
ctgggtttcaccatgttggccaggatggtctctatctcctgaccttgtgatctgcctgcctcagcttcccaaagtgctgagatgacaggtgtgagccatcagacccagcatttttttttttaatttaaatttaaatttttttcatttttttggagaggttttttttggttttggttttggttggttggttggttggttgttggttggttggtcttttggaggacacgtctgtgggctcgtggtcaccccagagcgtgggaaggtgacaggtggccattggatcttcgtggcaacccttctttaccttctccaagaggtggctagggatttcacgagggttagtgagaagccccaacgcccacagagcgcccgagagctttaagtgtgtatatctcggtttctccgggtcttctctctcctacagttctctgtcaaacaggtcttttgcgcgcgcgcgcggggcttcta

SEQ ID NO: 595632 - DNA, 351 bp, Homo sapiens
  misc_feature (153)..(153): n is a, c, g, or t
ctgcttcagcctcccaagtagctgggattacaggcacccaccaccacacccatctagtttttgtatttttagtagagacagggtttctccatgttggccaggctggtctcgaactcctgacctcaagtgatcctcccacttcggcctctcaangtgttgagattataggaatgagttgccacgctcagtcatagacaggttactttctcatctctcttaacaagtttcttcctcttaaaaaaaacaaacaaaaaacttagggctaatgaatagtgaggaattagtgaggtcaagcgttaagctcctgatacaggtcaaagacttgttgaaaggtttaattaaggcaaaggt

SEQ ID NO: 595633 - DNA, 266 bp, Homo sapiens
  misc_feature (91)..(91): n is a, c, g, or t
  misc_feature (246)..(246): n is a, c, g, or t
atcgaacccgggcggatcggaaacagattggcgttgctgccgatcacgagattgcactcggtctggccgaacacttcatgcgcgtcgacgncaaaagtctcgcgcacccagccgagcaactcgccacccagcgactcgccgccggtgaaaatactgcgcagttggaccccgggatgcctgacattggcctggcgcatcagcttcagcgccgtcgggcaggaagacgttacggatgttcagagacgncatcagttccatcgtcgcct

SEQ ID NO: 595634 - DNA, 196 bp, Homo sapiens
  misc_feature (109)..(109): n is a, c, g, or t
tcagtctcttgattcttatgtttaagcaccaccacctggctttattatttcaatgtcccattgtccccatttcttcagctgagaccacctctatgtgaagttctggacntgcaggaagagagtgatgccaacatttcttatttgatgcaacgtgcttctactcaagcagcacacgacggtaacaccagcagtactg

SEQ ID NO: 595635 - DNA, 859 bp, Homo sapiens
  misc_feature (859)..(859): n is a, c, g, or t
catcacttcttccactgtgtgtgacactgtttcctttacctatttgcctcagatcccctagctttctcctctgtctatgcaatttctttcgacagtgcagcgttgcacgtccggttgctgaagatgattataaagccgctggtgataattgttaagcttttattgtgattgaccgtgtatgtttcttctttccttgttcacagcgagacccaataccttttccatgggtcaaaggtacatgaagtagcaatacgattgatacgaagatgtacagaagaaattacttttgagtttttatccagtatgttttttacctcttgtgtagaagacgtctgagacagtctacatgtcacagcgcaaaaccaatcaccagaaattgacttgcatggctcgcaaacagactaggaagtatttgtggggaggagtgacatgaagcatgagtctcatctgattatgtgtttgtgagctcgctatgaatattcccaatgccttcattgtgcaagttcatgttacagttgtgtcataaattacagcaataacagcagtcctgttcacatttttgttctttgaaccgtggcttgtccgcatttgttccaccagagtgatctcagctctggttggttgcatgcgggatgcagattgggtgctagtcagagcctcttcccgaagcacttattggtgtagctcactgtggttcattactctacactggaaacgtattccgactgggaaattatttagagctacaaagtgctctagagggcttcgaaagggtccgtgatctggttctgcctggttttttacctccccggtttttgccccccttgggccgcgcccttctcgcccaaggcggtccccn

SEQ ID NO: 595636 - DNA, 699 bp, Homo sapiens
  misc_feature (699)..(699): n is a, c, g, or t
tggactaaaaagccaaggtctttaattaaaggtcccgacgggtttccccatcggttattcccatgccagccagggtccaggaacagcctctcgggagtgtaccggggggtctgggcctgggggcccgggtagcacagcgcttaagggtatctgcctgcctccactctccagcggggccagaaggccaccagcactgatgcctgccccgacctcggcttctgcgtggggcccctgtgtgtgggccttgccctttccttttagctctccagcgtgcgtgccctgctggaactcccgcgcttcatctcccgacgtggcgcagctctccgacgctgtgctatcataagaatcctcccctcacagttgtgttcacctccgaggagaagacagcgcgtcctcctttatcggggggacaggcaccagggtgccgattgggtggcgagcgaggttgaacaagaatgtgcttcccagctgggggtcctcctcctgggcctcgaactggtgtccttgtcatcaattgagcaggtcccccaagaccaccgtctttgtccctgtgtcgggataattcgtctctacgaactgggtggccccaggtgctgctccacccaggggtactccggggtaccggggggttcttttaaaatcgggattaggcgctccacgtgcgggttggggcgggagccaacttttaccacacgggtn

SEQ ID NO: 595637 - DNA, 1140 bp, Homo sapiens
agcggaggggccggagggcgacgattgaacagcagaatcggctgtggctagaagtcagagccttgtagcctggccgtcagtccctactgcagtacgtggacacagacttgtgtggctgttcagatgtaccttttccacgtatttgtcctgtccagtcagagtgaggacgagggaagcagtctgagagaaccagcgacacactgccaaaagccagatgtacccgagactattccttcacaggatttcaatgaagagccgcacgcggttgagagacgcgtccactggaggcacaaacgtgccagtgatgggcaccacagtcgtgtactctggtagatgggcactagaatgggccaattgcaggaaatgacagcgccatgatcttggagtgacctctctgaagacccatggatgcgcctgatgctgagtgtactgactccaaagcgcgtgaatggcaccgtggcagtccggccttggtggagagatggccgcatggatgagtcgctctgttgcccgagtcgggaggcaaccaactacgcacacacgtaactatgcgtgactggacactcggtagaatggaagccaggaaggcgaaaggcatcgcagattggttcccgcggaaacttaattggaccacgccaccccttagaaacacggcgctagtcgcatggatagcccacctaagaaaaggtcggggcaccgggaataatggcaacgcgtgagcctaaggccccatccattcgaacgctccaacaccacttgagtgcacatggtattctacccaataagcacccatttcctcctgctacccatgggctatgtcccacattggtgtagacaccgcagaaggggccactctcgttgttccacatatgcgcttttcccaccccacattagtccccgagcctcctccgtgggacgtgtttggaacccagacatcttacctacggttaggaacaagttcaccgtccccggatcacatgcgggccacaaatatgggatctcgagtgaccaccggctacaagttactcgcacttgggcgtggcccacgtttcgtagcccgcaacgcgaaattggcgccgcgcggatcaagggaatggggcaacacacaggggttttcccgtcggtcctttacttgggggg

SEQ ID NO: 595638 - DNA, 193 bp, Homo sapiens
tcatagaagggcccgctgatattaccatgaaggtgacttaaacagcttaaagtttagtttaaccagttgtaggtgattcacataatttgaaggcgatcttttacacagataaatttaaacttgaaaagtaggaagcagaagaaacaaagacaagctaggacacaaaaagctacgggcaaaatgtacaaactta

SEQ ID NO: 595639 - DNA, 351 bp, Homo sapiens
aggcttggggctagccccctctgaagcaatggactgaattatcagttggccccttattagaccatggactgatgcacgctgggtattcagagacaccacgtccctaggctgctacataacagaggggggcctatacgcccatgacaagcatttttacctctataaactccaaggcctgtgatagaaggcgctgctgagaaggtctctggtatgccctggagacattttccccattgtcttggtgattaacattcttggcttccgttacttatgtaaatttctgcacgctgtcttaaatttctccccagaaaatgggtttctcttttctgttgccctactgtgggtcctgtg

SEQ ID NO: 595640 - DNA, 219 bp, Homo sapiens
cacgagggcgtccgggatgaccactgaccaaagccatggtaaacgggctacattgctgcggtggatcaaatttccagacctccagagaggctggaggggaagcacaagcgggatcatccagaagtcagaatttttttttattatcgcaaaagggggaggaattgatgggaaaatggttataaaacctgaaggactctcaaatgccacaacctgtattta

SEQ ID NO: 595641 - DNA, 304 bp, Homo sapiens
agcggcccctactactactaaattcgcggccgtacgactcccacgtccaggggctgcccgaccgctgtgatcacacgtccagtcgcgtcccaccgtaccgtctcgtcgcatccgcagcgatccaagtagacataccccacgtaccgtctagtgctcccacgtccagtcgtccccctgacctctgtgatcccacgtccagtggctccccctgacctctgtgctctatgtccagtggctccccctgacctctgtgatcctatgtgcagcggctgctggcctctcaaacttaatgtgttcattgcgg

SEQ ID NO: 595642 - DNA, 153 bp, Homo sapiens
ctctgactatcggtgctggatacagatggctctccgcgagattcgctcgataccagaagatccagcgagcgtgcgtagatcagaaagctgcctttacagcgtctggtgcgtgagatcgcgcaggacttgaagaccgacatgggaccaggcgta

SEQ ID NO: 595643 - DNA, 263 bp, Homo sapiens
atatttataatcccaacagtttgggaggccatggtgggcagatcgcttgagcccagaaatttgagagcaccctgggaaacatagcaatacctgtctgtacaaataaaataacaaaatttagcatgtggtggcacgtgttcatagtccgagctactcggaagatagaggcgggagaattgcttgcacccaggaggtcaaggttatagtgagctataatggcaccacctgcactccagcctgggcaacagagcaagaccttgtct

SEQ ID NO: 595644 - DNA, 190 bp, Homo sapiens
cagcggccagcataaactgccacatacggaaatccgcaggacgagaggagtcctggtacatggatgtcctaacaacttcaactcatcgatagcgagatagcctgaatgtccagaagttatcacttcagaaatcacctgataaaagttaggccagagagtactaatggccagttctgccctgttccatgta

SEQ ID NO: 595645 - DNA, 1165 bp, Homo sapiens
catctgacgcgtgtgctgttttccctcctccccgccctcagggtccacggccaccatggctgtattagcgggcagcagtgcctgcggcagacatatggcatttgcagcggacggcagcagcaccaggctctgccacgccggcaacccccagcggcttaagccatggcgcttctcactggcattcatgcagcagcgcttgctgtaacctgtacaaagacaccttcgacattaagcacaattcctcgacttccagcaaagcaccgcaacactgaccgaacactgacgcttcctgcagccagcgacggctgtatggctgccgggaccttgcatgtccccacttcgaccaagcacggagctacaggcgcgcgctgacagacaagccctaggctctcgtcacactgactacacctgcgcacggctgcgccaacaccaccctcaacaccctcactggcgtaactcacacacagacaacggcctacacgcgcaggagcatcccatccagacctgcgctacggccagcagcgactggcgtacggctcacgcccccatcccacaccaccaacgcaaccgaagcgcaaagccctcacatcccgcgcacaccactacggcacatcgctaccacaccaaccccacctggactcaagacacaggcacgacaccagaacataaggcgaaatagccacctggcacccgcggacaactacacactcgcaaccccccgggcacacaacccaacatgcgcccaagcaatgaacacctacccatctacccacaaggcaagcacaatggaacaacataggctagcacaccacacatcagggccgcccccccctaagtgaccacgaccagcaccaccacaacagacgacaggaccccacccccacacacagaactgcaacaccaaaatacgagaccactcagcacagtacaaagtataacccagacgcccacgaccccaggagaaggcaccccacagcacaccgcgcaggaccaacccactccaccccacccataacgacccagcggggccccccggaacacagaaccacaccagaaaccaccccaacgaacacacacacccgcgcccacgacacacgcccaccaccatacaaagcaatcaaacaccacaccaacaaccacgaacacaaacagaccacgaaacgac

SEQ ID NO: 595646 - DNA, 145 bp, Homo sapiens
  misc_feature (11)..(11): n is a, c, g, or t
  misc_feature (68)..(68): n is a, c, g, or t
aaaatctcaanttcgttggtgctggaggagtgcctcagggatctgctgtcacctctgctgggccccantccagcccgtgccctcacttgtccccgggtgccgcctgccttcccagcctctaccccctctagagccaaaaaaaaaa

SEQ ID NO: 595647 - DNA, 654 bp, Homo sapiens
agcggaggcgcgctggcggcggcggcgagcggtggcgctcggctcgggcgaccgcggcgggggagtggcgcgggcaccgatgtggcgccactgagaagtggaggccaagaatgagcgggaagctgttattcctttgcggcaggcctgtggaatgtgcgaccctggcagtgcatagagtgatgtgccaacgcctcaggctctgccaagtgcgagcagcagaggatgcctcaatcgtccatgacattggactgcccaaggctatggggagaagagtctctatttgaccaattgggtaacaaggaggtgcagggaggctctttagtaacctaaaggacaaattgaaagacaccctcaaagacacatcttcataagaagtgatacaatctgtgaccagctacacaaagggagatttagacttcacttaatgttaccctccagaattattgtgaatgtcctttccatcttggacaaatgttgacataggattcaggaatcaggttgatgacattcgaagcgttgttggattccagacatcttgaccacgtacacagtatacaagtctgtcacctaagtcttatcgaacatgccaagtatcacagcacggggtctcagaatgcagatggaccattaggcaggctcccagtatgcacgagc

SEQ ID NO: 595648 - DNA, 225 bp, Homo sapiens
aaaaaaaaaaaggaagaaaaaatccttaattctgggttttcccggtagcttccacagatccaaaagggtcaggttaatttccagtagccaaatattctggccatctgggactggaaatatctcctaaggtggaggtaataatagagggtagtaacctgaattctttcttcctttttctctcttccccttttcctcctttggcctcccttcctcttttcttcctct

SEQ ID NO: 595649 - DNA, 222 bp, Homo sapiens
tgctctagaggatacctcacgccatgtcacaaaaaacacaaaaattagccagtcgtggcggcatgcgcctccaattccagccactcaggaggccgaggcaggagaaccgcccgaacccgggaggcagaggttgcagtgagccgagatgcgccactgcactccagcccgggcaacagaccgagacaccgccccataatggtaaggaggctgagtacaaagctg

SEQ ID NO: 595650 - DNA, 140 bp, Homo sapiens
agaagacgacagaagggaagagagagacagtcagagaaagacagagacggagagagagaaacagaaagagagagagagacagagacagagagaaaaaaaagtcgtatcgatgtcgagcgatcatgatgatgatgtcgacc

SEQ ID NO: 595651 - DNA, 1498 bp, Homo sapiens
  misc_feature (283)..(283): n is a, c, g, or t
  misc_feature (533)..(533): n is a, c, g, or t
  misc_feature (548)..(548): n is a, c, g, or t
  misc_feature (592)..(592): n is a, c, g, or t
  misc_feature (631)..(631): n is a, c, g, or t
  misc_feature (874)..(874): n is a, c, g, or t
ggcctcattgtagcccattctgagattcgcgatgggcattcctgaatagcttgaccgaaacgatgtatactaggctatatacaagtacgcaaaggtccccaaacgttgtaggccccgtacggggtattacatagtcctttcgggtgagcgccaatactagactcttcgatcgcacataggagccgcctagaaacaccggcggcagtctatcctattctacgcgcgtgcgtacactcaaccgtacgccggatgctatagactgcgtcacacaatcgatgctatnctaccatacttgacaccctcgctggtccctcacgagtaccacgcaagctccactcctgcggtgcgaaatgcatgcaaagcgcgtgagggcctcgttcgcctcagttgtcatttgctttatgtcgcaaccccttcctaaagcaacctgacgtcgcgttgtgtgaacgtacgaacgtgccccttcgttggacctcgacgagcgctggaggacgaggttcgacaaagcggtcaaaatcgtaagctgccttgcntgcattcctgtgacngtcgacgttgtagatgccacccgatacgggcgcacacatcaaantgcttcacatagtgagaagggtcgagctcgctttgaggncgctacatcgacattcttacaactaatcggaacattttaacatagagatagacggctcgagggtctcgtctatataacactacataccatcctccttctaatgcatgaaagagggagaaggaaaacagaactcttgcatgttgacctacccctgtgaacgccagtccgactagcatcgcacatctgggcgcgccattaagaacttattctcgagtctatcaatgcgtggcgccaaccttagcnttatgccaatgcactgtagcgcaaaaacctcggggagaacccaacgcaacatttactggaattccttgtcccttccggaataggtggggggaggtgtccccaggatttacctaaaggttcttcccaatggggcatatccgcaacccactcccggacgaactgaacgcgcgcgcagtctatgggccccccttgttgcgccactcctcagtttgcctcctccgattgaagccccggaaaaatgaagggccaaaagaggccactctaattgttcagttaaatgtaatatagtcacccccttgcaatcgcgaagtgtaagacgaaattcccttttgccctttaaaggggaataagacataaccaattgagtttgaacctggcgagcttctttcacccgcgttgtaggaacttcttgaaccagcgaaagggaggtgaatattctggtgcaagcgcaaaggaaacctccttatcttttcttaaacccctttgcctcttgttttgcgtatcattagaaactgtgccggaaacacaggtaattaacccgcgcccgaattttcccctggcttcaacgaagcaaaagttctattaaacactcttccctaatagaagagaaagggtttcccaaac

SEQ ID NO: 595652 - DNA, 103 bp, Homo sapiens
ctgtaggtctgacgtagattcacactgcggtgcatgctccctgaacaagtccgtcgacacgtgagcaatgtgctgacctccaaatatcgtaaagctggagcct

SEQ ID NO: 595653 - DNA, 84 bp, Homo sapiens
ctagaagattcagcaaagtacttttgtgctcttggggggcctgggacttcctacctgcctgtactgggggatacgcaactcttc

SEQ ID NO: 595654 - DNA, 1765 bp, Homo sapiens
  misc_feature (405)..(405): n is a, c, g, or t
  misc_feature (1761)..(1761): n is a, c, g, or t
gggccttgaggtgcgacaaatctttcagcttcttggtgttcttctctggctatttatccggtgcagactagcggatctgacactcactcacacgcttcggattagagcgagtcgctcgtggtcctggcgggacaagcgtgttgagataggaccgtccgtagtctacaactggaataagtcatctcccctggtcatactcacgtcgatactactgatgcgtggtggatggcttcttcagcccttcatgttgccggtgactcatacagttgcgtatccgtccctggcaggcgggtcgcacgtccgcatcgtaccgagcggagcagagggcccatgcgttccagccgaggacctcatggaagcgaaggttcttcgccagggacagtcttatcaggccaaggcaggaanccgttaccgagcgagcagacatgcgtgtgcaagtctggactagccctcgaaaggtagaccccttgcgcagggggcaaattgagctacacctgccgtgcatcctgtcattctgcgccccacgtacaaggcccttatcgtccctgcgtcgctggccttgtacttcggagactgtcgacctttgttcaccgcctgggggaataggcgctttcaattgatcgagtgtgcggtcgtggttgtgattgccgccccaaggacagcagaaagccctgtgcgcatgtgcgattagtgccttgtggtcacagatagggaatttacactctcccatatcccttactccgttaaaaggtcggaaacacaagacgtactttccgcctgtggaaagcggggcaatgggcggacccatggcggagatttatgttatatatcctccgcctcctttcgttgaatttgtgtaccccatatatagaaaacatagcgagaaaggcattccttcggtgtaatacacgttgtacatttcccttcggtgattgggaatcgccggtccgcgggagaaacgcgcgaatgtgcttttattatcggtcacttccacgtggggcacatcgcgacgttcgcgccgagacgcttgcgaaagaggtttacctgcctcttttacgggatccctctgggttgccacccagcgtacatagaacaaacaccccgcgaccaatcaaggtattgggcgaactcaaccaaagggctatagatacacgctgggggcatccacttcccccaatgtcttagggaacgcgttttacttggccccacggggtctccgtggggaccttgtaaggtccacaccaaccgcctagagatgggctagagagcccgaaaacattggggctttctttagaaacaacagagcccacagtgagcatttaccatggccattgggatgtggagaataaaagaccggcatcacaccaagggtcatgctcggagcagagaaatcttgtggtcccccaagaggccaacccgaagaggacccacacgatgctccaagagaaagagagtggctgtgcccacgaacaatttacaggaccatcaaagagggagccgaacaagagaggtcgcgtgatcaacgaactccctgcccacgacatgagtgacaaaggaagtgaacgcatattacaccgacgcaacgccgagggaaggcaccaccacgacaccccgacaggcaactacaactcgagtcgaggtagcgatgagcgcgagcgaaggaaaggcacccacacacagcaagatgaaattcgatcggagtgcattctaggacctgatccactgccgactcaatcacagcagatagatgaggagtcgtgnggta

SEQ ID NO: 595655 - DNA, 285 bp, Homo sapiens
tcactgtaatctgatttactacttgtgagggcccccgaaaggcctcctcacctccaatttaaattaaaaatttttaaacttagcccaagttcccaacggggagggcgcttttttcgcctccgaataccccggtttttcccccccccccaaagttgtggggggggcccccccccccctttttggcccccggggccccccccccaaggggagggggggggcccccccccccttaaaagattttttccccccgggggtgccccctttttaacacccccccccgggggg

SEQ ID NO: 595656 - DNA, 98 bp, Homo sapiens
acccctgcgccatcgccgcgcagctcgacgctgctcatcagttcgcactcgtccttatcgcggcaataggcgcgcgtgagctcgatgcgcgccgtttc

SEQ ID NO: 595657 - DNA, 116 bp, Homo sapiens
  misc_feature (18)..(18): n is a, c, g, or t
ggctcggatcctcggggnttggcaacttttcctgtaaatggacagatagtaacattttattattttatttattttttgagatagagtcttgctctgtcgcccaggctggagtgcaa

SEQ ID NO: 595658 - DNA, 1757 bp, Homo sapiens
agggtgaaacgccatctcaaaaaataaaaattaaaaaataaaaaaagaacctggcatctcaagtttaatttttcatagttcttgtcaatgaacatggacttgcaggcaagcctaacgatcatagactagcacaatacagactaattccacagacacactctctacgcaaactttagacctacttcactattcctctagaccatattcctataccacactgataactacttgacccatactaccatagcgcagcttcgcactactatgctctttcactaccatgcatgctggctcttcgaactgatatccacgtcccaaacacatcactgctctgacgcaccatctaactccacctaacctgataggacaactacctgcacacacggctgcgcgcgccctcttgcagcaactgctgcaatctgcgcactccgctacaagcgccaatgctgccccctctccactctcacctgcgcgctttacacctgcgacctctacacctgcgcgctactactcaaacaacgggcacacctgcgcgcacccgtgcgactgacgcccgtccataactacaccgcacacgcacgcgcacaaccccgcacggaaaccctggcacgcccctaccaccaacttggaccccccaagcacccccagccaccgcacgccatcgcccacacttcccaacccctacgcaacaggttgcacctcgaccactcaaacgacatgacgcacacacactgcactgcaacgcgcctcgccacccgccccctgacccccaaccaggaaacggggaggacacccccccccacaagcaccaaaacgagggaaaaacaacactggctcacacacaacagcccctaggactacacacttaacccgcactggcggaaacccttcccacaacacgcggacccccaaccccaacacgagcaaaacgcaacgccaacacgacctggaccccccaaaccggcaacatgaggagcacacagcacccaggcaccctatgcacagcggagcaaggaccacccacgcagggcacacacccccacatgggacaaaacacaccagaacacacaacgaaaccaccagcaaggcgaggcaaaacaccacgcgcccccgcaaggcgccgaaacaacgcaccgttgggccactgggccgcgaccacaagcacacctcctcacaaacagcgtattcatgggagcagacacacaaacaagcaaccccaaaccacttgggcacccagaaccagccaccgagaggcagcacacacacacaatgcacactcacacatgcggcagacgacggccacaagacacaaacacacagtcacacaacacattagcatataccacaccagcacagggcaccagcaagatccaaccccagatacagagcacccagccacgacttagtggcgcagcacacaagaaaaccacccaccacccacagacatgtgacatcacccgccacgaaagcgcgcccccgtcagagtgcgcgaccccacaccaaccagagcatccaacagaccgactggcgcccctattgcgagcgcccacaaccacacgaccgcgacaaaacgcgacccacccgatcaccaacacacaggtcccactacacccaaaaccacaacaacgcgacagcacaaccaaaaaccaggcgagagcatcggagacaccgccctaatttaaacacaccccacacagttcgggacaaaaagcaggcagaccaacccccccacagactcgacacgacaccacgaagca

SEQ ID NO: 595659 - DNA, 162 bp, Homo sapiens
gtgctatggagcaataccatactgaggagctgacgcagtgcgcagatgcacactatgtactgcaaagagtgtctcatcagatatgcccaagaggcagatcttaggatctggaaagttggagctcagctgcatggaaggcagctgcacgtgttcgttccattt

SEQ ID NO: 595660 - DNA, 715 bp, Homo sapiens
  misc_feature (14)..(15): n is a, c, g, or t
ctgtctgaggatcnncaataattgttggtcattgatagctaaaaaatttaaaaaatggattactaatgaagtttgccagagattagaaaaactggttcttataatcctgcaacaatacctaactttgaagatccatataaagccgctattgcttgggcgtctgaatacaaagcgaaacggattgcacaagaacaattagccattgcagcgccaaaagccgaagcgttagattgaatagcagactgtgaaaataatctaggcatacgtgaatctgctaaggtcctaaagattaatcaaaaaactttagtgcagtatcttatggatcataaggttgtgtatcgtgatcaattcaagaagatacaaggctatcaaaagtcagttgatcaaaagttgattcaagtaactgtaagtggtccgcgagaaaccgagaatggagaaaaggttttctcacaagtgaaactaaccccaaaattaattactcgaattgccacatggattgaaaacggcatgccgccaaaagccattaagaaataaaaaagagggctaatgccctctattcttttaatgatgttttctgcattgtttggtagagctatttagcatttaaactcatcttatttcatatttccatagttcttgatgataaaccaagattgactcagcataggaagttatgcatttatcaatatcaatgccaacaattattagggtcctt

SEQ ID NO: 595661 - DNA, 373 bp, Homo sapiens
atccgaagccgagaagaagattccaaggggagatatagagatatccagaggccacttttagacgatctggggtcagtagagaggtgagccctctccttacaattcatcacctgaacaaagacactcgaccttctgcagagggtcagtgctatcccctgtgtggcgacctttgcacagctcagtgcgggacctgagagctggctaaaatctcagggaaaggagcatagccctaggccccaggccccaaccctattctcaggaggttatctcagagactctgcttgtccacagagctaagtccagaagtagcaaagcctcaaatcaaagccagcaagaccacagtcacaggagataaggactctgtgaacctgac

SEQ ID NO: 595662 - DNA, 373 bp, Homo sapiens
  misc_feature (49)..(49): n is a, c, g, or t
  misc_feature (280)..(280): n is a, c, g, or t
  misc_feature (288)..(288): n is a, c, g, or t
  misc_feature (294)..(294): n is a, c, g, or t
  misc_feature (307)..(307): n is a, c, g, or t
  misc_feature (360)..(360): n is a, c, g, or t
ggcacgaggggaggagggggaaggtcagagagaccttgaggcttcttcngttcagtacggacaagtgccatattttgggatatctgcttctgagccccaacactgttattaagaggccatattttattgtaagcctactatatacaaggcacaggttaggttttgtgaaaaataagccaaagcttcttgaatggaattcaagccctatttatgttataatgtgcaggagtttagcaggttaacactggggaagcagagacttggtagcatccacattttngcttgttntctttnagaaccatatatnttatttaaataaattttttattaaaacaatgttgttaactggtagattacccntcaacacagggaa

SEQ ID NO: 595663 - DNA, 422 bp, Homo sapiens
  misc_feature (1)..(1): n is a, c, g, or t
ntgcacgaggcgacccgcatcactttgcggtgttgatcggcttcggcgcctcggcggtgtatccgttcctggcttacgaagtactcggcgacctgatccgtaccggtgaagtgctgggcgacctctacgaggtgttcaagaactaccgtaagggcatcaccaagggcctgctgaagatcctgtcgaagatgggcatctccaccgtcacgtcctaccgcggcgcgcaattgttcgaagccatcggcctgtcggaagaagtttgcgagatgagcttccgtggcgtgccaagccgcatcaagggcgcacgtttcgtcgacatcgaagccgagcagaaagccctggccgccgaagcctggagcgcgcgcaagccgatccagcaaggtggcctgctgaagttcgtgcacggtggcgaataccacgcc

SEQ ID NO: 595664 - DNA, 268 bp, Homo sapiens
ctgccggatccatggtacttcccccaacccacataaacttgtactgcccctatgcgtggcatattcatccctgtgaccttctctgtcccagggtgaatgttagaccggaccagtcctgactgtggatgacaggggtctgaccatctccatctcaccatcacaggccttactcctgggaaagacgccacaaacacttgctgcacacacagaagggtcgggccttgccattggaggtgattgggtttacaattttgttctgcatccgcta

SEQ ID NO: 595665 - DNA, 630 bp, Homo sapiens
aagggattatactatccctgttcatttatactactctcattaccctctacaccccctccctcttaggcatattgggcctattgcccatactagtctttccccctgcgaagcaccggtgggcctagccctactagtctccatcgcccacacatatggccttgactacgtacattaccttaacctactcccatgcttaaactatatcgtccccagccattatattactagcccctgacactgactttcccagaaagcacataattgtgaatccacacccacccccccccgccttattattagcatcatccctctactattttttaacccaatccacacaccacctatttagctgttcccccaccgtgtcctccgacccccttaccacccccctccttatactaactacctgactcctacccctcaccatcatggcaagcccacgccacttatcccgtgaaccactatcacggaaaaaactctacctctctatactaatctccctaccaatctctcttaattataacattcacagccaccaggactaatcatattttatatctttttcgagaaccacacttatcccccccttggctatcatcacccgatgaggccaccagcccggacgcctga

SEQ ID NO: 595666 - DNA, 1425 bp, Homo sapiens
gctaggtgcgagcgtcggtgagatcggcacgagggacaaggtgaacccgcagccggacttctgctgcactggggctccgaatgacccagaatctggggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagggcgttttttctatcagaggctggtggagttcatggccagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccaccacctgcctgagggcctagctcaccacagcacatcctccaggatctagccttctatctacctcttctctggaatgtttatggtggttcagaagaatgatgactcctctttgctgagaactgttcatccttcttcaagaagaagcttgccaggccgggcacggtggctcacgcctataatcccagcactttgggaggccgaggcaggcggatcacaaggtcaggaattcgagaccagcctgaccaacatggtgaaaccccatctctactaaaaatacaacaattagccaggcatggtggtgcatgcctgtaatcccagctactcagaggctgaggcaggagaattgcttgaacctgggaggcagagggtgcagtgagccgagatcgtgccattgcactccagcctgggcgacattctgtctcaaaaaaaaaaattacaacaacaaaattgtttgggcggcgctgccccagaaaagtttcaacaactctgtggaggggccagtagataacacggtcaagggttccagacaagggcagaagggtgttcccacaaaagccgggccgcggctcaacaccaggggggcagggataaggcggcctatcgccggggaagaccgagaaagacaagctcacatcgcgcgcagcac

SEQ ID NO: 595667 - DNA, 1646 bp, Homo sapiens
gctaggtgcgagcgtcggtgagatcggcacgagggacaaggtgaacccgcagccggacttctgctgcactggggctccgaatgacccagaatctggggtgggcttaggccccgggccgcgtgttcttgccacgagaacccctagcagcctggccttggaatggctggatgaggtgcattcgttggttcattcagatactgttaagagccagctgtgtgctaggtactgcttacaccttctggtggtgaagacggaactgaagggaacttgcaaggagctgtgagaaagtgtaacgggaagtgagctaagatcactaaggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagggcgttttttctatcagaggctggtggagttcatggccagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccaccacctgcctgagggcctagctcaccacagcacatcctccaggatctagccttctatctacctcttctctggaatgtttatggtggttcagaagaatgatgactcctctttgctgagaactgttcatccttcttcaagaagaagcttgccaggccgggcacggtggctcacgcctataatcccagcactttgggaggccgaggcaggcggatcacaaggtcaggaattcgagaccagcctgaccaacatggtgaaaccccatctctactaaaaatacaacaattagccaggcatggtggtgcatgcctgtaatcccagctactcagaggctgaggcaggagaattgcttgaacctgggaggcagagggtgcagtgagccgagatcgtgccattgcactccagcctgggcgacattctgtctcaaaaaaaaaaattacaacaacaaaattgtttgggcggcgctgccccagaaaagtttcaacaactctgtggaggggccagtagataacacggtcaagggttccagacaagggcagaagggtgttcccacaaaagccgggccgcggctcaacaccaggggggcagggataaggcggcctatcgccggggaagaccgagaaagacaagctcacatcgcgcgcagcac

SEQ ID NO: 595668 - DNA, 792 bp, Homo sapiens
gggtgagcagttgtcctacgccacgcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggctcgtcgctgtgaggcgtaagggacatgaattctagggtctcctttctccttatttattcttggggctacatcatccctggctgtggatagtgcttttgggtagcaaatgcttccttcttaaggtatagggctccctgagtttgggaatggggaaggactacttaactggctggcctgcttggctggcggtatccgttttgggggtggtgggctacaatagaagacccgggtttatttttgtggcctggaaggaaggacctccccacaggtggctggggccaaccccgctttttggctttttcccccgagggcccgccagaaaaggggggctggttgtttcttcccactaaaaaaccccggggccc

SEQ ID NO: 595669 - DNA, 236 bp, Homo sapiens
  misc_feature (189)..(189): n is a, c, g, or t
cacgattactcccaacgctttacccgccttcgtgtgtgtgtgtgtgtgtgtgtgtgtgtgtgtgtgtgtacaggtccacttctggacatgtctgtcatcatttcttggctcactctgtctgtacaggtgtcagtactacgacctattataaactccctggtactgtactgtactggcacgcggtaacanacgcgttgggtacccgacgactcgacactgtcgataactcagtggat

SEQ ID NO: 595670 - DNA, 1550 bp, Homo sapiens
gctaggtgcgagcgtcggtgagatcggcacgagggacaaggtgaacccgcagccggacttctgctgcactggggctccgaatgacccagaatctggggtgggcttaggccccgggccgcgtgttcttgccacgagaacccctagcagcctggccttggaatggctggatgaggtgcattcgttggttcattcagatactgttaagagccagctgtgtgctaggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagggcgttttttctatcagaggctggtggagttcatggccagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccaccacctgcctgagggcctagctcaccacagcacatcctccaggatctagccttctatctacctcttctctggaatgtttatggtggttcagaagaatgatgactcctctttgctgagaactgttcatccttcttcaagaagaagcttgccaggccgggcacggtggctcacgcctataatcccagcactttgggaggccgaggcaggcggatcacaaggtcaggaattcgagaccagcctgaccaacatggtgaaaccccatctctactaaaaatacaacaattagccaggcatggtggtgcatgcctgtaatcccagctactcagaggctgaggcaggagaattgcttgaacctgggaggcagagggtgcagtgagccgagatcgtgccattgcactccagcctgggcgacattctgtctcaaaaaaaaaaattacaacaacaaaattgtttgggcggcgctgccccagaaaagtttcaacaactctgtggaggggccagtagataacacggtcaagggttccagacaagggcagaagggtgttcccacaaaagccgggccgcggctcaacaccaggggggcagggataaggcggcctatcgccggggaagaccgagaaagacaagctcacatcgcgcgcagcac

SEQ ID NO: 595671 - DNA, 475 bp, Homo sapiens
gccggttccaggtccatcgcagactccgaggcgacctcctgtggctcgtatgacggccacaagtccaggattctacggacgatgcgacgatagtcggatgcgatgcccaaccagatgatgcagcagcggcgccaaagaaggctcctgcaaagcgcaaaccacgaaaagtcaaaacaccagctcgcgtcaacgaggaggagccagcggaaggccaaaaaggcgagcaaccatctacaaaagctaagaaacctcgcaagccacgtcaaaaggctgcagcgaagcctcgagctaagaaggcaactcctgaaggcgatgctgaagtcgaggtccaaaatgagacgaatgcggacgaagaggagccagagtcagatccagagctccacgagatcgacccggaagctctctccatgtacactatcaccaagcagaaacgctacgggaagacttctgagcgtgagaagaaaatggccgagat

SEQ ID NO: 595672 - DNA, 1454 bp, Homo sapiens
gctaggtgcgagcgtcggtgagatcggcacgagggacaaggtgaacccgcagccggacttctgctgcactggggctccgaatgacccagaatctggggtgggcttaggccccgggtacgaggggaggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagggcgttttttctatcagaggctggtggagttcatggccagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccaccacctgcctgagggcctagctcaccacagcacatcctccaggatctagccttctatctacctcttctctggaatgtttatggtggttcagaagaatgatgactcctctttgctgagaactgttcatccttcttcaagaagaagcttgccaggccgggcacggtggctcacgcctataatcccagcactttgggaggccgaggcaggcggatcacaaggtcaggaattcgagaccagcctgaccaacatggtgaaaccccatctctactaaaaatacaacaattagccaggcatggtggtgcatgcctgtaatcccagctactcagaggctgaggcaggagaattgcttgaacctgggaggcagagggtgcagtgagccgagatcgtgccattgcactccagcctgggcgacattctgtctcaaaaaaaaaaattacaacaacaaaattgtttgggcggcgctgccccagaaaagtttcaacaactctgtggaggggccagtagataacacggtcaagggttccagacaagggcagaagggtgttcccacaaaagccgggccgcggctcaacaccaggggggcagggataaggcggcctatcgccggggaagaccgagaaagacaagctcacatcgcgcgcagcac

SEQ ID NO: 595673 - DNA, 467 bp, Homo sapiens
accacctccacccagacgtattctgacatgaccattcggcctagtccacctccggatgagagtgacatgccagaagggaggtcagagcctccagggatgtgtgagcaaagccttactgggaagcccacagaccccaactggaatccaagaaacttaaaatccctaggcctcggccctgttccagcctcaactttagcatctctggcgtcttgcgggcagccacatcgttctgagcccgcagggcatgtttcctcctgatactccttgcagtacatctggtcatggatggccttgcagagccggcacttgacgtggcaacacacagggcaggtgaaactcatttgacatcatcctcaaagaagcaccatcccttgcaatctggggtcttgcaatggtagctgaaggcactgcggtttacagcaatggagatgcccaggtctagaaatcggtggtaatcctcaggggtc

SEQ ID NO: 595674 - DNA, 803 bp, Homo sapiens
tcagttactcttctggcagatatattaaacgatatagttcatcatgaacgtttaccttattctgtcaggcacagatttgatagccaagcaataggagttggaaatcactcgaatgcccattagtgagaaatggataatcagatagatgtgaatatatgcaatgctacgtggagtaccatgcagtaggttagaagtaatagaactatcattgtaagtagcatctagcgattaagtaaagtactcaagaaatatgactgatacagtaaaagaagttgagaagaagaaatgtacgcagaaatgggcaagtgatgttaaaaacgacaagagtgagtacctgcgatgtaatgttaaataatactaccaaatataaggatatccatgagagcaatcctgcatcactgataagtattctacttataagctgattgtctgtcacaagttgagttcttatttgcctctctgatgtcacttagattctggtgtaagctcctttgaaaatactctcaataacagttagagtctttctgctgcacggcaagtcctgcgtgtactctttgtcaaactccattccttaggaacatggggcctattgtgaactgggtatcctttgggacaatccttgtgcccaggaaaccccgcgggcaataatattgggggtatacttgataacagagtaagaagcacccattgggtgaacctctggcctatttctggaaaggactcactaccatagagttctggagggggatttagctcgattcatcaacagtagccacatggtaaatcatagaaatactgtgcgg

SEQ ID NO: 595675 - DNA, 1914 bp, Homo sapiens
gctaggtgcgagcgtcggtgagatcggcacgagggacaaggtgaacccgcagccggacttctgctgcactggggctccgaatgacccagaatctggggtgggcttaggccccgggtacgaggggattctcgacttgtcagttgttgtaaaccaagagtcaagacagccacaacttagctgcgttagtaaaggaaccatgtcctccctacaggtgggcttaggccccgggccgcgtgttcttgccacgagaacccctagcagcctggccttggaatggctggatgaggtgcattcgttggttcattcagatactgttaagagccagctgtgtgctaggtactgcttacaccttctggtggtgaagacggaactgaagggaacttgcaaggagctgtgagaaagtgtaacgggaagtgagctaagatcactaaggtgggcaggaggcaaccagagaaagcacattcaggactgcgaaaactactcacacaaaggctgtcaagccagaaattctttcaaaactgaaaggcccatgaggttggagctagagaaacttaaggagtgtggggttccagatgaggctagagaggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagggcgttttttctatcagaggctggtggagttcatggccagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccaccacctgcctgagggcctagctcaccacagcacatcctccaggatctagccttctatctacctcttctctggaatgtttatggtggttcagaagaatgatgactcctctttgctgagaactgttcatccttcttcaagaagaagcttgccaggccgggcacggtggctcacgcctataatcccagcactttgggaggccgaggcaggcggatcacaaggtcaggaattcgagaccagcctgaccaacatggtgaaaccccatctctactaaaaatacaacaattagccaggcatggtggtgcatgcctgtaatcccagctactcagaggctgaggcaggagaattgcttgaacctgggaggcagagggtgcagtgagccgagatcgtgccattgcactccagcctgggcgacattctgtctcaaaaaaaaaaattacaacaacaaaattgtttgggcggcgctgccccagaaaagtttcaacaactctgtggaggggccagtagataacacggtcaagggttccagacaagggcagaagggtgttcccacaaaagccgggccgcggctcaacaccaggggggcagggataaggcggcctatcgccggggaagaccgagaaagacaagctcacatcgcgcgcagcac

SEQ ID NO: 595676 - DNA, 136 bp, Homo sapiens
cccatcctatcatgcaggcagtgtctaaacattctccaagtattatcccacttaattcttacaaacactgatgacacatggtactatcattaccccctcatttgcggataaaaagagcaaggctcagagagcttaa

SEQ ID NO: 595677 - DNA, 428 bp, Homo sapiens
agcgcctgtaatcccagcactttgggaggccgaggcaggtggatcatctgaggtcaggagttcgagaccagcctggccaacatggtgaaaccccgtctctactaaaaatgcaaaaattagccaggcatggtggcgcgcccctgtaatcccagttactaggaagactgaggtgggagaattgcttgaacccgggaggcggaggctgcagagagcagagatggcgccattttactccagcctgggcaacaagagtggaactttgtctcaaaaaataaagaaaggaaggaaggaaggaaggaagaaagacaacaacaaaaaaaccttgaatcaggatgaagggatttagggtgatctttttcattctctagtttcaaacttcacgtaatgtggtattacttttaaattttttattaaaattgtttaaaaac

SEQ ID NO: 595678 - DNA, 1579 bp, Homo sapiens
aagtgtgtatagtcgatccggtttatttcagtacgaggccagagtgtcttttctcatctgtccgtccgcgtgtcaatgcatgcgcctggaaaacccgccaccctccaggacaactcacagcctcacctcacgccgcggcgcaaccggactaggaccccgagcagggctgcccaggagcgcctgaaggaccctgcgagggccgcaggctatccaggtggcgcctggtggccgggccctgtgccggaggacaggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagggcgttttttctatcagaggctggtggagttcatggccagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccaccacctgcctgagggcctagctcaccacagcacatcctccaggatctagccttctatctacctcttctctggaatgtttatggtggttcagaagaatgatgactcctctttgctgagaactgttcatccttcttcaagaagaagcttgccaggccgggcacggtggctcacgcctataatcccagcactttgggaggccgaggcaggcggatcacaaggtcaggaattcgagaccagcctgaccaacatggtgaaaccccatctctactaaaaatacaacaattagccaggcatggtggtgcatgcctgtaatcccagctactcagaggctgaggcaggagaattgcttgaacctgggaggcagagggtgcagtgagccgagatcgtgccattgcactccagcctgggcgacattctgtctcaaaaaaaaaaattacaacaacaaaattgtttgggcggcgctgccccagaaaagtttcaacaactctgtggaggggccagtagataacacggtcaagggttccagacaagggcagaagggtgttcccacaaaagccgggccgcggctcaacaccaggggggcagggataaggcggcctatcgccggggaagaccgagaaagacaagctcacatcgcgcgcagcac

SEQ ID NO: 595679 - DNA, 1483 bp, Homo sapiens
aagtgtgtatagtcgatccggtttatttcagtacgaggccagagtgtcttttctcatctgtccgtccgcgtgtcaatgcatgcgcctggaaaacccgccaccctccaggacaactcacagcctcacctcacgccgcggcgcaaccggactaggaccccgagcagggctgcccaggagcgcctgaaggaccctgcgagggccgcaggctatccaggtggcgcctggtggccgggccctgtgccggaggacaaggctgttcatcagcagattctaagcaacaagttcctgattgtacgaatgagagaactactgtggagaaaggaagattgccagaggttttaccgagagcatgaagggcgttttttctatcagaggctggtggagttcatggccagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccaccacctgcctgagggcctagctcaccacagcacatcctccaggatctagccttctatctacctcttctctggaatgtttatggtggttcagaagaatgatgactcctctttgctgagaactgttcatccttcttcaagaagaagcttgccaggccgggcacggtggctcacgcctataatcccagcactttgggaggccgaggcaggcggatcacaaggtcaggaattcgagaccagcctgaccaacatggtgaaaccccatctctactaaaaatacaacaattagccaggcatggtggtgcatgcctgtaatcccagctactcagaggctgaggcaggagaattgcttgaacctgggaggcagagggtgcagtgagccgagatcgtgccattgcactccagcctgggcgacattctgtctcaaaaaaaaaaattacaacaacaaaattgtttgggcggcgctgccccagaaaagtttcaacaactctgtggaggggccagtagataacacggtcaagggttccagacaagggcagaagggtgttcccacaaaagccgggccgcggctcaacaccaggggggcagggataaggcggcctatcgccggggaagaccgagaaagacaagctcacatcgcgcgcagcac

SEQ ID NO: 595680 - DNA, 631 bp, Homo sapiens
tggggggggcccccccccccaaaaaggggtttttttaaaaaaaaaattatataaaggggccgtccttcttctttttttattactatctttctcttctggggaggagagagagaaaaaccgggtgtacagagagaccactttttatataaaaaaaaaattatttttctccctcacaaacatcttattaataaggaaggagggggttgttgtgccgcgcggaacacgagcgggtctatattattgtgtgtgtcgtcacccgaccgcgctgggtcctctctccgcgcgtgtgtgtgtgtcgtctctctcttgtttgtgggagggcttctctctctctctctctctctctctctctctctctctctctctctctctcgcgcgcgcggggtgtggcgtccctcccggagcacccggcggcggagggaggtggttatatattgtaggggggagaagaaaaaatagattatctttaagaagaaagaacaacacaaaaaagagagagcggggagagaaaacaacgcgccgccaggcgagcccccccgcgcgcggcggggactcttctttgtccccaaagccgggagggggcgccaccaaaccgccgggcggagggcgcgtggactacccggagagaaat

SEQ ID NO: 595681 - DNA, 1385 bp, Homo sapiens
gctaggtgcgagcgtcggtgagatcggcacgagggacaaggtgaacccgcagccggacttctgctgcactggggctccgaatgacccagaatctggggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccaccacctgcctgagggcctagctcaccacagcacatcctccaggatctagccttctatctacctcttctctggaatgtttatggtggttcagaagaatgatgactcctctttgctgagaactgttcatccttcttcaagaagaagcttgccaggccgggcacggtggctcacgcctataatcccagcactttgggaggccgaggcaggcggatcacaaggtcaggaattcgagaccagcctgaccaacatggtgaaaccccatctctactaaaaatacaacaattagccaggcatggtggtgcatgcctgtaatcccagctactcagaggctgaggcaggagaattgcttgaacctgggaggcagagggtgcagtgagccgagatcgtgccattgcactccagcctgggcgacattctgtctcaaaaaaaaaaattacaacaacaaaattgtttgggcggcgctgccccagaaaagtttcaacaactctgtggaggggccagtagataacacggtcaagggttccagacaagggcagaagggtgttcccacaaaagccgggccgcggctcaacaccaggggggcagggataaggcggcctatcgccggggaagaccgagaaagacaagctcacatcgcgcgcagcac

SEQ ID NO: 595682 - DNA, 241 bp, Homo sapiens
gcaaattgtgcaatggaataaaatccacactttgctagtgtatttcctgggtagtgtggtgctgaataaataggagtagggtggtggggtgggtgggttaggggtttagattagccagaagcaggaaattcactagcaaatttttcaattgaataaaattcacactttagattcttgcaactgtatcatatgaatagatcactttttctacattttgggcaaataaatttttacataaact

SEQ ID NO: 595683 - DNA, 258 bp, Homo sapiens
ccttttggggggtgggggaagggagcccgtttggatgatggatgcccttccttttggccagttaaatgttcccccatccttttaactaaaaactcagacttagaaggcagatggttcatggcccagcctttaggttggtccacaggtggtttttcagcttcctttggccagggggaaaacatgattttctgggttggccagcccaaaatgttatatttgatatttaaaacttaatggtggtttgaagagatagctgga

SEQ ID NO: 595684 - DNA, 1539 bp, Homo sapiens
aagtgtgtatagtcgatccggtttatttcagtacgaggccagagtgtcttttctcatctgtccgtccgcgtgtcaatgcatgcgcctggaaaacccgccaccctccaggacaactcacagcctcacctcacgccgcggcgcaaccggactaggaccccgagcagggctgcccaggagcgcctgaaggaccctgcgagggccgcaggctatccaggtggcgcctggtggccgggccctgtgccggaggacaggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccaccacctgcctgagggcctagctcaccacagcacatcctccaggatctagccttctatctacctcttctctggaatgtttatggtggttcagaagaatgatgactcctctttgctgagaactgttcatccttcttcaagaagaagcttgccaggccgggcacggtggctcacgcctataatcccagcactttgggaggccgaggcaggcggatcacaaggtcaggaattcgagaccagcctgaccaacatggtgaaaccccatctctactaaaaatacaacaattagccaggcatggtggtgcatgcctgtaatcccagctactcagaggctgaggcaggagaattgcttgaacctgggaggcagagggtgcagtgagccgagatcgtgccattgcactccagcctgggcgacattctgtctcaaaaaaaaaaattacaacaacaaaattgtttgggcggcgctgccccagaaaagtttcaacaactctgtggaggggccagtagataacacggtcaagggttccagacaagggcagaagggtgttcccacaaaagccgggccgcggctcaacaccaggggggcagggataaggcggcctatcgccggggaagaccgagaaagacaagctcacatcgcgcgcagcac

SEQ ID NO: 595685 - DNA, 598 bp, Homo sapiens
tgaaccgccattttgaaaatcttgtgattctggggagccgagcgcgcggcgcgagcgtccgccagacagggcccgcgcgccttctcctcggcgtcggccggcgcgcattcccagaatctcctcgtgccttcgtgtgccaggcccgaggccggcacgacaatccgcggttcacacagattgtccgcctgggccctggtttgtgagaggtgggaagggaaaccccccaaccaaagcccggggtcggagaaaagaaccgcgaaaatgcccggtcccccagagaggcaaagcgatggagcgatgaaggaccgaggaacgaccgatgcgaaggacgggatcgtgatgtgagacaaaacaggaagaaggagtctcatccgtgagcacgcgcaaggaggtgaacaaatacataccattgtccgcagaggtctggacaatctgcaacgtcttcctccttaacagaggagacccttttaccattttggccacaagggacgtggggcaaacatctttgtgacacttggcgaggaatacatttttcctaggtacaaagaaaaccggttgagttagaagtctacacagagggtttaacacagccaggccg

SEQ ID NO: 595686 - DNA, 978 bp, Homo sapiens
gctaggtgcgagcgtcggtgagatcggcacgagggacaaggtgaacccgcagccggacttctgctgcactggggctccgaatgacccagaatctggggtgggcttaggccccgggtacgaggggattctcgacttgtcagttgttgtaaaccaagagtcaagacagccacaacttagctgcgttagtaaaggaaccatgtcctccctacaggtgggcttaggccccgggccgcgtgttcttgccacgagaacccctagcagcctggccttggaatggctggatgaggtgcattcgttggttcattcagatactgttaagagccagctgtgtgctaggtactgcttacaccttctggtggtgaagacggaactgaagggaacttgcaaggagctgtgagaaagtgtaacgggaagtgagctaagatcactaaggtgggcaggaggcaaccagagaaagcacattcaggactgcgaaaactactcacacaaaggctgtcaagccagaaattctttcaaaactgaaaggcccatgaggttggagctagagaaacttaaggagtgtggggttccagatgaggctagagaggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaaggtaaggaggtagaagtacagaaagttgccttgggcaccaggatgaaggtatcttgatgaaggtcctctctctttgcagggccagtagctaaggagtgtgcagacttgtggccccggattgcatccactgctggcagccttgcatgattctcccgatatttgtaacaaatgaaaaaaactaaccctattaggt

SEQ ID NO: 595687 - DNA, 1498 bp, Homo sapiens
  misc_feature (1498)..(1498): n is a, c, g, or t
gcctggaacgtccttgccctggggcgctggggctgcgcctgcgtggttcttgtcctcacgtgggcggtcaagccctctagtgccttagattccagcgagctacgcaagcaatcctggcccagccgagcttgcttccccaaatcccgtaatccttgaccttattcccccaaagaagcggcctccctgggaaggagctgccctgtgctggagaagactcgaactggctcccacagccgggcgttgggggaaagtgtgggctggtcttgtgtctgtgcgaggtcgtgggagggagtggtcctcctgctctccattgctgtgagcttctgtcctgggaccacctggtgggacctggactgccgtgtgccgctgaatgcttgcctgccttggggctttgcgagaggatgtgacgagcaaacataagctcggaatgggcacttacgtgtggccgtgtgtcaagtgggtctgtcacccggtgggtattgggcggaacattgaccgaaagtgtggtccccagggcaccagtcggttgattacacttggtgctgagtgtttaccacgccctaaaggatgccccaccgcatgcccattggcggggaaacacccatgtaggtgacctttctagacaggcctgatgtttcccctgaatatgaaccatgtctcttgagcaaacgatgtattccgagagagtgggccctttaaggaacgcgcatgggtcggaggtggtcccccaccttttatctaaagcggcaatttggtgtgtgaacacatgcccggttcataaccggtactcatggcaacaacacgccgaggtttcttccaaacggtttggtaccggtgtccctattaggcggaaactttggttgctttgtacgcttaataatcaccgtcgcaatcattgccacactgagccactgtgtacagaaactctgctacgccagcggatgtgatcatggcacgtcttagcacgaaagtgttaacgacgatgtgttagccccggagtgatcaggattacataatcgctacccatctagcagggatattacacccttagtaaagggatctacgcgacaggtttctccgaggataaccatagcccctgagtcgccaccagaaccgcgtatcgtggttcaagaaatacccccctagttactactgtactcgttacaacagcagtgtaactctcatagatatatcagtggtcctggcgccgctacgtatgagtttgcgacagagcgcagtccgcgtatattaaacttccccagagctataactatattagcgatagggcgtcttgcaatagggttaatagggacagcaatggtcgcgattgagtatctctcagaaggcgagtgagcgagtcaggagttggagacggttgggctagcaggggtgagagctagatgcacgaccgtagatcacattatccagagtcactgggcattgtacagagacacttcttcagtaacttcgtttgtcacaggaagcgatagcaagaggn

SEQ ID NO: 595688 - DNA, 447 bp, Homo sapiens
  misc_feature (7)..(7): n is a, c, g, or t
caccagnggtgctgaggtgagaggatcgcttgagcccaggagacggaggctgcagtgagccgtgatcatgccactgcactccaacctgggcaacagagtgagaacaaaaaatcctgggcaacagagaacaaaataaaaatgtggtacgtatacaccatggaatatgcggctataaaaaataacaaaatcatgtcctttgcagcaacatggatgcagttggatgccattatactagaagagaatttaattccggaacagaattaacatctaaacctatatgaagttcttacttgtaagtgggagctaaacattggtacacagggacataaaggtgggaacaatagatactgatagacagtagagagaaagaagagggaaaaggctgaaaaactacctgttggatactatggtcactacctgggtgacggaatcatttgtacgccacat

SEQ ID NO: 595689 - DNA, 1046 bp, Homo sapiens
  misc_feature (62)..(62): n is a, c, g, or t
  misc_feature (82)..(82): n is a, c, g, or t
  misc_feature (87)..(87): n is a, c, g, or t
  misc_feature (90)..(90): n is a, c, g, or t
  misc_feature (109)..(109): n is a, c, g, or t
  misc_feature (328)..(328): n is a, c, g, or t
  misc_feature (330)..(330): n is a, c, g, or t
  misc_feature (342)..(342): n is a, c, g, or t
  misc_feature (466)..(466): n is a, c, g, or t
  misc_feature (469)..(469): n is a, c, g, or t
  misc_feature (474)..(474): n is a, c, g, or t
  misc_feature (480)..(480): n is a, c, g, or t
  misc_feature (494)..(494): n is a, c, g, or t
aaacttatggctaggtacgaggctgggtgttggtgtcgacacgttcaacccgttctgctggntcgagaacgaagtaggccgnctcgntcngggtctccaggcccgcgancgtccgccagtcgtcccgaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcagaatctccggcctgtgaaactgtgagngngattcggccaangacgttccttctttcaccttcttagccttcaccaacaccagaggccaactctcttctcaacctctccaaccaagtgacgccgtggcactatccgaagacgccgtggaacaatccgaggttgtgnagngagcntgagcngacgctagataggngcctgagctcctccctctgctccagcagtgccaagtggtcaggctggacgactgtggcctcacggaagcacggtgcaaggacatcagctctgcacttcgagtcaaccctgcactggcagagctcaacctgcgcagcaaacgaagctgggcgatgtcggcgtgcattgcgtgctccagggcctgcagaccccctcctgcaagatccagaagctgagcctccagaactgctgctgacgggggccggctgcggggtcctgtccagcacactaggcaaccctgcccaccgctgcaggagctgcacctcagcgacaacctcttgggggatgcgggctgcaagctggatctggaagggactcctggaccccaggtgccgcctgacagaggctgcagctggagtattgcagcctctcggttgccagttgagaacccatggtctccgtgcttaggggccaaggcggactgtaaggagctcacggttagcaaccaagcgacttcaatgacgctgcgtccggtgctgtgcccagggctgaaggatccccctgcagtggaggc

SEQ ID NO: 595690 - DNA, 155 bp, Homo sapiens
attgcatacatggatcaggccagtggaaatgtaaaggagggccctaaggctgatggggtcaaatagagggtgattcagggctgagggaattagcaattcacctacacagttctggaggatggttccacgaaacacactggggattggagcaaaac

SEQ ID NO: 595691 - DNA, 759 bp, Homo sapiens
  misc_feature (62)..(62): n is a, c, g, or t
  misc_feature (82)..(82): n is a, c, g, or t
  misc_feature (87)..(87): n is a, c, g, or t
  misc_feature (90)..(90): n is a, c, g, or t
  misc_feature (109)..(109): n is a, c, g, or t
  misc_feature (179)..(179): n is a, c, g, or t
  misc_feature (182)..(182): n is a, c, g, or t
  misc_feature (187)..(187): n is a, c, g, or t
  misc_feature (193)..(193): n is a, c, g, or t
  misc_feature (207)..(207): n is a, c, g, or t
aaacttatggctaggtacgaggctgggtgttggtgtcgacacgttcaacccgttctgctggntcgagaacgaagtaggccgnctcgntcngggtctccaggcccgcgancgtccgccagtcgtcccgaggtccactcgttcagcctaccaccatgagtcctggatcatccatgctgtgnagngagcntgagcngacgctagataggngcctgagctcctccctctgctccagcagtgccaagtggtcaggctggacgactgtggcctcacggaagcacggtgcaaggacatcagctctgcacttcgagtcaaccctgcactggcagagctcaacctgcgcagcaaacgaagctgggcgatgtcggcgtgcattgcgtgctccagggcctgcagaccccctcctgcaagatccagaagctgagcctccagaactgctgctgacgggggccggctgcggggtcctgtccagcacactaggcaaccctgcccaccgctgcaggagctgcacctcagcgacaacctcttgggggatgcgggctgcaagctggatctggaagggactcctggaccccaggtgccgcctgacagaggctgcagctggagtattgcagcctctcggttgccagttgagaacccatggtctccgtgcttaggggccaaggcggactgtaaggagctcacggttagcaaccaagcgacttcaatgacgctgcgtccggtgctgtgcccagggctgaaggatccccctgcagtggaggc

SEQ ID NO: 595692 - DNA, 1290 bp, Homo sapiens
ggcgcagggcagcgcaagtttcaggcgcacaaacccgcaatggagtaagacggtagctggcagcactctgtaaatggtaatctgggggcccgaaggaaaacggcggatcgatgattatcgcatcccaagcaaggcgcgcgatcgtgcagcagcgaaggtctcatggaagtatactctagaagtcggcaatccggatacgtaatgatcgcagagcagtgcacgtgagtgatgacatagccagtgagtcagcctgtgccgataaagcttgtgcacatgcgtgagagtgctccgcagccatagaaagataaggggcaggtgccgacaacttcctccaaaggaacaccgttcctgtagggacgtctgtgtcccccaagttgcagagccataaaatcctaaagcctccttagcatcacactagtgtgcatcccttgtgaagatcaattactcacagggactgtcttgttgtcaggcgaaacgaagggatcccgtggtcctcctcaagctacatgagtgcgttcgaccattagaaactctcaggtatgggtgagccatagtgggttgcttgaatgatactccaatgctaactgaaccagggaaaagattgccaagttcacgtacaactatcgattcatagtcaccgcggtggacgctctatttccctaagggatcgctttgtccttccggaccatgggtttataaaacccaagtaaagcagaatataagccatgggtttttggtccagctcggtctaatggaatccttaaagaaatggcacaggatagagtaaagacaaaattatggtaactgatatggaacatattttagagattaagaaagatttacgtaggcgaatttttgccaagaaacattccgaagaagaacaggagaacagaaagagaaagatgagcgaaatagaagaagagcggagaaagagagacgagaaggaagagaggaaagagagtgaaggagaaaaaaaaaagaaagagaaagggagatagaaggcgggtcagaaacaaagaatactcaagcaaggagagggcagacaacgagcagacaaggacggaccggagaaaaaaaagagagaaaaagaaagagagaacggcgccagcgagagaaacgagagaagacaaagagaagagagaacgagagaagagaaagaagaaaaaaaaagaggaacgaagcgaagcgaaaaagaagaagagaagcagacaaaaagaagaaggataggagaaagaacaacaagaaagcaaggagagcgagagagaagatagaagagagaccaaccaacat

SEQ ID NO: 595693 - DNA, 1134 bp, Homo sapiens
  misc_feature (451)..(451): n is a, c, g, or t
  misc_feature (453)..(453): n is a, c, g, or t
  misc_feature (465)..(465): n is a, c, g, or t
  misc_feature (554)..(554): n is a, c, g, or t
  misc_feature (557)..(557): n is a, c, g, or t
  misc_feature (562)..(562): n is a, c, g, or t
  misc_feature (568)..(568): n is a, c, g, or t
  misc_feature (582)..(582): n is a, c, g, or t
gcctggaacgtccttgccctggggcgctggggctgcgcctgcgtggttcttgtcctcacgtgggcggtcaagccctctagtgccttagattccagcgagctacgcaagcaatcctggcccagccgagcttgcttccccaaatcccgtaatccttgaccttattcccccaaagaagcggcctccctgggaaggagctgccctgtgctggagaagactcgaactggctcccacagccgggcgttgggggaaagtgcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcagaatctccggcctgtgaaactgtgagngngattcggccaangacgtcctcttccctctgcctcccacccagtgccactcttcacctccaccatgagcctggacatccagagccttggacatccagtgtgnagngagcntgagcngacgctagataggngcctgagctcctccctctgctccagcagtgccaagtggtcaggctggacgactgtggcctcacggaagcacggtgcaaggacatcagctctgcacttcgagtcaaccctgcactggcagagctcaacctgcgcagcaaacgaagctgggcgatgtcggcgtgcattgcgtgctccagggcctgcagaccccctcctgcaagatccagaagctgagcctccagaactgctgctgacgggggccggctgcggggtcctgtccagcacactaggcaaccctgcccaccgctgcaggagctgcacctcagcgacaacctcttgggggatgcgggctgcaagctggatctggaagggactcctggaccccaggtgccgcctgacagaggctgcagctggagtattgcagcctctcggttgccagttgagaacccatggtctccgtgcttaggggccaaggcggactgtaaggagctcacggttagcaaccaagcgacttcaatgacgctgcgtccggtgctgtgcccagggctgaaggatccccctgcagtggaggc

SEQ ID NO: 595694 - DNA, 283 bp, Homo sapiens
atcactcccaggttcaggtggtcggcttgtcgtcgtctgtgaagcgggactcgctgctgtagctgcccctgggccagcgtacccttgggtgcctcctccacgggggtcaggacctcgtactcctcgtcccgcggcccgcggtgcgttgtcccaccacgctccgtccccatcataggcaggcttacaagcattgctcttggccaaaatttagccccatgaggccttaccacgatgaaatgtgttctatgctccatattgtattatctggcctgggcacacctcc

SEQ ID NO: 595695 - DNA, 759 bp, Homo sapiens
  misc_feature (547)..(547): n is a, c, g, or t
tgcgtgccgccgttgatccggtgctgcagtgaggaggtggttcttgcccgtgttgtgtgtgtgtgtgagtgagagagcgagtgagtgagtgagtgagtgtgtgtgtgggggggactcggcttgttgttgtcggtgacttccccctccccttcacccttcccctccccgccgcgctgcagtggccgctccctgggccgtaggaaatgagcgataacgatgacatcgaggtggagagcgacgaagagcaagcgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccaacacacaccagcaagatattgacgacctcaagcggcagaatgctcttctggagcagcaagtccgtgcactggacgaaggcgaggtcaagtgcccaactggagaccaantaccaccatcctcagacaagagcctctacaccaacgccaagggcagcaccatctctgccttcgatgtggtggctcggactccagctcggaagtctgagcctgaagagccccaaagcagggaagaagctccggattggattgccagaataagccacctcggggcaagggccagcaataacagactgtactgtctcacatcgtcatcatcatcc

SEQ ID NO: 595696 - DNA, 728 bp, Homo sapiens
tgcgtgccgccgttgatccggtgctgcagtgaggaggtggttcttgcccgtgttgtgtgtgtgtgtgagtgagagagcgagtgagtgagtgagtgagtgtgtgtgtgggggggactcggcttgttgttgtcggtgacttccccctccccttcacccttcccctccccgccgcgctgcagtggccgctccctgggccgtaggaaatgagcgataacgatgacatcgaggtggagagcgacgaagagcaagcgaggtttcaatctgcggctgacaaacgggctcatcataatgcactggaacgaaaacgtagggaccacatcaaagacagctttcacagtttgcgggactcagtcccatcactccaaggagagaagctctatttcctctttgggaaattgtgtgctcctgtccttcatcgtcaaagttgatgcgagataatgccacaggcatgacattttcaagctacccaaggtgcagcaagagaagagagatgctaagatttaaagacattgctggttcgggaccccttacacaaatgtcttagctcctggctttactataacgctgcttgagggctgatagactctgcttcccaccatggtaatcagcagaaggtcctgtaggctggggaggcccctgggcagcaggaagcacttccaaggagccaatgggtctgtgcgggactctgcccttagaaacattcagcctcatttgctggcattgatggg

SEQ ID NO: 595697 - DNA, 731 bp, Homo sapiens
  misc_feature (519)..(519): n is a, c, g, or t
tgcgtgccgccgttgatccggtgctgcagtgaggaggtggttcttgcccgtgttgtgtgtgtgtgtgagtgagagagcgagtgagtgagtgagtgagtgtgtgtgtgggggggactcggcttgttgttgtcggtgacttccccctccccttcacccttcccctccccgccgcgctgcagtggccgctccctgggccgtaggaaatgagcgataacgatgacatcgaggtggagagcgggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccaacacacaccagcaagatattgacgacctcaagcggcagaatgctcttctggagcagcaagtccgtgcactggacgaaggcgaggtcaagtgcccaactggagaccaantaccaccatcctcagacaagagcctctacaccaacgccaagggcagcaccatctctgccttcgatgtggtggctcggactccagctcggaagtctgagcctgaagagccccaaagcagggaagaagctccggattggattgccagaataagccacctcggggcaagggccagcaataacagactgtactgtctcacatcgtcatcatcatcc

SEQ ID NO: 595698 - DNA, 225 bp, Homo sapiens
aagctaatacctcggctgtctggtctccaggtttgatattagcatgtagactatcagatgttcatcgagtcctggaaacttcatagcccttcgttgagcctgtaatataagaaccggtcctactattttgagtcggtttggggtcagataatcagcatcgaaagacacgagtactagttagtactgtaataccccaaaatgcagggacacttagtgatcacttaa

SEQ ID NO: 595699 - DNA, 151 bp, Homo sapiens
gatccccccagttaaggcgggaccgactggttttctgttttacactttgatgctcagtcctggggataacctccctgctgtgttattttattctaaacaaggggtgacatcttactatttctgggtcgtctgcaaaggcctgggcgccttc

SEQ ID NO: 595700 - DNA, 921 bp, Homo sapiens
tgagtaatcacagccagtagggcctacatcacgctgaagggagggggcccagcagagatcatgctcaaaagcgagcaggaaaaagctaggtggagcatgctgaaagtgccgagggtgtgacctgaagagtgaggggtggtgctcgctcaaagtcaagaatctggggggttcatacaatgcgtggggatagcaaaacagtagttagtggcaaatcactctgggtgttagtgcaagagcattcgttgacgttgcgagtttcttgtgggcttcagacatgtgagtggaaagactccaagactttgaagtgtggttgtggtgaacccatgtgggggcattctggaaatgggcatggagatgcatctggtatgaaatggcgaagtaaaggtaagcagctggagggtatcaggagggcaagacagcctgggtggacattgcgccggcagggcgcatgaatccatgggccgggaccgaaaaactagccccggtacgagaagcgcagcaaccgtgcggtgggaccacgagagcgttttgtaaatattatctctgtggttttgtcctgcggaattgttcacaaatacacgtctgatcttggtccgtgtgaaaagaattctgatgaaaatctacgaaagagaggtatgagaaggaggtctgggttccatgaaagggtggtatgaggagagatttgggcgatacttaacagaggttacttgcagaagtaagaagtatgccggggggggggggcggttgggggtttttcccaaaacaggaggtctgtggggggggggcccaagggggaaaggtgaaaaatttggggttcagagcaaatgttgggttttggaattggaaataggtgggggaaaaaaaacccggggggagatttggggaaaggggacgggggggccgtgaggtggcgaaaaggtt

SEQ ID NO: 595701 - DNA, 106 bp, Homo sapiens
ggtaccgcttatgtgctgtacatcacttcatcaccacgtcatcatcacatcaccaccaccatcatcaccatcacaagcgtcactgtcatcaccactgccatcatca

SEQ ID NO: 595702 - DNA, 1075 bp, Homo sapiens
gcaggctgtacgcctcgtgataacgggatctgcgctcctgctggctggacgcgctgaggagtgagcagcacccggccggcctggggctgacagtcggcaaagtttggcccgaagaggaagtggtctcaaaccccggcaggtggcgaccaggccagaccagtggcgctcgcatgcctgcgggcgggctgtaaggcgagtggctctgccccagtgccgagaccctggggcttcattgagcctggcccctgggagagaagagtgcagtgcggcggactggagaaaacaatctccaaatgttggctgaaagtgcacctgcccgtactccctgggctttcctgcctgcttaccgccgcccccgcagcgcctgggaataccaaggagtaacgcggctcggagcccctgggaaccaattggaagcgccccacgctaggatgaatgggcgtgacaacgcgaagtggaaggacactttgtgagcgccccaggggcgtaccgggcgctgcggaagacacccaagtaccgcggtaagagacaacgaaggaacagagcgttcccggaggaggatcgcccgttatcgcggtggaccaactcaatcgtatgtgaaccaaagggcgcccagggcggagttgccgtttgatatggggtcgcatgccgccgttcctcattcgcgtacccgatacgcatacccgttttgcgggaggggtgaggcgatacgttggggcgcgccaagttccccgaaggaagccgctggggacgtctacgttttatatagtcaccccagaaagagttccaatgatggccattagtgatagaacgggaagacacgcccacggacataagacgaaaggagttggcgttactttatagggaaacagtgaatgggccgaacgagggagcgcagcgcccctgttaatagcgcagagtaagtaggtgctgcgcacatagttagtggtatcccggtggggggaattcgtagctgcccgtgcagaagcgtccatatcccgcgtctgttagtaccgaaaagagtatagagcgaagcgctatgggagcggcttccaattttcacgtttgtggggca

SEQ ID NO: 595703 - DNA, 517 bp, Homo sapiens
actaactcccgagatttttgcgtttgccaaggggaccacccaaacggttggggaggagggcggtcgggttattgagcagtcgctgcaccggactgcgtcattgggagcgcagttgatcctgaacaagcttgcaaccagccggtcttccactgtaatccaatgctataactgggtatatcctgacaagctcctactcggtaagcgtcgcgagaccggcctatcttcgtttcagctgatgtcctcatgaaaacaggtcattgtcgaggcgtcctgacgccaccaaaatctgcctacacacgatcgcgggtgccccacctgcgaaaccttgatctaaaccggcgttcaattacttaccagtaagaccaagggtcatccactcctcctgaatatggtccgcttaaacaccggctatctagctccggcacgactccagcggctccataaaggaaccccgcgctctatcgccgaggtcagatatatgacaatcgctaaggcggacgttttaatgctaggggcc

SEQ ID NO: 595704 - DNA, 501 bp, Homo sapiens
gctggtacggtctggtttaggtgcacagcatggccctttagtctcccgccccgcaaggggcaccaatgccacgtttccggtgccacctcctgtctactcattgttgcatgagccctgtctgccagcccaccccaggactgggggcagcaccaggtcccgggtagagggattgagccaagaggtgagggtgcacgtcttccctcctggtcccagctccccaagcctggcgtagagcaccctctcacagttatacactcaagcgcggtcgtacctgctcgtgccttctggagcacatgccgcgagcttgtgtgtacattaatcacctgatgcttgcgccctagagggcagagcagcgatggaccatgtagtgcatgggcagtgtgcgacatcctgctctctcacataccgtatcgatagcgcaaccttctcacactacaaattggcgatctgctcctcacaaatgacacacgaaatgaacaaacagcacacaaccataaacca

SEQ ID NO: 595705 - DNA, 488 bp, Homo sapiens
cacagaagataaaaaacagtgttcttttccatattcaggtgtgcacccagggccaggcgctgaccatggttgggagtgcatgcccactgcactctggtcccacgccaagtctcacactgtcacccccaggctcaatgcggaaccgtgtgcaaggctagcccttatccaaagcacaactcccagcctgggtagcacagggagaccccgtctctacaaattattttaaaacactggctcagtgtggtggcatacacttgttgtcctagctactcaggaggctgaggcgggaggactgccttaccctcagagtctgaggctgcagtgagctgagaccgcaccactgcatcccgggctggggccacagagcaagacctaacctcaaaacaaacaaacaaacaaaaaaaacagaataaccccacacagcacaactgtaccaccaccgctcctcctgaggcgagagtgcccctacccgtcggtggagcctcggg

SEQ ID NO: 595706 - DNA, 151 bp, Homo sapiens
aactcagtcagcagcccagttttcaacactgccagcacacatcggcagtggcatgggttctcgcttcaacatcgggcaggcatcgccacagccggagcacaggcacacacattcccttttgtcccacaccgtgtcatccacatttttcacc

SEQ ID NO: 595707 - DNA, 103 bp, Homo sapiens
cggggtgatagcatatgatcgaagtataaaggaactggaagcgatagaaggactcggggatatcataaggagcgaagagctgatcagtgacttcggagtagaa

SEQ ID NO: 595708 - DNA, 139 bp, Homo sapiens
taagctaatagggatgtgcgtgtgtatgtaggagatcgagtatgtgggaataaatgtgctagtgggacttattacgtagtggtaggtagtgaggtcagggctgtagaagtctaggacggcatgagagattgggtacgag

SEQ ID NO: 595709 - DNA, 178 bp, Homo sapiens
ggttccattgaaacaaaggggatacgtcattttcagaggggacaaagcaggacagtccaagatttcatcatgctataagaccagcacacaattaaaacctggttaatttctgggaaatttccatttaatattttctggacgggggtggagcggtggcagtcacaaccggccggggggg

SEQ ID NO: 595710 - DNA, 599 bp, Homo sapiens
  misc_feature (55)..(56): n is a, c, g, or t
  misc_feature (62)..(62): n is a, c, g, or t
  misc_feature (67)..(68): n is a, c, g, or t
  misc_feature (73)..(73): n is a, c, g, or t
  misc_feature (87)..(87): n is a, c, g, or t
  misc_feature (265)..(265): n is a, c, g, or t
  misc_feature (307)..(307): n is a, c, g, or t
  misc_feature (565)..(565): n is a, c, g, or t
ctttcaatcgccaccctcgagaccacctcccacagtactcccagcttcacttctnngatcanaccanngagancacctcacacagtnctccaagcttcacttcttcaatcaacaccaccaagaccaccttcacatagtactccaagtttcacttctttgatcaccatcatcgagaccacctcacacagtttccagcttcacttcctcgatcgccaccactgagaccacctcacacagtactcccagcatcacttctttgattgtnaccaagactacctcacacagtacccccagtttcacttctatngccaccacagagaccacctcacacagtactaccagcttcacttcttcaactgccaccacagagaccacctcacgtagtactcccagcttcacttcattgatcaacaccaccgagaccacctcacacagtactcccagcttcatttctttgatcaccaccactgagaccgcatcctatagtacttctagcttcagttctttgatcaccacgaccaggaccacatctcagagtactcccagcttgacttcttctcaccancacagctgaggaccatcgttggggtaccgagctc

SEQ ID NO: 595711 - DNA, 928 bp, Homo sapiens
tggaaatggattccccctttttcccccaggttggtgtgcggggcccaatctcggctcactgtgcaaacctccgccctcccgggtttcaccccatttcccgcggccctcagttcctcccgagttagcgtgggactacgggcaccttgccaccagcgcccgcggcataattttttgtgtatttctcaccgtggaaggacggggtttcacacgtgttgtttagcccacgagtgttcctcccattctcgctgaaacctccgtttatattcttgccccactcttgggggccccccccaaagggttggctggggatataaccgagggtctttgaaccccaacgcgtcgccctgtggccaaagatgccgagaactattttattattcaaagcggggggtagtaagggcaggcgccacaaggtctaaagagctctttatggagaaacctcgaggtgtgtaactgcagaccttttgggcgcattttgggtgtgtaactctagagcgccacccgagcaaagggagaacgcggtgtaaaatctgcgcacagatttgggcacattgttcgcccccccaaggggaaagaaacggcgcccggacaaccatttgggtgagcccctcttgaaaataagcgggaacgtgagagacgagtgtcatatctgggacaaaaggttgttttggggcgccaagtctgcccacacaagacttcagctttcaccatgtggcgcacttaaccgacaaattattttttggggggccgaaaaaacactacgaagggggggcacaccctttctgcgggggcacaccccggacatgtcaaccagatgggcccaggtgtaacagagaaacgacactccttgtaacactactgtgcgagcaaaaacacccccaagggttttaaacaagtgttgtttgggaattaccggggtataagacac

SEQ ID NO: 595712 - DNA, 934 bp, Homo sapiens
agcgtgggttcctgggtggggccaacaagatcaaatgaggcagtttattgatcttggtggtaccagctgatccgtcaagtacagggtctgcaaaatatctcaagcatggatcttaggagcagtttagggggagggtcagaatcttgtagtctccagttgcatgactcgactcctaaaccgtaatttctaatcttgtggctaattggttagtccaacaaaggtagtctagcccccaggcaagaaggtggtttgttttgggaaaggactgttatcatctttgttttaaactataagctaagttcctcccaaagttagttcaccctatgcccaagaatggacaagaacagcttggaggttagaagcaagatggagttggttaggtcagatctctttcactgtctcagttataattttgcaatggggatttcagctacttgggaggctgaggccatgagaatcacttggacccaggaggtggaggttgcagtgaaccaagatcacgccactgcactacagattgggtgacagagtgagactctgtctcaaacaaagaacaccacaatctacaaaaactctgtagcctaatggggaaactagatgctttccccactaagaacaggatccagagcaggagaagattcatgcgacagatggcagaatattggtcctccctagaggataccttcgaaagggacccttttacatactcatggattaatcccgcgaccgaattcgggagcaagctaacctaaagatatttttatggaaaccccgaattttgccctgtgcatgattcccttacactttctcacattccgattttaccaaagggcctcaactctcaactacctgctggcgtcgaacaagcggcaactgttgatgcggcttttccccaagatgctctcagaaaaacggcacgcacttcatcgggaat

SEQ ID NO: 595713 - DNA, 796 bp, Homo sapiens
tgaggcccagaagaaacgcgtggcatcctgcaccctggaaggtaccccgattgagctagtggcatcgtcatccgaactgggacgagatggagaagatctggcaccatagacttctacaaatagcaactgcggaccgtggccccggaggagcactccagtgacttggtagtacctgatggagcgctcctctgtaatccaccaaaggtccaacagaagagaacgatgatctccagattcatgtttcgagaccttacaacacccccgagtcatgtacgtggacatccaggccgtgcttgtccctctatcgcctctgggcagcaacaaatcggccattgtcatgtggactgctcgagacggggagttcgaccctagtacgagttgcgcactattctcacagatgtgcgttaacggcccttccctcgcgaaacggcctatcctagccgtttctgtggaacctgagtctggggcccgggtgaaccttcgaactcagtactgagccttcaattgaaaggtatccttgcaactcgaacggcgtacgggttcctccaatgactttgcgttccagcccgacgggcctctgcaagaccgggcgacaattccgctacgctgccgaaacaatccacaaggggaggaaaggctttggtgccttcacctgtcctggcccctggggactttcagacgccaagggtaacgattgtgcccgacccgcacgctcatttccttccctacctgttcttccttgggcagcacagaagcataacggatggatcgccccggaatgggcccagggtccgac

SEQ ID NO: 595714 - DNA, 845 bp, Homo sapiens
  misc_feature (40)..(40): n is a, c, g, or t
  misc_feature (225)..(225): n is a, c, g, or t
  misc_feature (325)..(325): n is a, c, g, or t
  misc_feature (388)..(388): n is a, c, g, or t
  misc_feature (502)..(503): n is a, c, g, or t
  misc_feature (528)..(528): n is a, c, g, or t
  misc_feature (558)..(558): n is a, c, g, or t
  misc_feature (568)..(568): n is a, c, g, or t
  misc_feature (573)..(573): n is a, c, g, or t
  misc_feature (590)..(591): n is a, c, g, or t
  misc_feature (604)..(604): n is a, c, g, or t
  misc_feature (606)..(606): n is a, c, g, or t
  misc_feature (619)..(619): n is a, c, g, or t
  misc_feature (628)..(628): n is a, c, g, or t
  misc_feature (632)..(632): n is a, c, g, or t
  misc_feature (636)..(636): n is a, c, g, or t
  misc_feature (647)..(647): n is a, c, g, or t
  misc_feature (658)..(658): n is a, c, g, or t
  misc_feature (683)..(683): n is a, c, g, or t
  misc_feature (685)..(685): n is a, c, g, or t
  misc_feature (740)..(740): n is a, c, g, or t
  misc_feature (749)..(749): n is a, c, g, or t
  misc_feature (760)..(760): n is a, c, g, or t
  misc_feature (777)..(777): n is a, c, g, or t
  misc_feature (785)..(785): n is a, c, g, or t
  misc_feature (810)..(810): n is a, c, g, or t
tttattttcataattatcttcctatagaaacaataatctngtatttccataacaacacatttaatattctactcatcagagttgggaaaaataggaataaagcagattccatacagaaataccgtactctgcatatgtacaaataaattcaatatattaaatctattttgtagctggacttcacttacaatgtaacagaacattgaatattagattctgagcatnttcatgcaaacttccactttggtgaaagtgatgacagtggagttctggaagacaattttccttgtaaacaccaagttttgcactttggactatgctctcnagatagaaacttacgtgagtggaaaaagaaaatgtataaatgtgaaacaaatattccttaccncacagaataaccctggcaacaaacgatatcccccagtcctggttattcaatcctccccgtgggcggggggggtggggggggctgcacctggacacagccttttgtgtggtttanngcgtagctgcgctgctgctacggantgcgcttcatcgtccccttttttgaaaggngttttccgtnctttngacgagtaacattcccnncttttttcccccngnctttaatgggtantatggtctntctnttcntaaatggtctncagtatctttnacgtattgccccctctgtttccccngnttactaattagctcaaatgagcattaatgtaagactccagaagtttccgattggntctaaaggntacaagctgcnatgatggggtctttganacactgcnatgtccttaaatgcaaatgtctacntatagcttgttcatagtttatcccaatatcattaa

SEQ ID NO: 595715 - DNA, 408 bp, Homo sapiens
ggtttgcagagagccaagataacgccactgcataccaacctgttcgacggagcaagtactacgtctcagtcaagacataacagcaaataaacatgatgtctaccaagtacaactccagagatgttcaaacaatagcttcgctgacagacaattaattatgccttctgacaatcctaatgtcacttcaaagacagtaaggagatgctaatctgtgtgttatagagaaagtggtggttaaagttgcagtatgcaggaatgatgttggtttgaaaggtaaaaggagctgagttcacagtttaattgtgtttgtgtgttaataccagaagatgcataattagcacttggaggttcagttaccagtaccaaactgagactttcttttgcaccaacaggacaaatgttgcgcct

SEQ ID NO: 595716 - DNA, 1175 bp, Homo sapiens
tgatcatccatttcagtaacactggctcgtcatcttgcataaggcgcgagagcgtctaggaaactctatgcgccatagaatgggaccgagaccgtaagatatcctgagtgcttgtcagggaccagatggtctgctgtaccgaggctattcagcatatgccgatttcagtgcacgacagagaccgtcaaagtacgtgcgtaaatgggcaatgctgtgttctaatagaactattataggccatggcatggttgctcacacttgtaattacagcacttagggaggccagggcaggaggagcacttgaagccgggaattcaagactagactgggcaacattagcaacgacaccgtactccacaaaaacttattaaattagaccgggtgatggtggcacacctgtagtcatagctactcaggaggctaaggcaggaggattgcttgagcccaggagattaaggctgcagtgagctatgattatgtcacttcactccagtctgggtgacagacgggagacccattactcaaaaaacaaaatagtcacttaaaaagcaggtggtgggccatataggaccatacaccgtagttagccggcccttatctacgccatccagagtgtcgagccagtgtcgaaatgggaaagagaaactggctagagtacattctcctaggacagaccttcacaaatgtattaaatcctaacattaaatactagattgtactcaatacataactggcttccaaatacctaattatacccaagaagattccaaaagaggagatcccctaacggccatgggaacattgacaattctctgacggctataaatggcatggaataagggagctacgcactggccataaaggcgcttaaacgcagacagaacgacgcacgagacccacagcgcagcgccgagatcacaccaggacaaggaaacacccacaaaaaaaaagcccgcaccaaaacacaaaaggaaaaagcgaacgaaaagagcggacacaagaaccaaacacaaaggcaccacacacagagagcagaaaagagcagaggaaacacacaagacacagcacacaaaccacagagccaaagccacacgcagaacgcagcggaaagagcagcaggaccccaacaaaacacagacaaaacatacgaagagagaacgtaagcgatacaagac

SEQ ID NO: 595717 - DNA, 491 bp, Homo sapiens
ctgccttgaactcccaaagtgctgggattccaggtgagagctactgcacccagcctatctcatcattcttactggacctatatatgtgtgggattttgaattctcctttgaactgattgtaacttcttgctagttctctcattaattaatgaattcaatgaaatctttgacacatactttttttttttttttttggtaagacacttgctgttttgcccaggctggagtgcagtgacacaatctcgcctcactgtcacctccacctcctgggttcaaacgattctcctgcctcaggctctcaagtagctggaattataggcgcccaccagcaggcctgactaatttttgtgtttttagtagggacagggttttaccatgttggccacactggtctcaaactcctgacctcaggtgactcacccaccacggcctcccaaagtgttaggattacaggcatgagccactacgcccaacctacttcgtggttttga

SEQ ID NO: 595718 - DNA, 156 bp, Homo sapiens
gtacaacaggatccctaagctgaaaatgcagatgaccacattcaaggaagaacctatctgtcccagacatttgcagaatgaaaagctttcctgcttggcagatattcttccacaagagagggctttctctggctctgctcctgtaggctggcgaca

SEQ ID NO: 595719 - DNA, 189 bp, Homo sapiens
  misc_feature (156)..(156): n is a, c, g, or t
tcattactggcattgggctgattctttcactgtttccacatagcttgtctcatgtgctcggtgaaaactttggttcttgcaactacaaaataacattcaacatgccccgctttgatggaaaggaagcaaccatttgataaaacatcaataacactnacattttggtagtaggctgaggtgacagggtgt

SEQ ID NO: 595720 - DNA, 615 bp, Homo sapiens
ctcccccccggttggaggcaccttcgggcacacctcaatactcgggctcccttcggctttttcgcccgagatccctaagaaggctggtgcggacgacccaagggttaaaaccgggccaggaaccagagagcccttcctcccttaggtccttgtcatttgatcctacaggatgcgtcaccatagccatccatgccaaacctgggtcccaaccaaatgctgtaaccgctctgctattcccttcctccaccattggaggagactccggagggcgtttcagaccggggtctctcactttgtcaccccggctggagccccgcggcaccacctcgggtcactgccgccttgacttccctggctcaaaccatcctcccacctcagcctcccaagttgctggaactacaaggtgcatgccacccacaccccggctaattttcgtattttttgaagagacgggatctcgccactgttgcctaggctggaagtcttgggcttcggtgatcctcctgccttggcttccccaagtgctgggattacaggcaatgagcccctgtgcctggcccgaattatttttcttactttattaacttcccataaaaggtttgggaccaaaaaatc

SEQ ID NO: 595721 - DNA, 105 bp, Homo sapiens
tccgacggcttgccctggtgcagtaccacggacaactacgacaccgacgaccggtttggcttctgccccagcgagagactctacacccaggacggcaatgctgat

SEQ ID NO: 595722 - DNA, 140 bp, Homo sapiens
gactagaggacctgatcagagcatacccctgaacttcagggcatatgtttatttctgtgctgaagttgttccattgttcaggtacagggattgaaacatatgtgcctgaagttcagggggaggcatatccaacagttagt

SEQ ID NO: 595723 - DNA, 180 bp, Homo sapiens
gtgtatcagtgatcctcggaacaacctatggtttaagggtgatagctggtcccatttcatagacccagtgagactttaagaaccaaatggcagggctggcgaaaaacaaaccacggaaaggtttcaggaaggttcccaaacttccccaaggggtttccttaccggcctttaaccttgggc

SEQ ID NO: 595724 - DNA, 345 bp, Homo sapiens
ctcgggtcccctgatcttccgtgccccatagttaatcttaacatcagctcaggagcagcgcagatgtggggatgactgcactctgggaaaccccttgcagccagtccttgctggtgtgcctaacatgctcctctaatatatactacgtatttctgaagacaaacaagttatcagcatatcatcatcaaactgcaatggtctctccatgaaaactcaaagcaagaatgttgatgtgaatgaaaactctgtgaaggcatatgctgcctggtttattttccacaggagaagcctcacatgtagggtccttgaagcctgtgttcaaattaattgtgggacggaagatca

SEQ ID NO: 595725 - DNA, 905 bp, Homo sapiens
  misc_feature (199)..(199): n is a, c, g, or t
  misc_feature (266)..(267): n is a, c, g, or t
  misc_feature (269)..(269): n is a, c, g, or t
  misc_feature (271)..(272): n is a, c, g, or t
gaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgggacatgtccaccccggctcggcggcgcctcatgcgggacttcaagaggttgcanggaggatcctccagccggagtcagcggggctccgtccgagaacaacataatggtgtggaacgcggannantnntcgggcctgaagggaccccgtttgaggatggaacattaaacttacaatagaaatgcgactgaagaatatccacgattaaaccactacagttcgattgtctctaagatgtcccatccaaatgtctattgcgcgatggtagtatatgtctggaacactacttcagcaaccgaggagtccaaccctatgatgtgtcttccattctaacatccatacagctctgttggatgaacccaatcccaatagtcagcataccgccaaggctgctcagacgtaccaggacgcaccaccggggagtatgaacagcgtgttaacagcatagtagcacaaagccggcgtgactggtagaacgccgggtaatggtccacagcaagctgactctcgacaacgagtttttggctggttgagacagcctcccacttcctgtagtaaccttccgatagtcaccctcagaacacggtgtctgcgttcacctcacggtcagatcctaacctgtacttctctctacctccatacactgtttacgtaatgtagtccggtgcggccaaacacacagattatcatagccaagatgaggcaggaaataatgcgaacaaggggcacgggcgtcatcagtaagaccatagttcgtgacag

SEQ ID NO: 595726 - DNA, 143 bp, Homo sapiens
gcgtttactaacgttgtatcttgacacactggtgttcgtcagctagcagcttatgttattcgccccatgccacgttagtgtcacaaatattatggtttctctcctgcaatcagactcaacatactttccgacgggtaccgagc

SEQ ID NO: 595727 - DNA, 113 bp, Homo sapiens
tgtatatttattgaacaactagcagcaaaaagtatctaaaatctgttgtgtgcaaatagtttttagatactttttgctgctagttgtgtaatatttattgaacaactagcagc

SEQ ID NO: 595728 - DNA, 1980 bp, Homo sapiens
gtgaaggccctgtgtgcaccctgtgggcatgactgacaaatgaaaagggccaggtctgtgaccaagacagcactccatgaagcagatggaagagctgatctgacggagcctgtgcctcactgtgctgcatcttgcagtggagggatacaacgttccagcccacaaagtgtcctgtggcatttataccttcacaggaagctgggtagccttgcgcaggagcatgtgagaataacgccccggaaacagcagggctacagcaccgtgtcccacttcaacattgtgcactacagacttgccatactggcttgcctgtcaggtttggtgctcgaggccgggaagagtgggagagttgcctgccctgcagaatggcaacaccaaagtgcaacgggactccttcctggtcttggggacctcatgtccctgaatcagctcatatgccacttgcttggccaagacacaacacttacctccaggactgtacagtgccagcgggagcccacgtatcagctcaacatccatgacatccacactgcttcttcctgcgcttcgcatggagcagctcgttcagctgcagacactgtacgtgggcgtgccgggagagcaacaatcccaactgatcccgtacatcattcacactgttgctttacgtcctgaagaaaacccgaagacacattaccgagaagcagaagaacacccaaggcttcttggacaagccaggaaaatggtgaacactcctccgtaattgacggccctaacacaacacagactgagccctcaatctgccccatagcagtagaccaccacgttcaacatttgtagatgttcaacccaacgcgacaaatatcagcttccaccgcaaaaaaacaagcaatcaacaacacaacaacgagcaagtcacatacatagtacaacaagatacaacaaacccccacaccttgcctctctaccactcccaccacatcacacacacaccaatacaacacccacaaaaaaaaaaaacaccaccaacaccacaccacaccaacactcacacaccacaaccactaacaccaccacagcacatccagcgagcacccgcccatcctagccgaagcgagccacagagaccagaagagagcaaggaacagcgagagcagcgggacagagagagagcggtcaaccgagctgaccgaagcgagaagagagtgaaggcggagagcggagagggctggagcgacaggacaccgagagagacagtgagtgaagaggcgcggagggaagcgaaaacgccagctggcagaagagcggagtcgaggagcgcaggcgaggcagcaaagcagaaggaggaacggacaggatacgagggatccattccatacacatcattactcacaccacacacatcatcaagacataacacacatccaagcaaacacaaccaccagacaatacaatacacgatgaaagaacgaacaactaacaatacaacattaagccatcacacctagctacgaagcgccgagccaatacgacttatactaaccacacaatctccaatcactacatcgattaaacctatccaattaccactcacatcacacacacactcgcacctcaccacaaaccacacccccaccacacacaacccaccacaccgacaggaccgcagagtaggacaagagcacactaaagccaccgaagattcagatataaggatatgaagcagagggcagcacacgattggacagcacacacagccaggagcacaaaactaagtgacacatggcaaagtacagacgcaagaggaaccaccagcaacgagacagctacgcacgaaacgccgactgcacgtacacgcacacgcagacaagaaaagagacacaagagacaagcgaagcaaacactagccgacacacagagcaccacgagcaagaggcaggaagagaagagcacagcacacaccgcacagccagaccgccgcaccagcagagacacagaaaa

SEQ ID NO: 595729 - DNA, 118 bp, Homo sapiens
ttcgattcacaatacgaaaacctggcatgacatgtgaagtcaggagtggctcatgagtcagctaaaggacgtttagcgatggggcgcactgccctttttcagtactgaaacctgtcgc

SEQ ID NO: 595730 - DNA, 302 bp, Homo sapiens
  misc_feature (2)..(2): n is a, c, g, or t
tntgctggaactcatgctcttctccacagagtttggacagagcagacagcagagaccatggagtctccctcgtgccctccccacagatggtgcatcccctggcagaggctcctgctcacagcctcacttctaaccttactggaaccctgcccaccagctgccaatgctcactacttgaatccacgcctgttcacatgtcgcagagtgtggaatggcggtgcttctacattgtccacaactctgccccagcaatcttttatggctacatgctggtacaacaggtgaacagagtggattggcaa

SEQ ID NO: 595731 - DNA, 676 bp, Homo sapiens
agaatatttattactttttgggctgcaggtatttccttcccaacctaccactgctaagactgtttcataagatgcactccaccacactcagctaatgaggtgtttcaatcagaagaagatctttggatgaagagccgaaatttgtataaagccttttattcaccttgggtgggtatttgggaacatcttgagctgaaagcgttgcatggaaactgctgtgtgaaatttgatcaggaccaaggtattcagttctatgcctcaaagactgatttattttttcccccttgtacttaacatttaacaggtggtggagttcctgggggacacatctaaattggggcgaatttccaggattgaggcaaccccgctcccttttagcccttctactaaaaacactggagctaggctggcgggcatttgacccttataagtataacagggattgaaggggcgcttgggttgaaccagacccaaagaacccccccctagcatatttgcccttggacggctggaaggaaccccttggtctgttcataaaagccaaccgggttggcttcttgtgtgcaagccttggccccccaggaaaaaaaggcagggcttttggggccccccctcaaaaaaatttttttccccggctttggggggggggcaaaggtcctttcccttctttgtgaaa

SEQ ID NO: 595732 - DNA, 1024 bp, Homo sapiens
ggtccagccaaacggcctcggcgggaactagaggagcaaaggcctcaatggagtgggggtggggggcctggaggctggacctgtggacctgtgctcagtcctggttccctgatgctgtgatgaatacggtaggtcccacatgaatgaaggaagcattggggaacgtcaatgtgaaaacagttccccatgtgcgaccatgtagtgatgctgctcacttcatgctcctgatccacctatgaccttgaggctgccatagtcagcatgattaatcacagagggcaatcaacgctgagtatttacccctagacaagcgtaattgcacatgagggaagaatgctactcatatcatgacaagctcagctcttgaatacccgtataatgaaaataccattgtccagggtgtccctggtgcaaactgggcttttagcatggccttagtgtgtggccccatggtcctcacattgagcccagatgtggggaacccacacttatgaggcttcgggcggtatcccatgtagcccctacggaggccccaaaggggtggtcccaaccggagtccgggcaaaaaagctggtcaccgggctcgaagttatccttatcattgaaacctcctttgaccgaggattggacagggacggcgccatggaaactaagccaaaccggaactagcccggtcaccagggcccataaggataccgcccccgaagggggtgcgcgggaaactccttggtgtaattcttgggcaggtgaccccaattggggtgccccctttcattaggcggtacttaaaccccgggtggaatagcctaagtccatatggtcatttccccaatccgatggaaacaacctaaggaagggcgcctttccaactatggaactagcggggggatttcggaaccgcgggaggtttgggcaacgcggacatctgacggtgagacacctacagctagtaagtgtaggcaccatccgtcgacgcttagggtgcggacatatagcactggactgtaagatgggcagtcccgcc

SEQ ID NO: 595733 - DNA, 160 bp, Homo sapiens
tcttgagcggactagctttcgctttgacttgtgtgtgcacgcaatccaaccggcacttaccgttcaatggcgtcccgcagcgacttaagttatctggaagttgtgaagctttcaggctcaaacgaatagcattcattccgcagccaagaccgctcttacc

SEQ ID NO: 595734 - DNA, 164 bp, Homo sapiens
tgccgccgcagccaggctcggctgccgggacagcgtctggaaaatctgcatgtcgcgatagcggtccatcaggccggccgcggcatcgacgggttaagcgcagcatcctgccccagccggctgaccaaaaaatccacgaacgtgttgacctgggtaccgagctc

SEQ ID NO: 595735 - DNA, 448 bp, Homo sapiens
gacgagtgttgccagcacctttgatatggggaacggatgcattattagctcagatctttgggtgtggtgactcatgcctgtaatcccagcactttgggaggcagaggtgagcagatcacctgaggtcaggagttcgagaccagcctggacaacatagtgaaaccctgtctctactaaaaatacaaaaattagggccaggcgcagtggctcacgtctgtaatcccagcactttgggaggctgaggtgggtggatcacctgaggtcaggagtttgagaccagcctgaccaacatggagaaaccccgtttctactaaaaatacaaaaaagttagctgggcatggtggcacatgcctgtaatatcagctactcaggagactgaggcaggagaattgcttgaacccgggaggcagaggttgcagtgagccaagatcacgtcattgcattccag

SEQ ID NO: 595736 - DNA, 507 bp, Homo sapiens
ggggtaaacatccaaagtggcttctgccacagtccaccacatggagaaaatgaagctaacagggaggaaagcagcctctagagagagggaaaaagaggaagagagacggagtcctgatgatgttttagctcctggatacagctatgcctgaagccctcacgctttcatctatgttagtcaataaatcctgcccgtctccctgcttttttcttcttgagccagtttgggttacgttcatgtcactgcagttcagagtcctttcatagaaatatcaaatgcagtgagatgcactataagcattgctttttgttttaggttttttgtttgtttgttttgcagcagagagactaaaatgttcttcctcagaggtagcaagtctccttagagcagatgtgttttggaggaaaataatcaatgattctttggtttgccaaatgcaaggcaaatactaacccagagttctggaaaggccttgaataaaagagttattcatcctaaaaaaaaaaa

SEQ ID NO: 595737 - DNA, 934 bp, Homo sapiens
ggttgagaagctaagcagacatcaggactaccagctgcagagaggagctacccactgtgggcttcgtctctgctgagagctgaacactcactgggacgccctgcctatggaaaccagctgttcactctgggtctcctctgagctgttctgtcgctcagtaaaggtcttcttctgcttactcgccctccattgtctgccttacctcattcatcctggacacaggacaagaacttgggacttgccggtatggtggagctaaaatagctgtaacacaaacaggattgaaacatgccccttgctcgccacatgtggatgacaagagggagggaagaaaggagagaagatctgcgaccttcggcaaacccagacttaggagatcggagagccaagactgtgacaccctttctggggctctgtggttcctggcgtctccaagcttctgggcacctcggctttccccggtgccagtcgtggaagctgcttgtgcagagtcttgctttgtcacccaggctggagtacagtggcgtgatcacagcttactgaaacgtctgcgtctcaggttcaagcgatttttctgctcagcctctggtgtagctggaatacagtgttagcagtcactgatgctcaaacatgagaagactgggacatccatcagatagaaacgctgcccaagtgttagactattaagtgacaggggtggcaatggaaccaacaatcaaccttccggaaaaggaggtttaacatagattatgtaatcttatcagaaaaacgcaatgtcgggcggtgggtaagcctggatccagcctttggaggccagggggggtctgaggcgggaaggaaccccgtggacaggggaccggctgtaaaaaaaaaccggggggggggggcccacaggggggagaagcacccccgggggggaaccccccggggagga

SEQ ID NO: 595738 - DNA, 119 bp, Homo sapiens
  misc_feature (41)..(41): n is a, c, g, or t
  misc_feature (44)..(44): n is a, c, g, or t
cctggctgcccttcctccctggctgtgtaaatagtctcccntancccactgagggggttttgatggcccttggagatcctacagtaaataaaccagatcctgccgcccaaaaaaaaaaa

SEQ ID NO: 595739 - DNA, 218 bp, Homo sapiens
gcggggctggtccacattcccaggccccaacagccttcaaagatgggtaaaggagctgccctccctgggccccccaccttggtgatcgccacacccagcctgtcccgtgccaccaccgtcctagatggtggacgtagtgaactgacttgtaccgtgtgaccctcaattacatataacagtgtgatcaccgccgagcacaaaaaaaaatagatacaacg

SEQ ID NO: 595740 - DNA, 158 bp, Homo sapiens
attaagcatgccgcagttatgccagagcatagtaaataaaggtcaagtagcatttatgatagaggaagtattgttagcccgagcatgagtgtaatggtgaggtgagaaacgttgtcttgtcattataagaataaaaaagggaacgtttatgagggaaa

SEQ ID NO: 595741 - DNA, 326 bp, Homo sapiens
tgggtggagggggggggggattttgggattggcagagcctgcctaccgaggcgggacgcggtggcataattgtgcgcgatgcgtgccctgcctaattatcactctggaaggtaatcttcgaagattatggcagctgtcaggggtaacaagccagtgattctacgccacattactggagaaccatgggttctccttctgtctcagcgacagtggctgtctcttcttgttcaatacacacatgcacatggacgtgcacacacacgtctacgcacaggcgtgggcccgcacacagatatacacacacagatacacacacacgtcgacgc

SEQ ID NO: 595742 - DNA, 1070 bp, Homo sapiens
ggcggcgcagattaaaggtccagcagaggcactgtggccctgcgtcggctctgctaggaactggctgacccaggaattttagcgcccctgcgttttactcttctgattcttctcttctcccaagcccgtgtccctcacgcgtggcctctctccttgccgggagggccgcgatggaggtcccgcccaggctttcccatgtgccgccgcattgttcccctccgctcccgctactttagcctcccgcagcctctcccattggcggccgaggccgccgcgggcagctagccccgctcctcccttcgctcgctcccagatccgtccggcagggggcgcgccgagcccagtgccaggtcaccgtccagcagtcctcccgattgtgcgggcgggccggctataagagggagggcgcaggcggcgccggatctcttacgccgcattttaatccagctccatacaagcggctccgcctgcctgctgctgcgccgagaacccggaagtgagcgcaagcacacccctcttgccgagcagtctcccgtcactcatgggaggcatattgaaccgaagtaccagcaatataagaggaacaattcgcaggagcggattcaagatcactcgcgagcatagaatcagcaggatgactgtaaaatgtttatatggaccgctgagctgccattcaagccacagaacgatctgacagaagtacttggcctcgactaggggaagattgacaactgccaactacaccacatccccgtaccgtgggcagactaagaacgcattcggattgcgaccatcaaagatgctgggaagattgatacagctttggcactcgacaagaaaccactgattgaatggtaaacccaacaggccaacctataggaacaactccaaacgtttgtgtggccgtcctgacacttacaacaaaacaaatcgcacggcgaacagcatcatctcgtcatcacaacgagcgcgctacatatgcaacacatgtagcaatcatgaacaatcgtacagtctccatctaaaccataagactcaccatcacacacatacatatatttctgcgtgcc

SEQ ID NO: 595743 - DNA, 894 bp, Homo sapiens
ggtgacgtggtcttgggcggctctcgagtggttgagcacgggttacggacacccattgcaagacgtgcagtgactgcacttgtcttagacagttctcgctgacctgcgctagctgcgtgcttctacgctccgagcactctgagtatcatcagcaaacgccctgggctgtctgtcctcaccatgcctagcctttgggaccgcttctcgtcgtcagtccacctcctcttcgccctcgtccttgccccgaactcccaccccagatctgggctgcctgcgctcagcctgtggggtctggcagaccctgggaggaggggttatgacctgctccacgagcctggagagatctgggaattgcagagtaccctggacagcagcaacagtggcattcgggccgtgacgcgacaagacaactggagttaccatgggatggtggtgtcagtactggcctgacatacagagcttgcctcatgtgaccctgatggactgaaccaattttgtgtgcacaaacacttgatgcaagctgcctatgcagaggagacgccactggtggaccaaggcgctgaatgggaatctcgaacagccactgcagccgcctggcttgattgcctaagacacagtatgtgtaaagaacagtgtttgttgccacaagaaaattaaactgcgacccttctgactaccatgcagtagatccgttgatggggaccttgctgtgggaatgaagcactgaagaaaacgaactggccgagcactcgcatggaacagaacttgacaccaagcgtggagaccaaatagaatcgaacccccaccatggtcgccaactcacgatgaacactctgaggcactggccacatacttgaccagaacaggcatgaagaacgacaaacaccaaactgc

SEQ ID NO: 595744 - DNA, 123 bp, Homo sapiens
aaaaaaaaaaaaacctttaagcaaggttgttcccttaaagccctctccttcagaaatctctcttttggcaaattgttgattcttccctttttaaaccaattgacaaccattgaattcgttgtt

SEQ ID NO: 595745 - DNA, 118 bp, Homo sapiens
ccccccccccccccttggggtttttttttttggggggtttaaacccgggggtaaatttttttggtttccccgggggggggtttttttaaaaaattttttcgggggcccccccccaaga

SEQ ID NO: 595746 - DNA, 130 bp, Homo sapiens
  misc_feature (12)..(12): n is a, c, g, or t
ggcaccgaatgnaagagaaagaaggaaggaaagaaagagaaagaaggaaggaagaatgaattatggagacagcgatggtcaggtttttaattcagtaaaaaccacaaaaaacctttatttctctttcttt

SEQ ID NO: 595747 - DNA, 160 bp, Homo sapiens
  misc_feature (34)..(34): n is a, c, g, or t
  misc_feature (72)..(72): n is a, c, g, or t
  misc_feature (132)..(132): n is a, c, g, or t
  misc_feature (156)..(156): n is a, c, g, or t
tttaaagacaaaattttctttccttgattttttnaacataagctaaatcatattagtattatactcccatanaaacttgacatgtgcttctctgaaagaattatttccttctgaaatgtgcccccaagcctncctaaataaaaaaagacaaattcnaaaa

SEQ ID NO: 595748 - DNA, 847 bp, Homo sapiens
tcggactaagagagagaagatactagcacaactgcaatgcgagccagtgcaaacgcttacgcgccgatacgtcaagacgactgggcaatcgcacgggtatctgtctggaccccacccaaggtgcctggcccagggcaccacctctgggcaggcggctacccacgggcttccaatcctgcgcctacccccggcagcaccccagggctattcctggacaggcacctccaggcgcctaccatggagcacctggagcttatcccgggcacctgcacctggagtcctaccccgggccaacccagcggccctggggcctacccatcttctggacaacccagtgcccccggagcctaccctgccacctggcccctatggcgcccctgctgggccacctgattgtgccttataacctgcctttgcctgggggaagtggtgcctcgcatgctgataacacattctgggcaccggtgaagccccaatgcacaacagaattgctttagatttcccaagagggaatgatgttgccttccacctgttaacccaccgcttcacatgaggaccaccacggagagtcacttgtttgcaataccaagctggagtaataactggggaaagggagagaaagaccacgtcggttttcccactttgaaaagtgggagaagccacattccaaaataaccagtactggttgaacctgaccacttcaaggttgcagtgaatgatgctcacttgttgcagtaccatcatcgggttaaaaaactccatgaaatcagccaactgggaatttctggtgacatagacctcacccgtgcttcatataccctgatataatctgaaaggggccagatta

SEQ ID NO: 595749 - DNA, 700 bp, Homo sapiens
cgatggttgaaccgtgactgataagatttcacaagggagcaacattgcccagaatacggtaagctttaattagccctcagtaaggggtcggaaagcgggagccccccccggtggcggcccctttaggctagttggatccccagggctccaggaattccggcacaaaccaaaactagtctccaagttcattttttttcttttttaagatgaattcttcctgtgtcaaggctgaagggacacaatctcagctcagtgcaacctccacgtcccaggttcaagagattttcctgcctcagcctcccaagtagctgggactccaggtgtgtgccaccacacccagctattgtttgtatttttagtagagacggggttccaccatgttggccaggatggtatttatctcttgacctcgtggtccacctgcctcagccccacaaagtgctgggattacaggcatgagccaccatgcccgaccagaaaacttttttttttacagcagcaaaacaccagccctgggttacagtagcaagaccccgtgtctacaaaaaaaatgtaaaaatttgtctggcgtgatggtgagcacctgtaggcccagctactcataggctgagctgggaggattgtttgagcctggcaggtggaggctgcagtgagccatggtcacaccactgcaccccaacatgggccacctagcaagatc

SEQ ID NO: 595750 - DNA, 113 bp, Homo sapiens
gcgggtatgataggggtgtagagttgccttgtggtagaatgtagggctagggcatttttaatacttagagcgaaagcctataatcactgcgcccgatcataaggggataggca

SEQ ID NO: 595751 - DNA, 854 bp, Homo sapiens
tgagtgctgtctgagtgggctggactggaggctggctgtgtgtgcggtgtgtgggagcgggagcgggctgggagagtggtgtgagctggggccgggagtgtgagcagcctgccgcggtgggactggaccgagcctcgccggcgcgccctgcccgcatgcgccctgcggagcgcgcagcgcggcctgagcgcgagacctgccgagcttggtggactgaggcggcggtgtggtgcgcgtcaaggccgcgacgatggcggctgagacaaattttacatgtattggagaccagaccagaagcccttctgaattaagatctcacattcttgaagtggtggcattgaagagcactaagatcggaagatgaggtgagcttgacccagttacggcagtgatggcctgatgcaagcttaagaaccagattcgagacgccaggaaatgcattgtgcagattgcaactctctctcagatcacaaacaacgatctgacccagttgggaagaatccaaatgcgcactgatgggaggaccactgcgtgggtgcaccttgtgccaagatctaccgccattgcactgaggaaacagaactccaaggcttctcggtcaagttgcctcgcaaagtgatggtaaacgttatcatctgggaacagatacaacaccaaaaaggttccacggccattccctctgacgctccctccttgtggtcaatgaccttgtgcattattcccctttcttgggaaactatgtgggccttgcgggtggccttgaaataccatttggctccaatatacaatctgaaaactcgtgagggtgaaaagtgctgctttaaatcaggagctgggaggaaacacaagtactg

SEQ ID NO: 595752 - DNA, 467 bp, Homo sapiens
tagtcagcggatcccgttgggtcgatcactgtactctgatgatagtttcattttgcgtgcagaaagtctttatctttaattagatcccatttgtcaattttggcttttgcttcaattgcttttggtatttttgtcatgaagtcttttcccatacctatgtgctgaatggtattgtctgggttttcctctagggtttttatgggtttgggttttacatttaagtcttcaatagatctcgagttaatttttatataaggtataaagaagggttccagtttcagttttctgcatatggctagcctgttttaccactaccatttattaaataggagatccttttcccattgcttgtttttgtcagatttgttgaagattaaatggtttaggtgtgtggtgttgtttctgaggtccctgttctgttccattggtctatatgtctgttctggtaccagtacagtgatcgacca

SEQ ID NO: 595753 - DNA, 559 bp, Homo sapiens
  misc_feature (15)..(15): n is a, c, g, or t
  misc_feature (53)..(53): n is a, c, g, or t
  misc_feature (69)..(69): n is a, c, g, or t
  misc_feature (92)..(92): n is a, c, g, or t
  misc_feature (94)..(95): n is a, c, g, or t
  misc_feature (100)..(101): n is a, c, g, or t
  misc_feature (104)..(104): n is a, c, g, or t
  misc_feature (108)..(108): n is a, c, g, or t
  misc_feature (244)..(244): n is a, c, g, or t
cgatcctccaaagtnacacagagtgcctgcttcctggtcccctcagctctgcntctgcagcccactgcntgcccagtgccatcaggttgagnanncccgnncangcanaatgacagagagaggcagatttcagggaagccctgactgtgtggagctaaggacacagtatagattctctggcactctgaggtctctgtggcaggcctggtcaggctctccaggtggtcagagggcccagtggtgncccagcatcggtggtgcccaagccaaccctgtgactgacatgtacgattcactcctttgagtctttggatgccaactcagcccccgtgaccgtggatggcatgccggccataggccgtctatggtatagatgccccccacgtgcatgacattgaccctgtgtagacttgctggcttatggatagtagatttgtacgggtcttgagacctcgggtggggcattcagatgagcgggttatttttaccggctcgagtttccccttttattaatacattcacccagataatcattaaaattaacatgtgccaggtctta

SEQ ID NO: 595754 - DNA, 194 bp, Homo sapiens
caataatcacaaagtataacaatgaaagataaaaagagaaaaataatttgtgtgtgtgtgtgtgtgttgtttgcatgttaacgtctatatgagataactctatcaattttcaaagaggatatcactatattttgacataacagtttcagggatgtcctatgtcttccgtggtaaagttgtaaccagttataggt

SEQ ID NO: 595755 - DNA, 994 bp, Homo sapiens
  misc_feature (67)..(67): n is a, c, g, or t
  misc_feature (340)..(340): n is a, c, g, or t
  misc_feature (410)..(410): n is a, c, g, or t
  misc_feature (629)..(629): n is a, c, g, or t
  misc_feature (696)..(696): n is a, c, g, or t
cgtctctgtgtccgtgcgttatgcaagcagactagctcaggcatcacgcgctactacaaagcatganagcgagacaaggaagaacattacaatagcgacgcacgccgcctcgcgggaccaccgcgtggtagcagcgctgcaagcacaattttctctaaagagctacccgctaaactagtcgttggtcagagtgtgcgcgatgttacacatttaatatcccttaagttagacaaattcaccttagatggtctccctgggagagaaagataaggttttcttacacaccgcggctgtaaggtatctttctcttccgcgagtacaaaatgctttctaaaacaantttgtggacaccggctccggcgccgccgctttaactccccaaatagctgcacttcttttctatgtacgangcaatggggacgcctcacacgcgtcaagcgtcattgttaaaacgggtcgggggataaacaaactttcacgcggtgtttttaaaagcagcgggttcaccgcccaggggggtttcaaagccccgtggtattcccatagctcccggggggagtgggtgctccttcaaggccattgtgacggccgtttcttaacgcgccgcgcctaactgggaaagaatcttntatgtggagatgcgtagcgagtggacccctttggacgaaaaattgaaacttttgaagtggcaaacangcgtaaacacacatcacgtgatagcacacataagcataagacaaaactacaggcactatgtagaagtcaacactactttctcaaagaatcaaaagactattttaaccccgcaaattaggaaccccaaaggcgatagcccaagtatggcgacccacaagatcaagggcccaaatgccccaactctcagagcaaatctgggaagatatgaacccaaattatcaaaaatcaacaatgtcttcccccaatttccaaaaagaaagacccagttaaaccaattttgggacaaacaacaaaaaca

SEQ ID NO: 595756 - DNA, 156 bp, Homo sapiens
cggacgtggagctcggacgtgggtgggcaggttagtctgtttagattattgtgccgttacagagaaactactagaggctgcatgagaaaagacgcctgtctcgtacttctcccattgtcgtatccagtgaatgaaaggctccgtatatgctctctg

SEQ ID NO: 595757 - DNA, 724 bp, Homo sapiens
  misc_feature (525)..(525): n is a, c, g, or t
  misc_feature (620)..(620): n is a, c, g, or t
  misc_feature (663)..(663): n is a, c, g, or t
  misc_feature (678)..(678): n is a, c, g, or t
atcccccgggctgcaggatgctttggggtaccctcgtgggagagactagcactcaggagtgggagccaaggaatccacagccccccaccccccgttaaggtgcagggcgtgccgaaaaggcactggcctccgggggaggactccagcctcctctttggccttgccgctttaattccctagcctgcctcaacgtccccctgaaaggttgcaaggctggcgtcctgtcccggtcaggcggggggagttcttcccgcttttgggtgggccccacacaccctgaggtgccagaaactctacagccccccagggtcccgcacagggcctggcaataaggcactggcctccgagggaggaccccaacctcctctttggccttgccccttgttttccctggcccgtctcaatgcttccctggcttgcaagcctggagtcctgtccccatcacccagggggacttcttgccactatgggttgccttccacgcaccctggggtgggagccagggactccacgcaccccccggcncccagtccagcacaggtcctaccaggaaggcactggcatccaggggaggaccccagccttcttttcagtctcgccactatttttccgaggcctgnctcaatgttttcctgcaagcctgcaagcctggcgtcctgtccncatcactccaggggntttttgccgccaggggtgccccacgcagcacagacacgcttctggg

SEQ ID NO: 595758 - DNA, 885 bp, Homo sapiens
  misc_feature (885)..(885): n is a, c, g, or t
attgaaagaaggaaagaagttgaaagcatcttgaagaaaaactcagatggatatgggatggtcaagtcggccggaaaatattccccccaagggagttcctctttaaacacccgaagcgcacggcaccctcagcatgaggaacacgagcgtcatgaagaaagggggcatattctctgcagaatttctgaaagttttccttccatctctgctgctctctcatttgctggccatcggatggggatctatatggaaggcgtctgacaacctccaccagcacctttgatgaagaactggagtctgacttggttcgttagtggattacttctgagcttgcaacatagctcactgaagagctgttagatcctggggtggccacgtcacttgtgtttatttggttctgtaaatgctgcgttcctaatttagtaaaataaaagaatagacacctaaaatcatgttgatctataattacacctatgggatcaataagcatgtcagactgattaatgtctactgtgaaaaatttggtagtacattttcattctgatattagatataatatctgatatcaatcattttaatatactagtcatgatgtgtgtcgtctttcaaacattcatctgcaccctaattcagctgaagtactgctatttcaccacgacatgctacctggtattaaatcgcccttagggggttggccccataaattggggtctattcaccatgggacaagttcccaacgcggggggggccacaaaaaagattatccggcgggtcacagcaccacagacgccagccggggcaaaactcttgtgagaaaacctcaagcacgacaggggccagaccatcggagacacgcggggtacatattaaacaacgaacaacgcn

SEQ ID NO: 595759 - DNA, 136 bp, Homo sapiens
tgttgcaacctcaacctgcaggagccgtgtaggaggggtcgggagaaatcaggctctcgaagctcattaaattcaacgtgaggatgcatgtacaagaacgcccgaagcacagtggacggtcatgaaggagcggagg

SEQ ID NO: 595760 - DNA, 152 bp, Homo sapiens
cctttgccttggatccctgtagcccagcaacctgccctccccagcatccagctgggcagagagagccgagtgtgccaacaaggactggggcctgcctggctgcccgcctcagtgatgggcacctcatgcctgtctcgccacctcctgtgcca

SEQ ID NO: 595761 - DNA, 399 bp, Homo sapiens
gctcgacatccgtattactcgcatcaggagtatctatcgactgaggctcacatagtcttattggaaaccaccggaaccaaataattcaaggcctggtttattacaattttatggggtcttttttttaccctcctacaggcctcggagtacttcgagtctcccttcaccatttcggacggcatctacggctcaacattttttgtagccacaggcttccacggacttcacgtcattattggctcaactttctcactatctgcttcattcggcacactaaattttcattttacatccaaacatcactttggcttcgagccgccgcctgatactggcattttgtagatgtggtttgactatttctgtatgtctccatctattgatgagggtcttaaaaaaaaa

SEQ ID NO: 595762 - DNA, 375 bp, Homo sapiens
gtgattcccatgcctgaacttgttgagtatctggattacaggtgtgcgccactacacccagctaattggtgtatttatagttcagacggggtttcatcatgttggccaggctgatctcaaactcctgacctcaaatgattcaccagcctcggtcttccaaagtgctgggattacatgtgtgaatcaccatgccatggctgtatttatgtaattaaataattcacacttactagaatacgttattcctattctgtgatatattttttaccttctgtattaatatgcaactgtcatccagtgtgcacttttgaggtcccttccttctctattcttacttgacatgtctgtcattatcatgcatgtttctataccttt

SEQ ID NO: 595763 - DNA, 469 bp, Homo sapiens
tacctccagcctcctcccctcaaacatccggggagggggtatggtgcaatagtaagagcatgagctctgaagaccagggtccgaagacattaattctgggataaatatcactggacagctgtgtgacatggggcaagaacctagttcttttatatgtcagttaaaggactgtaaatgacaagggcagggtctgcctcatatggctgtcccagggggtatgagtttgccatggtggcttaaacaaatcaccacaaatggagtagcttaaaaggactcagacatataatcttacagttctgtacgttagaagtctgtcacaggtctcacggggctaaaaatcaaggtgtcagcatgtctgtgttcctggctagagactctgcgggagaatcggtgccttggccttttccagcttctagaggccacccacatacctgggctagcggcccccttcaggtagagagccgggcaa

SEQ ID NO: 595764 - DNA, 946 bp, Homo sapiens
cgcccgatatgagaattaagaaagaaaggggaacacgtaccatagtcgggtgtgccttgcacctgctcacaccgtggtcttctttgtgcagcgcagtgtccaactcactcttcatgggttgtctcttccaggtcaattagttcccagttttcgctaatttctgcgtttctgttcctacccgcgacttgggaacactccgtcagccatacgaacgttctttcagaggtcccagaaacatcgggttctggccttcggcaaatcattgccttcgtcacacgttcccgggtagtatccccaaaccccgttgcacagcttctttcaaaacttgcgtggtcatactccacgacgggcttctcaagaacccgagggtctttacccgcccacttgttcacccgtcgcagcagcggttgcaactcatctgcacccactctgttgacagctccaccgcaaaaaaatatgtgctgaagtctgattgagcgcaaccccctgtgtgcgtaggggggacatccccacccaccaggtgtggatcccacgcaagcttaatcatgtgtattctagaaatattgctggggggctgtcaaatctacatgaatgaagcacccgtcgacctctaagagcaagaacacacgtaatatggacacacctccggggcgcggagaggcgggagaatcaccccaatggtccaggatgatacaagacgacacccgcgcacgacactcaggggaatccccctctcttcctgtacaaaaaccccaactgaatcaccggcacgacgtgggtcacacgccccggcaacccacccctcctcttcaggcgggctgagaggacacagaaggactcggtcataaacccgggagacgaggtaggatgagagccgtgaccaagacggttcgccctccccccccacctggcacaccaaagggggaaacccccgttccacaaaaca

SEQ ID NO: 595765 - DNA, 106 bp, Homo sapiens
taactcacaagagtagagggagtgagtatatttttttcccacatggaccactatttttgtaggaccctagaaaaacttgataaggctactgtgactgaagaatctg

SEQ ID NO: 595766 - DNA, 418 bp, Homo sapiens
gtgtcctgagcttcaggtgatgcgcctgccttagcttcccaaagttgggattacaggcgtgagccactgcacctggcccacatttgtattaaagtattgttttagaaaagatttgtgtgctgtgtattgtcttttaatgacctggttaaaatacttaattgatagttatctgtacgtgtttaatctttctcaaagatcagtgacccataggtgaagagtgcaaagtttgatttacaattgggttattcgtttattcatattacagatacttcatgaaggaacagcagtagcaacaaaaaccccggactcattcttctgaattaaatgggtgcagattggtctggagactcttctgctgccctctagtgtttatatcatgagtagccattgaaagttggaagctgcacattgctgtgcc

SEQ ID NO: 595767 - DNA, 944 bp, Homo sapiens
tatagcatagggaagacaaaccagttcttaataatgtcaaagttggacccaatagagacatgctaagcgagtacatcatgctaggaagaacagctatcactcagctgcctatacttcagccattctatctttcacaccaagaacaaaagtggctagagattgttttaaaaaaatacaagaattgccagtacctttggcagagactttgttcacttagattaggcccgcaaccgcaaggtaatgggtcatctagttgtgagaccatatggagatcgctgagtagctccacatacaaggtgaggtacactgttgccaactttgagggcagaaagcaatcagagtaaacgtagtacgactgcagatgaacacgctatcgatatcaaaaggccaaaaaaaaaaacctaagttccagggacattagaccttggtgaacactgccaagtgaagaactggtgcttgccaaaggtagtctcttagcatataaggaatacgtgaaacatcagctggcgatctgctcatattcggttcacgtgtctgacgacacgactacacaagggacacgtccaaagtacttaaacgagaccaaatttgaaccttaagccacttgagagagtaaccaattccccctgaaaatgtaagtacgtgtcatatcctggggactaggggggaaggtccaagcaatatgtaactggcgaagaatggctgggaataggttggtgccagaagtaacgggtttacgttgcaacgttctacacctggtttgtacaacacacacagggcagcgaaacacaagaaaaataaagccagcacacaccgcaagaacataacaggagacaacaccaaagagcacacaacaaaaaaaaaaacggtggcgcggaacaacaagaggcaggcgcaatgaatactacagcgcggggtaaaaaaagcgggaaatgatatataac

SEQ ID NO: 595768 - DNA, 730 bp, Homo sapiens
tgcgacgctgagtgcgcggagagtacggcggccggcgacgtgagcctgtggcggggcggcggccatcgaaggagcgcgcgggcggtctggccccgcccctccccgccgccttccctggtgaccttcagtggcccgggtggctggggcagtgcccctggggggggggatgtcgtgcaggaggagaagatcttcgcgggcaaggtgctgcggctgcacatctgctgcgtccgactggcgccgagtggcttggaggaggccaccgaggacacctcggtggagaagctcaaggagcgctgcctcaatgcactgtgctcattgggagcttagaagatcccaaaagtataacccatcataaattaatccacgctgctcagagagggtgctgaggtgatgccaggacacatcctggaagagaacatccaggacccaagatgtcctattattcgataaaaaagcgtgctccatcaccactttcccaagatggctgtgtctcagcagaagaacgtgacaaaacaagaccagaaaggctccgaagataaagaggccatacttgtgggccagcggcaaactgccctctagaaatgaccgggcgtggtcgagaccaacatgagagacttcagacagaatccggaggatagtggtgtctctcaatcgggtgggcagaagtgtacggtgacccagatggggtggaattgttaggaggggaatgatgtgagagagagatagtttc

SEQ ID NO: 595769 - DNA, 92 bp, Homo sapiens
gattagagaagaatctttctcataggcttggtgaatcccagaccttgctggcagcagcagttgagagagaacggtcagctacagaggactct

SEQ ID NO: 595770 - DNA, 113 bp, Homo sapiens
cgttatacgcgcacgtgctcagcctgccaggcggtacgtcccagcgccttccaggtcttgtccagccgggctctgtacgcctgtagccagtcagcccagtggccctggttcct

SEQ ID NO: 595771 - DNA, 535 bp, Homo sapiens
cacgagggcgattctccggcgactgagcattacgcgcatgagtcaccatggcgccgatctgcacctgaccgtcagtgactttgatttgcgcaagggactcgatgcgccccaagtcaaccagcagagtgggtgacgcgaggcgcaacgccagcaacggcagcaagctctgtccgcccgccagtggacggctgtcctcagtgtcagacagcgcttgcacagcctcgccgaccgtgctgggagcggtatacgagaatgcgggaaatttcatgccacacctctgctttagcttgctacccggccgcccggcttcgccagtcctcgaatagcgaggccactgtccgcagtgaagatcgatccggtgatgtgcccggcctcccgctccgacgccagaaatgcatagagcccgccatacgcgtccgcgctcggaatggcctgtagtggcacattacgctctgtgcccggcagaaccgcctcctttggagtttgattgagctcccggacaccgctcagcgtcgtgggcgctacaccgggtgca

SEQ ID NO: 595772 - DNA, 339 bp, Homo sapiens
tgcgaaagtttggggataggagatgcctacatggtatttcatgtattctcttaggtgttgggggctagaccgaggaaccatgctgctcactcactcacgtacgtcctcagctgcatgcaaggattgagctgggttaaaaccaggcagaatcagtgaccctcacgtcgcggcgttaattaagcatcagggtcctagctttgtcctgaaggaggggaggcaaggtctaggtgagagacgttcgtggaaccagccagtggggtggtaggtcgggaggtagatgtcacatgtcagggtcacttggcctgaatggttttttggatccagttcgtgtatctgcag

SEQ ID NO: 595773 - DNA, 469 bp, Homo sapiens
  misc_feature (297)..(297): n is a, c, g, or t
taccttgataactggattaaagtgatgttctgcactgtaaagtgactgttgttctgctttttaattttacttgatagaacctagaaatgagtcaccaagtcatatcccatattctgggggaagggaattaagctcccaacccctgaagggaggagtatcaaagaatttgtgggcatgttaaaattcctaaagtaattagttaatatttttggggaagataactctgaggttatacagaatctgatttctccttaaaaatttcctctacttattttagcattcattagtgaatcctcntgcggcagcggttgattatattattctgttggttttctatttttctaattctttctacttttatgatttggaatccttttgtaaggaagatttatgcctcccccatttatttattaaatcatttatgtcaacatggacccatgaatatttttttctttgcttataatccagt

SEQ ID NO: 595774 - DNA, 275 bp, Homo sapiens
cgtgatctgcgagtcaccatgctgcttttaactctggtaaagtggatatagtatgccatcaatgaccccttcattgacctcacctacatggtttacatgtaaccaaatatgatatccacaccatggacaaatatccatggacaccgatcaaggactagacgaacgaggaagctatgtcaatcacatggaaatcccatacaccatacttccacggagcgcagatcccatccaagaatcaatgtggggcgatagctggcgactgaagtacgtacgtg

SEQ ID NO: 595775 - DNA, 351 bp, Homo sapiens
gaacatggttgggacacgcacatagttgcccttgcttgaggtaggggctcagaaacactgtgcgggtgtcaatatagtgggaagtcccagcacgctgctggagtagaggtggaggaggcggaatttgcggttcatctccaccttgaagagctcaaagccaatgatgtaattgtcaggtcttcccattcggcggtaagagcgcagatccttctgctgcagtgacataatgaccttgtgcccatcctcaggcacagtgaagatgtactggggattctgcaggaaggtatcacggttgttatagcagcctcctgagcggttcatcaggggatcatcatccacagtccagcattc

SEQ ID NO: 595776 - DNA, 600 bp, Homo sapiens
gcgggcgtcgtcgaagataacaatagttggccggcgagcgctagtgtgtctcccgccgcggattcggcgggctgcgtgggaccggcgggattccggcagccggcatggcggggctgtactcgctgggatgacgtcttctccgaccagggcggaggaagtacatggaggacgtactcaaatcgttgtggagcccgaacgacggctgaagaaaagccctcgccgcggggtcgctgtctcagccgttgcctccgcggccgtcgcggcgcccttcccggggcgaagtctcggggaaaggcccagcggtggcagccgagaggtcggaaccctctaccggacgccggggctcgacgtgcacctaggccgctgatgacgacgcacgttcctccgatggcactttttcgccgtgtgccgatgggcacggcgggcgggaggcggcacagatttgaccgggaggcaactttggagtatccatcacagaacgcagacgggtttccactcagtcacgagccggctaaggtttgccgctgccatccgcaaaaggcttcctcaattgtcacacttgccactgtggaaagacacctgggggactgcgcaagacta

SEQ ID NO: 595777 - DNA, 190 bp, Homo sapiens
ctggactttatcgttgaacaaactaacctttaatagcggctgcaccatcgggtatgtcctgatccactatcgaggtcgtaaccctattgttgatatcgactctagaataggattgcgctgttatcccttgggtcacttgtcccgttggtcacgttattgcatcaattagtgatcgtggggttgtaaagga

SEQ ID NO: 595778 - DNA, 388 bp, Homo sapiens
aggatctcaaaaaacaaaatcttcatctccccagtaagaaaatacatggacaaaatcccaaagaagagagtattctcataaaaactgttgcaatattatagccactttatgcataatcataaaactggagacaatgtccactgttggcatggtgatggtaaacaattgtgggcattcagacaatcaagtaaccctcagctagaaaaggaacagactactgatacatgcgacaacgtgggtgatctccaaatcattatgctaaataacagaagccagacacaaaatcatacgaactgtatggttctattagtataacattctggaaaaagtaggagtaaaaatcatgagaaaaccgattagaggttgccaggggtggggataccacggg

SEQ ID NO: 595779 - DNA, 1209 bp, Homo sapiens
cgttcagacttgtggggtgccttcgtcgtcagcagcttgcgtcggaccggcccgtgcaggccagggggcagatgccccgaagctgacgccgccgccgccgccgactcgtgccgtgtggcggtgtgggaggtgggcgaccatgcccggggccgctgagtgtgacggacgcaactgggggcgccgtggggctccgcacggaccatgtattttctgagcggctggcccaagaggctgctgtgccctctgtgggagccctggcctgaggcgcctttccacgttcagtccgacccgcagagggctttcttcgccgtgctggccgaggaccgcctcagcatctggtacagccgaactagtgtgttaatttgtaacctacaaggagcctgcaaaatcatctactcagtctggatcctaccaagcaagctgaatggaggccagatagtaccatgatagctgtatcaaccggcaaatgggataccatcttggtacgctccatattacatctacacgaggggacaagtaccttgatgaaccagtggtatcccaaaaggcaagtcaccaaatgaaggggggacaccccattctcaccgcgaagaaccagtgttgctccacgcacttcaactccgggagatgaggcaccatacctggactttccaaggcaccccatccatgagtatggccaggcctgcggtggcaagatcgtcccatgcgtcgctccaacgtcctgacagggacctacccgccacacactcattcaacgtggggcacaagggcactgccccaccctgggcagagaaacgccgacacaccaccttggcggcagcgcgacccgccccatccgcagagacacaccgcggacaaccacacaacacaaggggcacaccaccagcggagcccacaacgcacggcacaacacacgagaacaacgtgcaacaaccggatcccacccacatggccggggcaagcgaccgcaggaccccaacagcaaggcgacaacagcagacgcacacaccggcgccacgcacagaacaccaagtgccgacgagcggcccaccggcaccgcgggcaccaagaaggcacgccaacacgcgcaccgacggcaccccagagacccacgacaaaagaacgaacgagagcagccacgcaaacgcacagagcccacccagagcgcacacagcaccaaagcacacgaccgaacgcacacacaagaaa

SEQ ID NO: 595780 - DNA, 108 bp, Homo sapiens
cggagtccgacaggtcaaaaaggccactcaaaacaatctatgatctgcctggatgcagtcttaccagaagcagctggcacagaggcaagttggcgtctagccgcaaga

SEQ ID NO: 595781 - DNA, 1560 bp, Homo sapiens
gatatcacgtcggtgtactcatgtgtcgcctcccgcggcggctcctgttttgtgagtcggacgctgccctgtgcattgttgacttgtggacgagtggtgttgacccgtctcgcttgtggtggtcccccctcggtgggggtgtgaaaccccacccgccagtgtgcggggtggatggacccttttcgccggagacggttgtccgtgtgatttgtgtgtcccgtccccatcttccacgatggaataggtttttttgtggtgtttcccccccggtggtagagctctttgctacgttacaataaaggggtgggggacaaccccacccacgagaccatcttttaaaaatggtgggtgtacacaatgagacccttgtgtggtggctagttaccactgcacagactacattattaccggatgatgtttttttggaagggggacctctgccaaccccctgttgattgtgtcctgacaaatggagaggaacaaccacaagggtgcccccttgtgtcgacggccagaccaagatgttttggtggtgtgggcgacacaaagtgggacaataaaacatggggtctgatctcaaaaatcgaatccgaatggtggccacatagtgggggtagaacacctgtggtgctcgactcctacgaggtccgtcaatatgtgggggtgctttttcagctgccgccccctctacaaaaatgtttatagagagcggggtttttgtcctttgccacagaatatcacgcgcgtctgtttggttaaatggagaccaccgtgtcgcggtggatcactatatatgccaccggctttcccccacgcttgtggggttggcttttttggcacacacctcgtggggatatactttttgggggggggccccctctcgagagacgtcgtgggctcgcaccaactgagaggtttgtgtggtcacacagcggatatatctcgtggtgtagtctgtcgcacatatttgtaccacacatatagaggtcccacacgtttcttgcgccttttctgtcacacactatacttggggtgtcacacacacattgggggagacctttgtgtgagaagagggcgcacaccccgctggggcacaagcacgccacgcttgattttgtgggagagagagggacacacgagagttctcagacacacactgtgtacacacttgtgggcccacagagattggaacctcggccctctttctgctcccacagaactcttggggtctcaaagtatagggaaccacctccctctttatgggcgatgtcctgagctttcccttccacttgggtggggtgggaatgtgggtgtgggggacactttccacgaagcctttataggtatgccccgcttgttgtttgcccacttcccccacgtgtttgtttaacccctgagtatgccccctatggcctatgtggtgatccccgtgctttactgggggatgtagagaaaggcacttttatagccctgggcatatagtgaaatcacccacgagcctttgggtggaatgtgtatagaaggccacttccaaaagcattaacctgttacaatgtttta

SEQ ID NO: 595782 - DNA, 294 bp, Homo sapiens
gcggcagcatctctggtcctcagattaaaaaatgaggttgaggcgggtccgtgctcacgctaatatcctagcactttgggaggcaaggtgggtggatcacctgaggtcaggagtttgagaccagcgtggccaacatagtgaaagcccatctccactaaaaatacaaaaatcagagctgggcgcagaggctcacacctgtaatcccagcacttttggaggccgaggagggcaaatcacctgaggtcgggaagttcaagacgagcctgaccaacatggtgagaccccgtctccaca

SEQ ID NO: 595783 - DNA, 492 bp, Homo sapiens
ataattctatttggtatatataataaattgagtggctgttttcatgaagagctctgtgttgtttcccgagagtggaatataaaagacatagctagaaagtgaaactgcaagaaaaattataatagaaaagctgttttctggacctttatcttgtggaggttctttgggatgggaagtgtctactcatagcctaacaaactccctggcagaggagttgttaaggggcctccagccttggacaggctgtgggaataagtggcctttcatctctgccaggggaaaccagaccattgcagagtccctctggcacagggttgccagatttagcaaataaaaatacaggattcccggttacatttgaattgtttctaattgcctatgcatgtgtgattcagataaaagaaaaatactgcatgagatatagttatgctaaaaaataccctgaaataaaataaaaatatgctgaaataaagaataaatacctaaattaaa

SEQ ID NO: 595784 - DNA, 228 bp, Homo sapiens
cggtctcaccctcccaaagtgctgagattacaggttgtgagccaccacacccagcatatcgagaagttttttccatgttaggggtttggggggaagtattaggtggaataagggtaaaaatggtgtcggtcacaatataggtccaggtttggagacaggatctcggtggcccaggcttggtcacctctctacttagtgatcagtgggcttctctgtggcccaggcttg

SEQ ID NO: 595785 - DNA, 951 bp, Homo sapiens
ggttttcaattccggttgatttttgtccctctgcgcttgctccccgtcccctccccccggtcggccaccagcccggctcgtctcctcctctcacggaaaggtcgcggcctgtggccctgggacgtgccgaatgaaccccagtgccccagtacccatggcacgcactacgtgggggacctccaccccgacgtgaccgaggcgatgctctacgagaagttcatgcccggccgggcccatcctctccatccgggtctgccagggacatgatcacccgccgctccttgggctacgcgtatgtgaacttccagcagacggcggacgacggaggcggttgcctttggacagcatgaatcttgatgttataagagggcaagccagtacgcatccatgtggtctcaggcgtgatccatcactatcgtcaaaatgtggagattagggcaaacatattcactcaaaaatctggacaacatccagttgataataacaggcactgtatgacacaatttcctgctaaggtaacatacctttcgaagtacacgtggtacgtgatgaaaagtgtttccaaaggctactgcatacgacaggtagagagacgcaaacacgccaagatgaaatgcagaccctctgaaaaagagtggcagtgggcactgtaccaaacgtgacgacaaacgaatgggacggcaggattaacagtctacatacaagaagcgagacgtcataccccaagacacaaagggtgaaacgaagtcacccaatgataggacacagaagttctcgccgaaaacaagggcctggtgacagcggacagcgaattccacaagtgcgaccgacatagtcgtccactatgacataaacaccggcagaccacacacccgcactgatcctataccatgcacaaaccaaccccgcggattcaaaaggggggccctaacacgaataagagacaacatg

SEQ ID NO: 595786 - DNA, 170 bp, Homo sapiens
gaggagagagtgcatctatacaccattggaagattgagggagggagagtgtgatatgaaaaatagcaaacccaaggagttcctgttgtggcacagtggaaacaaatctgactggtatccacgaggatgcagggttgatccctggcctcactaaatgggtcagagatccgg

SEQ ID NO: 595787 - DNA, 141 bp, Homo sapiens
gccagtcaagcgaatacatatgaacgaatctctataaagaacatttacttgaatatataagagtcataactgatagtaaatagagtttaacttaaaaaagactttgtcctaccacaggcagcgatagacgtgtttatggca

SEQ ID NO: 595788 - DNA, 2012 bp, Homo sapiens
  misc_feature (990)..(990): n is a, c, g, or t
atggcttgtgatgtgagtggcgttcgtgagtgatggttgattgtcaatctagttgattgcgcgtgtgtggtctatgagtaggtcctgtcatgtgacgtatgttgaatgcaggtctgcgtgtggtggtggctcgcgtgttgatgaccctgtcagttgttgttgactacgattgttgtgcgcggcggtagaacagctttgttctcccgcggtggtggtagttggttgcgggcggttgtcttgttgttgcagcttgtaggtgcgtggtgcgtctgtgatatggggggagagtgaggtgctacctgcgttgtatactcaccgcgtggttgttcaaggtgcagcaatgtgtggtgtgagtcagttggggtgtggcggtggatggtgtgaggggtgatggtgcaccagtgagcgtgagtggtgtgtcgcgcaccagtagtgtggtggaaaacaacactatatgtgtgtggtcctcacactacgtgtgtggtgcgtgcgcttgtttgtatcgggtggtggataagtctgcgggtggcgctggttggttgttgttcgctgcctagtgctgactggcggcggttgttgttgggtggccaatatatgggtggtgtgtttggttgttgtgtgagggtgtgctcacctccgcatgcatgtgtcgcttactggggcctgtgggtgatgtctgttgttgtccaaccaccgcttggctgtgtgtgtgtggccttgtggttaggtaagtcaaggtgggggggccccacccactagtagtgtttggtggtgcacgcagaaaggtgtgttagtgtgtggtgtcgaccccaccccggtggtggggttgtgcgacaccctttgggggggcgtcagcaataataatgggtggttggtattgtctcgcctgctacgctggtggacgaccaccacaaagtatggtgggctggtgtggaggtttgtcggccgttccctcgtggagtgagcgaattgtgtgtctttattaggcgntggttcctcattctgccgttcaatgtgtcctcccgtcgttgcggggtgagtatagtttgggtcggggttcctgccacaattatgttgggggtccgcgactgatatttctcgtttgtgtattattgttgagtgtgtggtaacgtacaccgcgcacatgtgtggtttcgcgtcttggggtgtgtttcgatgtgattcgtcagtggagccggggcgggtgtgtacgtcttatgttgtggggagtttcctcttgttcccccccccccgttggtgtgtagagacccccccgcgcgtggcacacacacgtagtgatagtgacacacatgagacaccccctgagtagagtgagtgaccacagacacacacacacacgacgcagcgttgtgagaggggtgagcacacacaccagagagagaagagactgcgcgagcacagagagagtcccaccaccacacagcgtggtgggacaccacacacaatatacacacgcgcggctgtgtgtgcgagatacacgccgcgggcgccacccggcgaacatagtagaacacgcgtgtccctcacacgagtgtataccgagagagacctgcgcgcggtggcgcagaaagtgtcgctccaccgcagcaggagaagaatacactgcgggacgacaccaccaccacacgcgagagggtgtcacacagcgagagagtagtgtgtgtgccacacaaatgtgtgtgtgaatagagtgcgaggtgtggtgggcctcaatagtgggaggtggcccacgaatccctctgtcctcccaaagacgggtgcgccctgccccgagaacgggacccggagggccccctgggccctgcggccctgctcacacccccccccctgtgcctctgccaccccctgtgtgtgtggtgtgctgtcactgtctcccccacccccccccctctcccccgggcaccccctacccccctccacacgccaggccccccccccccacatgagagtgaaaaaaaacaccacaggacaccttttttaaaacacactga

SEQ ID NO: 595789 - DNA, 207 bp, Homo sapiens
  misc_feature (61)..(61): n is a, c, g, or t
  misc_feature (66)..(66): n is a, c, g, or t
ttacaagcacaattgtagtaataactgaataactgaataattaacaaagacaaaacaattnaaaanaaaatggaagatttaacattccattaattactgagaccttcttcatagcagtggattctgggagcatatatatgggacataattatctttgagctgccttttgttccccttttgctacccctggggatagttacttcatat

SEQ ID NO: 595790 - DNA, 469 bp, Homo sapiens
tagatgaactggaagaaagtacattctttgccgggcgcggtggttcatgcctgtaatcccagcactttgggaggctgaggcgggcagatcacgaggtcaggagatcgagaccatccttgctaacacggtgaaaccccgtctctactaaaaaaaaaaaaaaaaaaaaaaaaaaaaaattttgtgggcgcgcccgggccccggaaaaagttttttaaaccttttggttggggggcccgggcgcccaagttatgtgtacggtaaacatgtgggtcaatagcttggtccccaagaggaaactacgggcgccagtagactacacgtgggggggttctttccccaaattaaaaaaccgccggggggaacccggacgcggtcttggaacaactcccagagagggtcggggggcaataacggggttctctcaccgggacgccaggcgaacccgatattaatttaccccacgcggggt

SEQ ID NO: 595791 - DNA, 569 bp, Homo sapiens
  misc_feature (260)..(260): n is a, c, g, or t
  misc_feature (293)..(293): n is a, c, g, or t
  misc_feature (432)..(433): n is a, c, g, or t
  misc_feature (438)..(438): n is a, c, g, or t
  misc_feature (455)..(455): n is a, c, g, or t
atctcaactaaaaatactgagtcaggagaattacttgaatctaggaggtggaggttgcagtgagccgagatcacgccactgcactccagcctggaaaggaggggaaagggaaaggaaaggggcaggggaacggtaaaggggattgtccttgggggtgggcacggcagaacactacgggggtgccagtattttggtcgttcggcagagttatttaaagtgagttcagttggcccaggccaaggtggccgcgccttgttcangcccgcccccagtaaccccgtcatttcggggangcctattcatccgtatcccacacaccccagggcccgcctgagatgaggtgaccctgcaaaggggagggccttctcctcttcggatgagaggcgcagcccccccctccccgggccccggccctctggctcgaacgcatcnnagggnggaccccggctcgaagngttttccaccgccaccttcaatccacccctcaatcccccgcagacccaccaaatctaacccgccggggcccgtggttgctggcctctctacaccactccccactctccttccat

SEQ ID NO: 595792 - DNA, 258 bp, Homo sapiens
cagttaacttgggatagtggttttgatgggtcgtaggttgtgacatgtgggaatctctgttcatcgatacatgcgctgtcattagttagatgacgagacattgggctagcttaagagagtcatagttactcccggcgtgaacccgtgcaacattgaatatcttcacttggagattcagagcactgggcagaaatcacatcgcgtcaacacccgccgcgggccttcgcgatgctttgttgtaatagttacggattaacg

SEQ ID NO: 595793 - DNA, 199 bp, Homo sapiens
ctgggataacagggtgttcactcacgattgcctggctctttttatattttagtagagatcgtgtttcactatgttggtccaggctgcttttgatctcctgacctcaagtgacccaccctcctcggccttccaaagtgctcgcggattatcaggcgtgagccaccatcgcctgcgcgtctcttgagatacgtacttttaa

SEQ ID NO: 595794 - DNA, 438 bp, Homo sapiens
aacaaagaccaacctgcctggcagaccggggtgagggctgcctggagggaaggtgaccccacctcagggaggccactgtgaccacatcctcttgcacagtgggtctttgcctcagcaactgtgggggaggaaaagcaccaacatcccctctcggccgaggggaccaggctctagaaagctcacagcggcgctatggaaaaacctggagacagccctggagacggcccagtggatgaataggaaaatgcatggtgttatggccaaacaccggaacactcttcagctacccaaatgcactgcagccgcacagaacattacggggcatctcagcgctatgaggctagagagaaagtaaagtctccaaagatgaagttcagcacagtacgctttctagaaggctaaaaagaactgtaaataaaatgttctttttgagagtga

SEQ ID NO: 595795 - DNA, 906 bp, Homo sapiens
catagtccaggaatttatgtgctttttataatatacatcacgagagtaagtgttgttttccacgaacactatggcgaccgcactgtgttgcaagaaacgatttttcggggcgtggattgggggtatcataaaaaagggtggtccgctctatatttttcggggaaggggggcgcttattagaggcgctgaaaaaacccgaattttttgctcaagactcacggcgagactagtgaagagattgccggttgagtgcattgtatgcaggcatgcccgggacacatagtggcgtgggaaaagtttggaccgtgtgggtgaacacgagagcggtatctccgggagtggactgaattagagaagcgcctctgtgcacactgcgggtttacccaccgtcgcctacatggtagtccctgggaaatgtacacgggaaactggggagaattctttttagaaggatgttaatttgcacaacgtattgtgaagagtttgagcctggtaaaccacatgataaacaccatgggaacaccactgtccggtatttgcgtcctcgctgattagcattcctgcctgctgtccgattgctgggacggaagtgctattaactactttatgtaacaagtaccaggaccagctagaggtcctggggttaagagaggaaaaaatagccacgtcgcctaccaatgtgaagccttcattattacacggtccagttgtgtctcgcagtgtaggcataagcgtaatgggttattttcagaaagctgcctgaaacagttgctttgtattcttttaggaagaactttaattcctcctgagggactctactttttgagcccaactgctaattttttgcggaactgtttagaagatcattcaagagacccgcagtgtgcactttttcgttaaagttta

SEQ ID NO: 595796 - DNA, 414 bp, Homo sapiens
ctccccccttctgcacgccccctgttccacgggtacctctgccggtcctactagcactatgcagccttttgtttcaacgcttcctgagccacgtcccccttgagtaacggcgccctgatcgcgcctactttctgtgcgggattcttgccttcaggacaggcggagttcccctggtacacaagggtccttctgtgtggagctgtccgccaatcggtgatgtcatttctgcttcgtggccaaagcaatgggaccagctcaaagtattgttgactgatctgtccgttacccgattgtccaaagccaaggagattggggctgatttagtcctccagatctccaaggagagccctcaggaaatcgccaggaaagtagaaggtcagctggggtgcaagccggaagtcaccatcgagtgca

SEQ ID NO: 595797 - DNA, 431 bp, Homo sapiens
aggccggggctcacaaccataatcccaacagtttaggaggtcaaagcaggagaaatgcttgaggccagaagttcaggaccagcctgggaaacacagtgagacccacccccctcaattaaacaacaaaaagaaataagagaaaattagctgggcgtggtggtatgcatctgtagtttcagctacttgagaggctgtggtgaaaggattgctttagccccagagttcaagaccagcctcggcaatataacaagatcccatctctacaaaaaaatacaaaaatcagctgggcatggatggtgtgcacctgtagtcccagatgcttggaaggctgaggcgggagaattgcttgagcccaggtggttgaggctgcagttagctacgactgcatcattgcactccagattgggtcaaacagagactctgtgttcaaa

SEQ ID NO: 595798 - DNA, 913 bp, Homo sapiens
aacgctcgctcatactaggcctactaaccaacacgctaaccatataccaagtgatggcgcgatgtgaacacgagaaagcacattaccacaggccaccacacaccacctgtccaagaaggccttcgatacggggataatcctgatttatatacctcgagaaggttgcctatatctgtcgcatggattattgcatgagccgtgttaccaacgtccaagcggctagcccgaatgcctccagatcaggcatgggcactgcgatcgcacaaaaaggaatctactgcgattaactcccctagaaggtccaacgccttaacatgcatgcgggtttacgccgaaatcaaagggggagaaatggcgtggggcacgcgcatattggaagtataaaacgacgaatctaataactcacgcatgcacatgatcatatcaccgctagggataggtgacctgctacactttgcgcttatatcgagcctgcaaggtaactatgagtcccccgtacaccaattcctcgagggagttgacagcccccggggagtgcctcccggaggggacacagggacttgaagtgattatgggatcacgttcttcacttatatgcgaatccgcaccaactatttgccacaatccaacagaccattgggggtgctagcggacgctgaaaggcgttagtccatgtggggacaggctgtgggtcaacagcggagacggcctcacagaatgactgacgagcatactgtgagcacgcgcccaaaggctacggcatttgtggggccagcgggattaaggagattcccaatagggtggaaagggtctccaaaacggcgagcgagcaaaggagcggcagatggacaggaaacgggggagaaagaggaccgaggagcacacgaagaaccgtatctataccaagcagtaa

SEQ ID NO: 595799 - DNA, 496 bp, Homo sapiens
cctttgattcccagtctgtcctcgtcctcctctgcctgtgggctgctgcggtggcggctgatgtgagggatggcgtctgacacgctggtgccagtgctcctccgggcccctcaccagccccagtgtcttttcccagagatgcctggagggaacaggctgagtgagggtggttggtgtggaaaccctggttcccccagtccccggagacttaaatacatggaagaaaaagtgcaggacagaattacaatgtgccggcccagggtgggcagcggcccctgcctcctacacttgcgcctcatgaccagcttgttgaagagatccgacatcaagtgcacaccttggatcgtggctctcactgcaacgggaaagtcacagactggggtgaagagttcagtcacatgcgaccggtggctccctgtacccaaccccatgacactccccagcactccaaggccactgtgttctccagttagctcagagcctcagtcgatccctg

SEQ ID NO: 595800 - DNA, 103 bp, Homo sapiens
tacgacccagaacagtgtttgctcagatcgacatttacaactcagagctggttggtggccacactgtggtgccttgaaataccatattctgtatcttctcagt

SEQ ID NO: 595801 - DNA, 301 bp, Homo sapiens
tctgcatactgaggtctagcacatcctgcacacaaaccttttgtcagatacacaatttgcaattattttctcggggtctgtgacttgtcaatggggacctgacagcatgacagtgttttctttaaacaaaccaggctgtctttagaatcctgccattccaatcaaggagaggggcatagaatctttaaacttcatggcagaaaaagatcacgctcagcagctgtgtagtccacaggacctctgaagaggaaggggccttcccgcacatggaatgggcccctcatgccatgctaaacgattt

SEQ ID NO: 595802 - DNA, 143 bp, Homo sapiens
ggggggggggggccctttcccccaaaattttttacccccccggggggggggggggcctttttttcccctttttttttcccccccccttttttttcgggggggggggccccggggggggtttttttccccttttttttttttta

SEQ ID NO: 595803 - DNA, 431 bp, Homo sapiens
cagtccttcttctgtgctctgagcctctgagtctctgtcagtgagatggggctgtaaacatcctaggaccttccgcagtgaggtgccaccctgccaggttctcgccctgtagccgagccctgtcaccttcatatgtagttggctcagtcgtggtgccgatcagcctcacctgggcccggtccatctttacctgctgtttccgcagttgttagatggcttcgtcccggttcttgttgcggcgtagtcgatgtgcgcctccaggtccttctgttccttctcctaccttagacccgttgctttactctgtcttgccaggtctcagagtctcatactgcacccagtatgctcctcctagccaggtctgttacaatcgttgtggagggtcctgcctgttctcaagggacaagcttgcccttctctctcctgaacca

SEQ ID NO: 595804 - DNA, 864 bp, Homo sapiens
  misc_feature (280)..(280): n is a, c, g, or t
cgaatttcacattaattcctttccccaaaatccgattgcccctccgggtctttaagcccccacgattttccaagacccccggttttggaccccacaaaattttctctcttctcaaaaaaaagcgctatcccccccctttataaatctccacagccgtctaaacaattcgtacccccaaagttttgaacagaagttactagccttaaaattgtcaacaagaaacattgcaccttcaaagacgctgctctcttggaacgcgaacagataaaagctttttgtncaccaagccgccggctaaatagaagcctttctcccacgaggttaaaagtgttctttaagcccaatttggtagacaaggcatgtcccagtcgcccggcttttatccccctagtagagggccaacgccgtttgtagatgctgctaaatccgtagggtgaacaataaccgcgtaaagacattacttgttacaaacattgataggtgtctttataatacattcaatctgtcacggccaagtgtttttttgaaaagacgggtattacacccccacggcggtccattaacaactccctgtaagtcctcaccctcctgcgtgagcaattctccccattctaaggcccatttatcccccagttctttaatcgccccgccatattactgaacaacctatttgtgcggatagttataggaatggtacccctttttgatacaaacaaatacaaattcttatgagatgtggaaaaccttagtaaaccacataatctctccgggatgccgccatgacacaaaacacagacaatacaagaaaaaacacacattggccaacaattatcaacaacaaaaaaacaacccctttcacaaaca

SEQ ID NO: 595805 - DNA, 277 bp, Homo sapiens
aaggatcggtggaatgtgaggggaggtggactattttactaaacttgtaaccttggaaatgaccagcccacaactcaagcctccccagttctactgacctttttccttaggtttgaggctcagggttcctcggaaaaaaaatcttcatactcaggtgttgaccagagtgttcattgaatggtgtaattttgacctctctgtgtcctgcgaaatactggccctgcctggagacatattactcaatttctctcaagtcacaaataggatggggcgtctg

SEQ ID NO: 595806 - DNA, 997 bp, Homo sapiens
  misc_feature (995)..(995): n is a, c, g, or t
  misc_feature (997)..(997): n is a, c, g, or t
ccgtctatgtagcaaaatagtgggaagattgataggtagaggaagataatagcgtagcgagccatggtgatagctggttggccaaagaatagaatcttagttcaatcttgaaaatgtgcgccacgagtaagcctctaaatcctgcttgtaaatttaactgttgagtccaaagaggaacagctctttggagactagagagaaaaccttggtagtagagagtaaaaaattaaacatcccgatagtaggcactaacaagcagcgcaccaattaagaaagcgttcaagctcaaggacccactacctaaaaaagtcccagacatataactgaactcctcacagccaattggaccaatctatcgagcctatagaagaactagatgttagtataatgtagacatgaaagacattctcctcggcataagcctgcgtcagattagaacactgaagtgacaattaacagcctcaagtatctacaaatcaaccaacaaggcattattaccctcactgtcaaggcctaaatgacaggcatgctcataaggaaaggttaaaaaagttaaaggaagctcggcaatgttaccccgcctgtatagtcaaagaaacatcaactctagtgtcagcagtattagaggcaccgcctgccagtgacacatgtataacggccgcggtacctaaacgtgcaaggtagcataatcacttgttccttaattagggagctgtatgaatggctccacgaggggttcagctgtctcttacttttaaccagtgaatgactgccgtgaaaggcgggatgaacagcagagaagaagaccatgagctaattataaagcaacagtgctaaaacccagggctatacaagctgtaaaatttcgggggcccgggaaccaccggaatgtaattccggaagagaccttctggcaatgcagagaacagaaacataatataaaggcagaaaagcgagtatagaatagagagtccaatcctacttaaataatcctntn

SEQ ID NO: 595807 - DNA, 258 bp, Homo sapiens
  misc_feature (6)..(6): n is a, c, g, or t
caagtnattaacaaattcggtgaccaagtgaccctggctgttctccagaaccggcaccagcccaaggggattcttctcaaagaaccactcgggcttattcttcaggttgatattgatgacttcgtgccggattcccttggccttcaggaccatcagcgtcctctgagcgaaggggcagaacctcatgctgtagacgcggattctggctccgggaccgggccggggggcgcgcttcccttccccaggctcctggaggat

SEQ ID NO: 595808 - DNA, 117 bp, Homo sapiens
aaactggagcatatatgatagtgggaatgtaaatggtgcagccactttgggaaaacagttgggcaattcctcaaaaggttaaatacagaggtatcatgtgatacagcaatccaattc

SEQ ID NO: 595809 - DNA, 457 bp, Homo sapiens
gcagcgcccttgtttgcagtgtggaaacacccactctggggctggcactatctgtcgagaatttaaaagtgatcataaatctgtatgaaagctgatgtgcttttcgttattaccatgcaccagcaattccagtcagtgtcggccatacatcatctgtcgtctgtgttctgaataatggttactgttgagttttaataacataaatgtaagcttcagattcacacattcttattacttaccctttcgtaaacattgtgttttatgtggaaactaatttggggaacccccagtcaatggccctcacgtgccaacttggctgcatacccctgttccaagaccacgtgcacagcttggcattgctggagggcgctgggcacaccttgtgtctcccgcctctgtggcgctgtgggctcctggatggaagcaggagatgggaaataaacatggatcgctgaaa

SEQ ID NO: 595810 - DNA, 164 bp, Homo sapiens
caactacatatataccattttttgaatgcgtactggagaggatactctcagttcttttgagctacacattagaatcaacatctctccggagatctacagggtggggcagagtggactccctagtttcaatcagtcgctgaagagcgcccgcgcgagttagcgga

SEQ ID NO: 595811 - DNA, 133 bp, Homo sapiens
ttagcggaccgtacaactccaagaatatatacagtgctgactagagtacaggtgacctgattattaaagttcagtgagttaaaaaatgtgaataaaatctgatgttctgaagtacaattaaatgccgactaag

SEQ ID NO: 595812 - DNA, 958 bp, Homo sapiens
gcttctctcgccaggcgtcctcgtggaagtgacatcgtctttagaccctgcgtgtgaatccctgacgcaccgccgtgatgcccagggaagacagggcgacctggaagtccaactagcttccttaagatcatccacctattggatgattatccgacatgtgtcatcgtgggagcagacaatgtgggctccaagcagatgcagcagatccggatgtcccttcgcgggaagggctgtggtgctgatgggcggagaacatgcatgcatgcgctaaggccatccgagggcaacctggaaaacaacccagctgctggagaaactgctgcctcatatccgggcgcttggtgggcttggtgtgcacctgggggaggccctccactgagaatccgggccctctgtttgctaggtgcaatcaaggtgccagcttgctggccgtgcgtggtgccatttgccccatgtgaggtcactggtgccagctccggatctttggctctcgggcccgtttgcagatctcctttgtcctggctctggtatcagccagtaaatatctctaggggctgccattgcatatcctgagtgatgtgttagctgggtctagacatggtgtctatgtggccgccggcagtgaggccggcgcgtgttggatgatgttcagcttattccccttctacttgggtgtggtcctgccagaagtgttcgacggtgggttgctcttgacccctgggtgttgatatcccgggggaactctggatctttgctgccgaagtgttgcgaattgtgcctgctgttgggttgggaccactttgatcggcgccgtttcaacgaaggaacaggcgtcggctgggggggcgggacctcccgcgggggcggcggagatgcctgggggcctccgggccctctggtggcctggagaaacgccaggttttgtcccccttggctcactccacgcggcgtcggcgcg

SEQ ID NO: 595813 - DNA, 118 bp, Homo sapiens
  misc_feature (1)..(1): n is a, c, g, or t
ntgtcgaccgatggtcgcgctcactgttgcaggtgctggacttcgacggattgttgacgacgacctcgccgcctgccgcaagttccgcagcgcgcgcaaacaatgcgcaaagacaaag

SEQ ID NO: 595814 - DNA, 576 bp, Homo sapiens
tccaagggactcagctcttctgtttctacagatggaacagctccatagggacagctgtataattaccttcagaggccaacgacagaatccggcaggaacagacattatcttgccagttagaagtacttctgtctcacttatgtccaaagagtggctatagatcttggccttcttccctgtatgcttttttttttggggcccccaagaaagtccctttaatagcactttagcacgggcaaggctacaggaacaaagtttcaatggctggcggagagtgaaagaagggaggaaagtcggccactctacccggagcgggcagtagggcacggagtaccctaggaagaagtcagagcaagggatacaaatgacctggctctgggattggcggagcatgatccctattctgatgtcagagataaggtttaatgggaatagagctatccatgggtcctaactctctagggagacaatcttccaaaacagtttggggggggtcttctaaagctttcaattgggaagtaactttatccaactagagtggattaaaagaggggaaaattatctcacagagctgga

SEQ ID NO: 595815 - DNA, 360 bp, Homo sapiens
gctgatctagaggaccccagcgctgagcaatatagcaagtagggaaatcccacatcaatgggagccatcacacagatgcctttctgggaaccccaaccttctatgatccccaaaaaggtgcttgggggctttagcatattcaataaaggggaagagggaaaatacggaaaggggccactattgagtgggtgaaagattgaagctgtagaggtcccacccagcctagggccaaaaaagaaatgtatgatctgcacagagcaggcaggcctctgactgctgagagtatggcattcaggcgccaaccggttgagagttctcagcgagcactgtcgggtatggctcagcgctgggtaccgtgct

SEQ ID NO: 595816 - DNA, 80 bp, Homo sapiens
gcggccgcctactactactactgctcgaattcaagcttctaacgatgtacggggacatgttaagcagttttccttccttc

SEQ ID NO: 595817 - DNA, 208 bp, Homo sapiens
acatacattatcgcccatgaatgtacatcctcactactattctgggcgtggcgaactctatactacgaacgcactcacaggcgcatcataatcctctctcaaggacattcaaactctactcccactaatagctttttgatgacttctagccagcctcgctaacctcgcctattgtacaccaaccccataccacgttgctataacggga

SEQ ID NO: 595818 - DNA, 151 bp, Homo sapiens
ctagcaaagtagtcaggacatacttctggtgggcactgtgcaggaaacttgagagatgaaatcagtgagcagcatgcactatgaaaggcatggacatgtctcctcacttgaagtgcaaggtccatacgaccaaagaccctgtatcagatca

SEQ ID NO: 595819 - DNA, 331 bp, Homo sapiens
  misc_feature (303)..(303): n is a, c, g, or t
  misc_feature (306)..(306): n is a, c, g, or t
ataagagtaagaaaaacggcagggcacagattagctggcagtaatcattattcgcagccggacaaatgattttgcccggcctgaattaattaaacccggctaccccacaaatcgtactcatcggcgtgctcgactttcacacgcaggatatcacccggcttaacgttgtttcaccattgagataaaccgcgccgtcgatttccggtgcatctgccatgctgcgaccaatcgcgccttcttcgtccacttcgtcgataatcaccagaatttcacggcccactttctcttgcaggcgctcggcgnaantctgctgctgcagctgcatgaaacg

SEQ ID NO: 595820 - DNA, 284 bp, Homo sapiens
attctgctctagacatctccccatgagaaatgagcactgagcctcccgaaaggtcttttgggaggccaaggggagcggatcacttgaggtcaggagttcgagaccagcctgggcaacatattgaaaccccgtctctactaaaaatacgaaaattagccaggcctggtggtgggtgcctatagtcccagctactcgggaggctgaggcaggagaatcgcttgaaaccgggaggtgaaggctgcattgagccaagactgcgccattgcactccagccttggccaca

SEQ ID NO: 595821 - DNA, 183 bp, Homo sapiens
ggaacgtatgacgggtggcgtgtgaacccaggagagatgttagatcggtgtcgtgcaagaatcggaggtggagtgcggctagtgggtggaataatgaatgggtacgatgaatgtgaaaggtaaagaatcgtgtgagggtgggactgtctactgagtagcctcctcagattcattgaactaggt

SEQ ID NO: 595822 - DNA, 427 bp, Homo sapiens
ccaggcacaggtttggcttccggtcagtgtcccgcccctgtgcgggaggtgacaacaaagcaaagcagcgcaggggtcagggaggttcagacactgttgaaatcacactacccccccctcaggtgaagccccccgttccccaaacttggggtcatagattgtccagtcactggctccctccctgtcagcccagcccaaaggaaggggctaactgaattttttaccccttttggcctggctccagaactttgttttaaattccttaaaagtcgggagctgatgtcaaactcaattgagcagtagctttgatcccttggtttgggggtcgaaggaaaatggcgctgttatcagcggggaaatgtactatttaaaatcagctttgttgtaaaaccctttgttttaaaataaaactcaattggaaacgtga

SEQ ID NO: 595823 - DNA, 297 bp, Homo sapiens
tatgaagttgattaagtggtttacagcatctagtgaagtaatcatatggtgtgggttctagagttatattaagtgtgatatatcacattgatggattagcatatgttgaaccatcctggatccctggagtgaatcccacttgatcatggtgaatgatcttgggaatgtgtggtggaattcagtttggtagtgtttcattgagaattttggcacctatgctcatcagtgatgttggtctgtagttttcttttgattttgtatcctagtctagtttaggtatcgcagagaatgccgcgt

SEQ ID NO: 595824 - DNA, 1286 bp, Homo sapiens
aactataatagctagcattctaccactcctcacgttctagcgcaagtacctaagtatactccgctcacaccctcactactcctccctacctatgccctagcaacggaactaactacctactcgcttggctccactctagtacgcatacttcctcactacacccgtccaacaccctacatccccatcctatagccccaactactctgctgcccttactgcgcccactcacctcagctccatctctgcacccgcccatagccgcaacgcgcaggaccgagcatgcgcgaccctacgcccccgtaccgtacgcgtaccatcaacatcaatctcaagccaccagctcactggcgaccctacggagcttagcagctacacactacaacgcgttacacaccgcctaccatcgcacactcgcctaccaaagcttacacatcgattacccaaacccaacctatcactactctacgtacccaacgtgcacccactgaacctctctcccacacacaaatccacatctacactgttagaactccacatcaacacaacccaaccacatcagcccacctaacacctctacctcacgccactccactcacccctacataccatagctctctctctctacacccacacactccaaacatatcacacccatcactctctagacccatgatcatcccacaaacaccagtcttactcctaccgaacgcccctctacaccaacttcgcccactttccctacactacctaaaacctcaccccttgcacctcccctactaccctcttcaaccaaacctccataggccacccgcccacaacagcccacctatctcaccagctgcaaaccccacttcactcactccgcccctaccccaccctctcacccatcctcctaattctctaaatccttcccctctacacagatcttcttccgcattcaagtttactataactaacatatctacacgccacacagagtaaacctacacttcacatcactccatcactacctcctccctcatatacgacaacaatccacatcacctctaactatcacccacgccctttatgcacccacttcatatcccctcccccgactcaaccgtccataatccaccccacacgaaactctgccctcgcacacctacgtggccacactaactaccctacataatacacacaccgctatcatcatcacgcacactccctgccccctaactcacatagtgcacctccctcacacacattacatcaaccactctatacgcccactacacccatactcc

SEQ ID NO: 595825 - DNA, 179 bp, Homo sapiens
catctctcgagcgtgctctcccacaatcataattgtttcagtaaaatggttacttggtttttccaaaaaaaaactcgtttttactcattttgggcctgtttgtttatttagaaactaatctggattcaccccctctggttgatacccactcaaaaaggacgatgcagaaaaggatttag

SEQ ID NO: 595826 - DNA, 159 bp, Homo sapiens
tattgaattctctacgaaccacaaagacataggaacactctacaatattattctgtcgcattggctggagtcctaggcacagctctaagcctccttattcgagccgagctgggccagccaggctaccttctaggttacgaccacatctacaacgttatc

SEQ ID NO: 595827 - DNA, 129 bp, Homo sapiens
ccattggaccagcggatgaggggtctgttgtcaccagtgatgcatgcagcacattgttcctgttggctgctcattctgctcggagtaattagcatccacatgggcttcagcagcttttctcttcaggat

SEQ ID NO: 595828 - DNA, 1614 bp, Homo sapiens
accgtgttatagttattaaacattacccgtcgtagctctcatacgcgcgatctatcatcgagctgcgcgtatcgactacggagtatcgcggccatcacaggatccgggagcgacgcgcacgagcgcgccagcatcgcgcattagcgcgtgcgcgcgatgcgagcggtgccgtacgcgcgcatcgagttatgcggcgagcgcgcgtatacgtactcgcgcgatcgatacgtacgagcggattttattcgggcgctataaatcggcgtatatcgggcgcggcgatgtacacactgggatcgatgctagcgatccgcggcggactgatcggatgcggcgcgattacgcgacggcgcgatctgcacgatacggcgcggatttcgagtatcatgcgcgatcggcggcgattatggcggcgatcgtagcgcgctatatgcgcacgcatcgggcattatatattcggcgcggataggtagcgagcgcgacgctacgatcggcgccgatcatcgaggcgctacgactatcggatcgggtatcatcgatcatagatgcgctactatataataataataatagtcacatagccaacttacacccacgaatatctagcgatcatcacgaggacgacgatcgagcgcgcatgtcgcgatattatagcgcgcgcattatagcgcgcagcggtagcgatcgggggcgggcatatatacgggcgcattatatcggcgatacggcgatcgcggtttttacggaggcgtttacgggattcgggatgcgcggttagcgtatcgcggcgtattagcgcgcgcgcattaattagcgcggtatattcgcgattacgggcgcgatgatcggcgatcggcggcggcgattatcgatctagcgcgggcattacgctatcgatctgtacatctagcgcgcgcgcgtatatatatatccggcgccgttatagcgcgggctataatcggcggattctaggcgatcgtattcatattatcggcgcggattccccggggatttaggcggcatttacggcattaggctatgggcgcggtatcttatcggattacgcgcattctatcgtatgcgcattatgcggcgcggattattaaaggacgaccgaacaagcttacgtgtatataattaatttaaggagagacgagagctaagttcatctatcaggcattctacgcatccatcgatcgatcgcgcctagcgatcgagcgattatacgagatattacgcgcgatattggcggcttatatgcgagtatcggtcgatggcgattcgcgccgcggctagcgcgatatcggacgacattatcggttcggatcagcgcgatcgcgccgctcgcactgcgatgcacatgcgtcgagcattcggtaggatcggtgcatgcgtatcatgcctttcggcgttccactagcgaggatcggtatgggcttaggtcgtgcatcggtatcggcgcgattcggatgagtcgcggcttagtctatagaccagacggcatcagcgctttttagggcccaaggtcttctctcttagcacacccttctgctctatggactacgtatcgacacatcgatgtcgatgcggaattttaattttctgactgaccgc

SEQ ID NO: 595829 - DNA, 587 bp, Homo sapiens
  misc_feature (20)..(20): n is a, c, g, or t
  misc_feature (69)..(69): n is a, c, g, or t
  misc_feature (71)..(71): n is a, c, g, or t
  misc_feature (122)..(122): n is a, c, g, or t
  misc_feature (142)..(142): n is a, c, g, or t
  misc_feature (149)..(149): n is a, c, g, or t
  misc_feature (165)..(165): n is a, c, g, or t
  misc_feature (167)..(167): n is a, c, g, or t
  misc_feature (169)..(169): n is a, c, g, or t
  misc_feature (182)..(182): n is a, c, g, or t
  misc_feature (188)..(188): n is a, c, g, or t
  misc_feature (194)..(194): n is a, c, g, or t
  misc_feature (198)..(198): n is a, c, g, or t
  misc_feature (200)..(200): n is a, c, g, or t
  misc_feature (206)..(206): n is a, c, g, or t
  misc_feature (213)..(213): n is a, c, g, or t
  misc_feature (217)..(217): n is a, c, g, or t
  misc_feature (230)..(230): n is a, c, g, or t
  misc_feature (232)..(232): n is a, c, g, or t
  misc_feature (243)..(243): n is a, c, g, or t
  misc_feature (245)..(245): n is a, c, g, or t
  misc_feature (263)..(263): n is a, c, g, or t
  misc_feature (268)..(268): n is a, c, g, or t
  misc_feature (270)..(270): n is a, c, g, or t
  misc_feature (272)..(274): n is a, c, g, or t
  misc_feature (280)..(280): n is a, c, g, or t
  misc_feature (284)..(284): n is a, c, g, or t
  misc_feature (294)..(294): n is a, c, g, or t
  misc_feature (296)..(296): n is a, c, g, or t
  misc_feature (303)..(303): n is a, c, g, or t
  misc_feature (310)..(310): n is a, c, g, or t
  misc_feature (316)..(316): n is a, c, g, or t
  misc_feature (326)..(326): n is a, c, g, or t
  misc_feature (333)..(333): n is a, c, g, or t
  misc_feature (335)..(335): n is a, c, g, or t
  misc_feature (339)..(339): n is a, c, g, or t
  misc_feature (421)..(421): n is a, c, g, or t
  misc_feature (452)..(452): n is a, c, g, or t
  misc_feature (501)..(501): n is a, c, g, or t
  misc_feature (520)..(520): n is a, c, g, or t
  misc_feature (522)..(522): n is a, c, g, or t
  misc_feature (538)..(538): n is a, c, g, or t
ttaaaaaataaatttaactntaaaatatgatgagtatacatttctggatacaattatacaatttgctantnttttaactttctcttagaatgttcatactctgaaaaataaaatcaaatgangctcacctgctttacaatanacatttntctaagcacacttganananatgtaaatatgtntcagangctatncatntntatgcngtaatanccanaaaactctggaangnaaaattaaaancngatgttattaacactaanaaaanantnnnccaganagtntctatttcantntctcaangtcgtcncacttncttggaactngatttcntncttnttacactgtattatttctcaaaaagtttcatctcaactaagctacacttcttcatggagaagggaagtctttattctgagcnggaaggagaagagatattagaataaactgantaactcaagagaataatatatgaaatcttcataaggtatgtcacaatgngatacaaatagcaatctgnangaaatattctggtgtnactaaagccaaatataaatgtaatatcttaagatcagacagatgatttg

SEQ ID NO: 595830 - DNA, 971 bp, Homo sapiens
  misc_feature (30)..(30): n is a, c, g, or t
  misc_feature (81)..(81): n is a, c, g, or t
  misc_feature (106)..(106): n is a, c, g, or t
  misc_feature (122)..(123): n is a, c, g, or t
  misc_feature (164)..(164): n is a, c, g, or t
  misc_feature (177)..(177): n is a, c, g, or t
  misc_feature (196)..(196): n is a, c, g, or t
  misc_feature (203)..(203): n is a, c, g, or t
  misc_feature (218)..(218): n is a, c, g, or t
  misc_feature (228)..(228): n is a, c, g, or t
  misc_feature (235)..(235): n is a, c, g, or t
  misc_feature (256)..(256): n is a, c, g, or t
  misc_feature (258)..(258): n is a, c, g, or t
  misc_feature (266)..(267): n is a, c, g, or t
  misc_feature (283)..(283): n is a, c, g, or t
  misc_feature (287)..(287): n is a, c, g, or t
  misc_feature (289)..(289): n is a, c, g, or t
  misc_feature (300)..(301): n is a, c, g, or t
  misc_feature (307)..(308): n is a, c, g, or t
  misc_feature (324)..(324): n is a, c, g, or t
  misc_feature (328)..(328): n is a, c, g, or t
  misc_feature (338)..(339): n is a, c, g, or t
  misc_feature (341)..(341): n is a, c, g, or t
  misc_feature (343)..(343): n is a, c, g, or t
  misc_feature (349)..(349): n is a, c, g, or t
  misc_feature (351)..(351): n is a, c, g, or t
  misc_feature (353)..(354): n is a, c, g, or t
  misc_feature (357)..(358): n is a, c, g, or t
  misc_feature (362)..(362): n is a, c, g, or t
  misc_feature (365)..(365): n is a, c, g, or t
  misc_feature (375)..(375): n is a, c, g, or t
  misc_feature (385)..(385): n is a, c, g, or t
  misc_feature (391)..(391): n is a, c, g, or t
  misc_feature (413)..(413): n is a, c, g, or t
  misc_feature (415)..(416): n is a, c, g, or t
  misc_feature (421)..(422): n is a, c, g, or t
  misc_feature (437)..(437): n is a, c, g, or t
  misc_feature (440)..(440): n is a, c, g, or t
  misc_feature (462)..(462): n is a, c, g, or t
  misc_feature (465)..(465): n is a, c, g, or t
  misc_feature (474)..(474): n is a, c, g, or t
  misc_feature (507)..(507): n is a, c, g, or t
  misc_feature (514)..(514): n is a, c, g, or t
  misc_feature (520)..(520): n is a, c, g, or t
  misc_feature (545)..(545): n is a, c, g, or t
  misc_feature (559)..(559): n is a, c, g, or t
  misc_feature (642)..(642): n is a, c, g, or t
  misc_feature (736)..(737): n is a, c, g, or t
  misc_feature (741)..(741): n is a, c, g, or t
  misc_feature (743)..(743): n is a, c, g, or t
  misc_feature (748)..(748): n is a, c, g, or t
  misc_feature (767)..(768): n is a, c, g, or t
  misc_feature (881)..(881): n is a, c, g, or t
  misc_feature (919)..(919): n is a, c, g, or t
gcagcagagtatcttacttttatataattntataaaaacttatttttatattgttacattgtgaatcacattacaatttantctccttttcaatagaaagattttntaaggacatgatttgnngccgtccacatttatcagatgccttttcattaattttttcnatttttgcaattnttgatccaaactgcatggnccgtttnggcagaagagcagangctgtaagancaagttncacagctgcaaggtgtaaaantnattttttnncaattcctcggggtanagtnangtttgcttttnnccaaannggcagagaatttaganaggngacaacattnngntncagggnangnnatnntgcntcntttccatgancaccaataantctgtnatcacgaccaagacttccagangnnatgcnncccagtcccatcatnatntccttattcaatccttccagcncangggactganagcggagacgatgacgagaataacctggaagtngctcatntgcacnaattccagtgagaactacctttgcnttgctctgataggntttcactccttcctgggccactaaccaaccaattcctctagaagcaaaccagactgcacagccaatgctatcatccaaaactntatccaatggccgaattaagtgacatattcgagttcttcttaatttctgcagttcttccatagaaacattaatttcaacaaaattccaaattgnnaaangnataanaacttgtaattcctttaannccgcccttcctgtgattcgatctggtacactgacatgtttattaggactgtcagcagcagcagcagcaacatctttagagaattcttctgaaggtatttcacatttatttttntgtttattcccttctctgttaaaggtagttggcatggncttttcttcagctatgaaagctacattaagaagatcaattggttatctaaag

SEQ ID NO: 595831 - DNA, 351 bp, Homo sapiens
aggtttactacgatgagacagcccaggagattgtggacgagtttgccatgcgctacggcgtcgagtccatctaccaagccatgacccactttgcctgcctcccctccaagtatatgtgcccagggtgctgcgtcatgagcaccctgctcgccaacatcaatgcctactacgcacacaccaccgcctccaccaacgtgtctgcctccgaccgcttcgccgcctccaactttgggaaagagcgcttcgtgaaactcctggaccagctgcataactccctgcggattgacctctccatgtaccggaaacttcccagccagcagcccggagagactccagaaccccatgatggct

SEQ ID NO: 595832 - DNA, 299 bp, Homo sapiens
  misc_feature (119)..(119): n is a, c, g, or t
  misc_feature (142)..(142): n is a, c, g, or t
gttctttatgtgttctggataacccttatcagatgtatgatttcacaaatattttctttcattctgggagctttactctgttgatagtgtcctttggtgtactaaagtctttaattttnatgaagtccagtttatctatttngttcctgtggttttggtgtcatatttaagaaaccattgggctaggcatggtggctcatgcctctaatcccagcactttgggaggccgaggcaggtggatcacctgaggtcaggagtttgagaccagtctggccaacgtggtgaaccctgtctctact

SEQ ID NO: 595833 - DNA, 443 bp, Homo sapiens
gcaacagaggggggccccgtgtttgaacatttgcatttgggaattggtgttggggcctgtttgaaccccgggagagcccattccagggtgtgtccactcttgtggtttccccattacaaggagttcattcgagcccagggttttgcccaaaaccaggtagtttatttggaggtccccacccatggccaaggtggttgaactcaaaggtcacacatcgggggtcttgattttgcccatgagcccaaatggggccacagtggaatccgcagcagcaaatgagaccctgaggttatggggctgttttgagttggaccctgggcgggggggggagcgggaaaaggccagtgcagccaaaacagcttcatccaccaaggcatccggtgaagaccaacccatcccctcagttgttttttatttttttaataaagtcatgtttcccttca

SEQ ID NO: 595834 - DNA, 1034 bp, Homo sapiens
ggcactctggttcttccgaccggctccgccgtagcgttatctctgctcggatcagccatgagtaaagaggatgatcgccgcgctggtcattgacaatgagctccggtcgtgtgcgaagatggtttcgttggggacgacgtctccccgaaccgtgttccttccatcgtcgggcgccccatacaccaggacgtcatggtgggcgatgggccatgaaagactccttacgtgggcgacgaggcctcagagcaagcagtggaatatccttgactcctgtaagtagcccctagttgagcatgcgtttgtctgttaacctaacatgggactgacgatggcagaagatctggcaccgacaaccttctacgagaatgatgcctgcagcgttggccgccgtgagtgatctaacgcagttgtgtagctgagcgaggggccccctgaaccccttaaggtcaggctggagagaatatgcattcatattatgttagagacttcaagaccccgggccatgtactgtgtgccatccaggccgtgctgtccctctacgtcctctgggcgcaccactggcattgtcatggactctggagacggggtcacccacacaggtgcccatctacgagggctacgccctcccccagccatcctgcgtctggacctggctggccgggactgatcgactacctcatgaagatctcatgagcgaggttaagcttcaccaccacgggcgagcgggaacatcgtgcgcgacattaaggagaagctgtgctaccgtcgccctgattcgagcaggagatggcaccgcgatctcctttctctggaaaaagtagagtgccgatgcaggcatcccaatgaatggcggtcagagtcgaaagctgtcagctcctctgggtggactgcggtccgacccttagcccctaggtgctgggccgcacctgtgcccagggttggcacctcggttgcgaaaaggaccgcccgaagaaacccaagaagggggtgctcccgtgtggagggccctacatggtatctccacttctgtttca

SEQ ID NO: 595835 - DNA, 344 bp, Homo sapiens
gtttgttccctgatgatatctactgacaatactggttgataggactggtccagtagtgccttcgtggactgggttcacccccaggtctgcggctgttgtcacactcttctagcccctgtgtgaaatccaaagcatgtgcaggagcaaatggcaccgagatattccttctgccactgttctcctacgtggtatgtcttcccatcatcataacacgttgcctcatgagggtcacacttgaattctccttttccgttcccaagacatgtgcagctcatcatctggccattttctccctgacggtcccacttctctccaatcttgtagttcacaccattgtcatggca

SEQ ID NO: 595836 - DNA, 439 bp, Homo sapiens
ggggctataagaggaagacacggcattaagggctgaggatttttggtccgaacgcttctgctcctgactaactgctgttcgatctagactaggaacaagaatggccatgaagcagtgtacacagcagtcatggcttttaaggaaacctgaaaaacacccgtgaagccggacatggcaattcaacggattcggatcaccctaacaagcagcaactgtcaaatacttggaaaaggtgagtgctgacttgataagaggcgaatacgaaaagaatctcatagtgaaaggaccagttctgcctaccaagacttagagaatcactacacgactccttgaggtgaatgatctacgacttgggatcgctaccagagtagaatttacaagcgactcattgacttgcacagttcttatgagatcgttaagcacattagttacatcgttg

SEQ ID NO: 595837 - DNA, 131 bp, Homo sapiens
  misc_feature (33)..(33): n is a, c, g, or t
  misc_feature (58)..(58): n is a, c, g, or t
  misc_feature (130)..(130): n is a, c, g, or t
tgtagtgtagctacagttgtgcgtttgagaaanggcttagcactccaaaggacggagnggaacctggacatggtcccgggcatctgaatgatctgtaggggagggagttcaaataaagctttattttgtnc

SEQ ID NO: 595838 - DNA, 410 bp, Homo sapiens
  misc_feature (7)..(7): n is a, c, g, or t
  misc_feature (145)..(145): n is a, c, g, or t
  misc_feature (195)..(195): n is a, c, g, or t
aaggttnctgtataatacaatgtatccttccagagcttcaacggctctaagacctcaatttgaggcagacttcagttgagacccatatctgaagccagacgccagttgagatcatggcctttcttccctctaccacagttagctncccttaaccccatcgccttataaggcacttcttgtaacaattcacaattnccgatatgtatctgagaaacccaaactaacatcacagtaatagagacagtttaagatacattaatgaattttgaggaaaataactttatataggatgaagattagagagtaaagagtcatggatgaaactatgttgctgcttcagctgcaggatactgagaagatggaacagagagaagataagcctgctttgccagctgaagaggcctcaccac

SEQ ID NO: 595839 - DNA, 870 bp, Homo sapiens
  misc_feature (7)..(7): n is a, c, g, or t
  misc_feature (11)..(11): n is a, c, g, or t
  misc_feature (321)..(321): n is a, c, g, or t
  misc_feature (324)..(324): n is a, c, g, or t
  misc_feature (336)..(337): n is a, c, g, or t
  misc_feature (347)..(347): n is a, c, g, or t
  misc_feature (388)..(388): n is a, c, g, or t
  misc_feature (398)..(398): n is a, c, g, or t
  misc_feature (400)..(400): n is a, c, g, or t
  misc_feature (413)..(413): n is a, c, g, or t
  misc_feature (424)..(424): n is a, c, g, or t
  misc_feature (430)..(431): n is a, c, g, or t
  misc_feature (434)..(434): n is a, c, g, or t
  misc_feature (441)..(441): n is a, c, g, or t
agcgggngcgnctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctagaattcgtgatccgcccagccactgccgccgactgcagtgacatactgcgggtgatcaaggagctggctagaatatggatactatggaagaacaagtaatcttaactgaaaaagatctgctagaagaggnttntggagagcaccnncttttaccantgctggttgcagaagtgccgaaagagcaaggacacagcatntgttggtttngncatgtactatttnacctatgaccngtgatnngcnagttatngtatcttgaggattcttcgtgatgagtgatatagaggctgggcataggatcagaaatttgaagaatctaagccaggtggcaatgaaggtgtcggtgcagcacagaatgaatttcttggatagcagaatggattgacattccatcaagtttctataaaagacggggtggttcttgatcttgtccagtgaagaggttggcgactgtccaagatcgacaaggactattgtaaaaatggaacagaggtgtgaggcgtgttggttggtgatgaaactccatttaatttagaaaaatccacatttctggttctatgtgggtgtgtgaaaagatgggccctttcacgttacacagggtgtgtgtgaaagagtgtaaagggaccacacaggggagaatcttctatttgacaaaaggggggtattagaaaaacggttt

SEQ ID NO: 595840 - DNA, 998 bp, Homo sapiens
  misc_feature (7)..(7): n is a, c, g, or t
  misc_feature (11)..(11): n is a, c, g, or t
  misc_feature (321)..(321): n is a, c, g, or t
  misc_feature (324)..(324): n is a, c, g, or t
  misc_feature (336)..(337): n is a, c, g, or t
  misc_feature (347)..(347): n is a, c, g, or t
  misc_feature (516)..(516): n is a, c, g, or t
  misc_feature (526)..(526): n is a, c, g, or t
  misc_feature (528)..(528): n is a, c, g, or t
  misc_feature (541)..(541): n is a, c, g, or t
  misc_feature (552)..(552): n is a, c, g, or t
  misc_feature (558)..(559): n is a, c, g, or t
  misc_feature (562)..(562): n is a, c, g, or t
  misc_feature (569)..(569): n is a, c, g, or t
agcgggngcgnctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctagaattcgtgatccgcccagccactgccgccgactgcagtgacatactgcgggtgatcaaggagctggctagaatatggatactatggaagaacaagtaatcttaactgaaaaagatctgctagaagaggnttntggagagcaccnncttttaccantgctggttgcagaagtgccgaaagagcagctggactccggaaggttacagtctctagctgcgccatgtacatggccttccgtgtacaggtggatgggcggggaggtaagctaagagagatcctttacagcaatgaagtagatgatcatgataaatgaggacacagcatntgttggtttngncatgtactatttnacctatgaccngtgatnngcnagttatngtatcttgaggattcttcgtgatgagtgatatagaggctgggcataggatcagaaatttgaagaatctaagccaggtggcaatgaaggtgtcggtgcagcacagaatgaatttcttggatagcagaatggattgacattccatcaagtttctataaaagacggggtggttcttgatcttgtccagtgaagaggttggcgactgtccaagatcgacaaggactattgtaaaaatggaacagaggtgtgaggcgtgttggttggtgatgaaactccatttaatttagaaaaatccacatttctggttctatgtgggtgtgtgaaaagatgggccctttcacgttacacagggtgtgtgtgaaagagtgtaaagggaccacacaggggagaatcttctatttgacaaaaggggggtattagaaaaacggttt

SEQ ID NO: 595841 - DNA, 336 bp, Homo sapiens
ctcaacattgttacttttttattgacaaacattcgctagagcctttcatctggaatggatcataaaccatatagcgcaatctttgtgcttcctttttgcagcaaaaccggactaatgtctctcttctccacagacattgaacgtccaaagtgatttacaaatcccgcacaacttaaaatgtccacaggacaaagtgcatctgccctgtggcatcgtcatgattgccatgaatactcaacactggaattgaactgctgaggttcccatcttgctcgttcacccatcgaaacttactcaaccccaagtcgactgactcaccactgcagaatctcaaac

SEQ ID NO: 595842 - DNA, 1007 bp, Homo sapiens
  misc_feature (635)..(635): n is a, c, g, or t
gacatggaacactatacctattattcggcgcatgagctggagtcctaggcacagctctaagcctccttgattcgagccgagctgggccagccaggcaaccttctaggtaacgaccacatctacaacgttatcgtgcacagcccatgcatttgtaataatcttcgttcatagctaatacccatcataatcggaggctgtggcaactgactagttcccctaaataatcggtgcccccgtatgatgtgcgtttcccacgcaataaacatacgataagcttcgtgactcgttacctccctctctcctactcctgctcgcatctgctatagtggaggccggagcaggaacaggttgaacagtctatcctcacttagcagggaactattcccatcctggagcctccgtagacctaaccatcttctccttacacgctatgcaggtgtctcctctcatcttatggggccatcgaatgtatcatctacaacagattatcaatataaagacctccactgccataactcataataccaaagcccctcttcgtcgtgatccgtcctaatgcacagcatggtcctacttctcctatctctcccagtcgttagtctgctggcatcactatagctactaacagacccgtnctctaaaccacttcttcgaacgcgcggaggaggagactccattctatacaacatctattctgattttaacggtcaccctggaagttatatgtattatcctatcagggttcgagaattatctccgattgtaactaggatccggaaaaaggaccattgggtacataggctggtctgagcatgaatcaagggtcccaggttatcggggagccccactattcagtgataaacgtgaccccgagaatttactccaggcaaaatgcgtcccggggagataaggatgccaccggaaaaaagtgtgggtggccgaaacatacaggcgggggtaaacaccaccgcggagtcacaagcagggggtcccacagatccacacac

SEQ ID NO: 595843 - DNA, 166 bp, Homo sapiens
gggagtgcgagagaaggaagaagaaggtgatggtgaggaagaggatggagatgaagatgaggaaggaagcactacacgaaatcccagccaggatgtgactgtgccctgcccagttccctcaactccacctagcccttctctctccactcccccttctctctccact

SEQ ID NO: 595844 - DNA, 212 bp, Homo sapiens
  misc_feature (179)..(179): n is a, c, g, or t
gcagatatagagctgggaggatggaatttggagccactgaggggcatccttgccactaagaaaggggagcccacctcggggtgaggctgggagaagccagccagaagaaagcagagttgagagatggcaagagaaaaattgctaatgtcatgagtcaagttcctggatccaaccatacntgaagctgtaatattgcacttgtcaatgagcct

SEQ ID NO: 595845 - DNA, 311 bp, Homo sapiens
tagaagcacattaaccatttctatagcatgatttcttcaagtaaaggcaaaagatataaattttaaccaaggcttaaagtactcaagtcaattataaaatttatatcttttgccttttacttgagtactttaagccttgtttaaaacatttcttacttaacttttgcaaattaaacccattgtagcttacctgtaatatacatagtagtttacctttaaaagttgtaaaaatattgctttaaccaacactgtaaatatttcagataaacattatattcttgtatataaactttacatcctgttttacctaa

SEQ ID NO: 595846 - DNA, 478 bp, Homo sapiens
  misc_feature (272)..(272): n is a, c, g, or t
tctaagaccttttgctggtcagagggtcccatcgctacagccttactgcgccagacgtgctcagatatgtggggaaacgggcagcccccacaaagtcacatggggcaggcctgtgaagctgtaggatgtgggacctacaacatgggtttggtaggtcctcccacatagtgatgaaactcagccccagtgagcagcagctctgcttgtcggatgctcagccagcaagtcagaaagtcctgtgtgatcacagaatggcacttctgggctccggntgccaagagccatttttgcaccgtgtggagggtcagtggggatggcctcaccagatcagccacattctctagggtcaggtattttccgtattgaggagagctgggatctgacacagcctgcaccagctccgagagtctttccacattctgctgtctcagggcaaaaggtgaagactcagctcttcctcagggtccgcaagcaaaaa

SEQ ID NO: 595847 - DNA, 214 bp, Homo sapiens
cgaatcatgaaaggaaggaagaaaagatgaaggaagaaaacaagggaggaagtaaactcatgttattctttgaagagtatactttatcagctttaatgaaaattgtaaattaagagtgatcttgacaaaattttactcactggttatgcttagttaaaattaagcattgagtaaaggcagttcctaaaatcacagccaaaatcctttcatcgat

SEQ ID NO: 595848 - DNA, 362 bp, Homo sapiens
  misc_feature (301)..(301): n is a, c, g, or t
  misc_feature (313)..(313): n is a, c, g, or t
  misc_feature (317)..(317): n is a, c, g, or t
  misc_feature (336)..(336): n is a, c, g, or t
taaaaaaaatgaagaaagacttgctcaaaagtagaatcagagtatacatatttttaaaaattagttttgcccacataaccataaatatttcttcattttgtaagctctttgaaaacatcaaaacagaggaatgtttggatcttgatgtgattaggaattgaataaacgatgtttctcctgaaatgttagagcgataataatgaaactgttgggtcttctgccttcacataaagggacttcaaaaatcttctaaagccccaaaatgtatcttcattaaacatggaaactgagtttactgttncagtttcagttncccnttctgggggtggggggttnggggcaggggggggaccgggttgggg

SEQ ID NO: 595849 - DNA, 309 bp, Homo sapiens
gtgagtgctgggattacaggcatgtgccacatgcccagctaattgtgtatttgtttttatggtagagacagagtttctccatgttggtcagtgctggtctcgaactcctgacctgaggtgatccatctgcctcgacctcccaatgtgctgggattataggtgtgatccactatgcccagcttttattttttttctcttttagaaacagggtcatcgaatctgtcacccaggcttgaattgcaggggcaccatctcgtgatcacagaaacctctgccaccgtgggtccaagcaatatcacgtcgcctcag

SEQ ID NO: 595850 - DNA, 675 bp, Homo sapiens
  misc_feature (497)..(497): n is a, c, g, or t
ggcaaaaaagaaaaaaaaaaaagagaaagaaagaggaggagacagtgattgcagcctctcccggcgcaggtggcagagccttgcggctttggagagaggtggagccttggtgaggttgggaggactgcctaactgcgatctttttctccattcttcctcctgggaacttctccgccctgaaagggtagcgtgagcttcatgccttcggccggccgtgttatactcgttagacccaattcaccatgaatcctttgaaagactagtggagagtgagaagggggtttcaaagtcactggagtaaaggaattctccaagcaccacctcatgattaattcttggaaaagcctgtttgcgcggcccttagaatcattttgacttcttgtctaatggtgaagtttttctctgtaatccttctactctgttttctaaaaccagaactaaaaacctaaaaaattgtaaaacttcatggtgtaattaaaaccccttcaccatttttnttatgtcccttttttgagtatactaattttaaatacttactatctcttatatatattgatttttatcacagaattctcagggtgaaattaaaccaattataggactttttcttgggatgatttctagtcttaaggtatggggacattataaacttgagtacatatgtagtacaaagtt

SEQ ID NO: 595851 - DNA, 1235 bp, Homo sapiens
agcgggcgccgcagcccgctcggcccgagggcccgcctaatccgcgccgcccgtgcccgatcctcctcggaccgcgcccgtgatcgcgggggctcgtcggcgctggtgtactcggcggccaccggtgatcggggctgatgctggtctagttcccgtccccctgtgccgccgacgccgatttccggtacgagctgccggcttggccgtatgctgccgcgtctggcccccgggtccccgccgctgtgtgcggcgcgggcgcagcgggtcaggggggtttgcctggggctgcctgctcgcctcggtgcgccttgtgagttccactagtcctctggggccccgtgctgcgcacggaggacgacagttgggtagcgagaacggtaaccttgccccgaagcttgattggccgcgaagacacgcgattcccctggtaccctcattcctttccactgccacgctcctgggcgtccctgtgttgagaccccacagaacaattacgtcaccgccacggtttttcacacacacacgggcagtaacgggccaaagggactttgcaccacgcaaccacaagttaaccattccggaatgatgggttgcatttcactaaaggcacccattgacaggcttgtggtaccacggcaccaacgttgcttccacattccccacggtttcagaacacaaggattcccccataaaacggtttacaacaccatttttggtgcgcggacacaacacttcattgggcgcgtttcccacagtgttgggcaaatgtttcttcattggaaacagcgggttttatacacaacaggaaactgaaacaacgcttttgaagcgattaacagttggttccacattccttttgcgcgcaaacggcggtatcccatttggaaagagagacacccaaagtggagccaaaaggtgaaacagaaacggaaccgtatgcacgcgggcaacaaaggttggtgaaagcaaaaaagcgaaaaagattgcatattaccaaatgtcttcaaagtggaagtgtaatttcttccccaatgtgtttcatttgcaattgtggaaaaggtgtgttttgagaccgcccacgactggtggcaggaaaaagctttaaatggtccgcgagggagaattgtgggtgaaacgagttggacatttatggtggacaagggaagagattcgagaaaagagatttcagcatacaattgccgcttggaagatatatttaagtggaagtgagaaga

SEQ ID NO: 595852 - DNA, 120 bp, Homo sapiens
tcagctcggtccatatcgatagaaattgaaactggcgcaatagatatagtacgcaagggaaagatgaaaaattataaccaagcattatatagcaaggactaacccctataccaagctgca

SEQ ID NO: 595853 - DNA, 265 bp, Homo sapiens
  misc_feature (14)..(14): n is a, c, g, or t
  misc_feature (39)..(39): n is a, c, g, or t
cccccccccccccncccccacaccacaccgcccacgccnccgaaaaacaaacagaaaataaatcaagagttgaaaaaggaagttatggatggtttaaaaatatgaaaaagaaagtaggagagaaagatattgtgaaagaaaaaatagtaggatatgggataaataatgtatttaaaaataaaaatgttttagtaatagtttatttagaaataagaaaatggaacgatataaaaaaaagataatagcattagagtgcttgggaata

SEQ ID NO: 595854 - DNA, 1158 bp, Homo sapiens
agatggtgcgctgtcacgttcccgactccacgtctcctcgccacctgtctcggctgatcagacgtgcaagatctggaggacgtccaacttctccctgatgacggagctgagcatcaagagcggtaaccccggggagtcctcccgcggctggatgtggggctgcgccttctcgggggactcccagtacatcgtcactgcttcctcgggaccaaacttgggcccggttctggtcgtgtggagagctgggcagagatcaggagaaagtatgggcgagcaccagaacggctggggtctggctgggccttcaatgacagtgtgctgggctagcctgtgacccctcgggcactgcctggtgccggtggtggcagcttggcgggacccatgcagacccaggtcacgagcagaccctcccctgccgggcctgcgccagtttggacctgatgggcccctgtgagcagccttgacctgctgggccaggctgccttgggactctcagccccagttgcttatccagatgtgacagaggctcgaccaatgccaggctgcacactcctgagactgggctagtcttgcacttgcttgggcacagtcggcgaagggcccaatagcttgctcgacggagtcacagaggctggtggacaatcccacaaggataagtggagacacactggaccctccttcccggagatactacagggaccctcggcgaccaaatgagagaaaacacaaccaaccaatgtgccacggctgaacacgcgcctaactaagaccccgtgccacaagcgcgttacacccctgcttccagtgtggccctggcaccaaccaacagacgatgggacacgacccacgctgagcacaaccacagagcactcacacagtgagcggataaaataacgcaccctaccgacccgccccaacacaaccacggcggcgccgctctatcatcacatcctagggtaccattctctactgcgcaacgccgtcttaactcatgctgcaccaagacactatataatacgactgggaggccctagtaatactgtggcagggacacatcaagacacaagctagcgacctcttcttcagtccattattgacccagccatgaagtaccctgccacatatgtcctgcacactaacagatccatagtctagctt

SEQ ID NO: 595855 - DNA, 1038 bp, Homo sapiens
ctcatggcggtccgagcttcgtatcgagaacaactgtgagatcggctgcttagccaagctcaccaacacctactgtctaggtagcgatacggaggctcagagaacttctacagatgtgtatcgagggctgagctctaccgataccatccccgtggtagcacgcgtactatcgccgtgctgccgcatcatacgggcgcatagtgtgtaggggaacaggcacggtctcctggtacccaacaagtaccaccgaccaggagactgcaacacattcgcaacagcctcccagacacagtgcagattacgcgggtggaggagcggctctcagaccttgggacaagagtcaccacctgcaatgactacgtggcctatggtcacaaccagacattggacagggcagacagaagaaatatctggcagatgtgctcaaggtgtgcacagtctatccacacagacagtggccgaaccagcgtgctagtcaggacagctactggtgtcatatcagcactccagggcagggctgggtgcatccccaagacattcaactctgaagcaccaggatgcaagctgtccttcctctattcattcaagatccccccttgtgcgccgatagactggtgaacccagaggacagtgagcgcagcactgcttgcactgtggacatggctgggatcgcactgacctggctggtgtcctatctggttcacccatggcaacaacacccaggcacacgtgcctgtccagtgcgtgcactaactggtcctaccaaagcctgacatgaaagccaaggccatagcacccgatgagccaacaaacaagtcagcaaatcccccccacagaacaggccacacccaagaagacccaccgctccaaagcgctaggccccaaaagaggaaccacgcagggggactatgagacaacaggaggccaaacaccacctacccacaacatcccaccccacaaaccggcaccaagaagagaaatgaaaacggcaagaagcacaagacacgccaccagggcagcagtagaggagaaagacac

SEQ ID NO: 595856 - DNA, 99 bp, Homo sapiens
gccagcaccaaccagacatctatgtacctctgtgccagcagacttgaccgggcctcctcctacgagcagtacttcgggccgggcaccaggctcacggtc

SEQ ID NO: 595857 - DNA, 297 bp, Homo sapiens
atgtcggacctctaccgaacgtggtggatacagtgctaccatgtacacccgtatcacagcacgctcggatgtaatctccctagactggccgtctctttccataccggaggacattgatatggcccttctgactatcaagcctctagtcaattggcactaagtggttccgggtcgagtcgtacgtctcgagctcatcgctgatccttgatcttatatcgaagggaaaagtttagggtaatcgggagctaaggtaggtaaataaacaggcaactcaattgctatgttaacaagcagcag

SEQ ID NO: 595858 - DNA, 183 bp, Homo sapiens
actacaggtaacagtattagagacgggattcatcatgttggacaggatgatcacgaactactgactcagtgatccggcaccacattggcctcccaaagtactggctgggattgcaggagtgagccaccgtgcccagccttgccctgctttctaggagatggagttcactgaatttttctgtat

SEQ ID NO: 595859 - DNA, 702 bp, Homo sapiens
  misc_feature (7)..(7): n is a, c, g, or t
  misc_feature (18)..(18): n is a, c, g, or t
  misc_feature (57)..(57): n is a, c, g, or t
  misc_feature (185)..(185): n is a, c, g, or t
gtcaacnctgccatgtanacggcgaagtgaggaaaattaaatcaaccaaccaagacncttctattccaaaaagggaagccaggcaggcagcagcagccctagatatacccattaggaatcctgattagcgagtattgagaagcttcctacactgggagtgggaaattccttaaatagcctctaantctaatctctgggaggaaccttcttttccattattatttgtggtggctccatcctctggaaagttcttttccattattatttgtggtggctccatcctctggaaagttcttccttatttcttattccctggctgtcacctctgaagtggctgttaagaagtgtgctcttcttgcggatctttggcttcataactcattctgcaagagtaaagacggaaactaatgggtgttttaggtttaaggtctgtcatttgcggactctggggctgtgggagaaaaaataaatcgtttggttcatgcacacaatgtgacagcttggcataagtaaaagacatgaacaaaaggattaatgaagaagtgaaagaaagaaggcgtatacattaggcacaacatcacctaaaaaaaaaaaactggaatgcattaaacttgttcattcaaaaagtgttggctgagtgcctactaagtgtcaagcactgaaccagatgtggaggattcagtggcaacacacggaaaagtt

SEQ ID NO: 595860 - DNA, 3529 bp, Homo sapiens
  misc_feature (301)..(301): n is a, c, g, or t
  misc_feature (307)..(308): n is a, c, g, or t
  misc_feature (329)..(330): n is a, c, g, or t
  misc_feature (333)..(335): n is a, c, g, or t
  misc_feature (337)..(337): n is a, c, g, or t
  misc_feature (343)..(343): n is a, c, g, or t
aagaaaatggcgacaagaagattgtccccaagaagaagaagcccctgaagttggggcccatcaagaagaaggacctgaagaagcttgtgctgtacctgaagaatggggctgactgtccctgccaccagctggacaacctcagccaccacttcctcatcatgggccgcaagtgaagagccagtacttgctgacggccatccacaagtgggacaagaaaaacaaggagttcaaaaacttcatgaagaaaatgaaaaaccatgagtgccccacctttcagtccgtgtttaagtgattctcccantcgcanntggggagggagcctcgggtgnngtnnnancggtgnggacagtgccccgggaacccggtgggtcacacacacgcactgcgcctgtcagtagtggacattgtaatccagtcggcttgttcttgcagcattcccgctcccttccctccatagccacgctccaaaccccagggtagccatggccgggtaaagcaagggccatttagattaggaaggtttttaagatccgcaatgtggagcagcagccactgcacaggaggaggtgacaaaccatttccaacagcaacacagccactaaaacacaaaaagggggattgggcggaaagtgagagccagcagcaaaaactacattttgcaacttgttggtgtggatctattggctgatctatgcctttcaactagaaaattctaatgattggcaagtcacgttgttttcaggtccagagtagtttctttctgtctgctttaaatggaaacagactcataccacacttacaattaaggtcaagcccagaaagtgataagtgcagggaggaaaagtgcaagtccattatgtaatagtgacagcaaagggaccaggggagaggcattgccttctctgcccacagtctttccgtgtgattgtctttgaatctgaatcagccagtctcagatgccccaaagtttcggttcctatgagcccggggcatgatctgatccccaagacatgtggaggggcagcctgtgcctgcctttgtgtcagaaaaaggaaaccacagtgagcctgagagagacggcgattttcgggctgagaaggcagtagttttcaaaacacatagttaaaaaagaaacaaatgaaaaaaattttagaacagtccagcaaattgctagtcagggtgaattgtgaaattgggtgaagagcttaggattctaatctcatgttttttccttttcacatttttaaaagaacaatgacaaacacccacttatttttcaaggttttaaaacagtctacattgagcatttgaaaggtgtgctagaacaaggtctcctgatccgtccgaggctgcttcccagaggagcagctctccccaggcatttgccaagggaggcggatttccctggtagtgtagctgtgtggctttccttcctgaagagtccgtggttgccctagaacctaacaccccctagcaaaactcacagagctttccgtttttttctttcctgtaaagaaacatttcctttgaacttgattgcctatggatcaaagaaattcagaacagcctgcctgtccccccgcactttttacatatatttgtttcatttctgcagatggaaagttgacatgggtggggtgtccccatccagcgagagagtttcaaaagcaaaacatctctgcagtttttcccaagtaccctgagatacttcccaaagcccttatgtttaatcagcgatgtatataagccagttcacttagacaactttacccttcttgtccaatgtacaggaagtagttctaaaaaaaatgcatattaatttcttcccccaaagccggattcttaattctctgcaacactttgaggacatttatgattgtccctctgggccaatgcttatacccagtgaggatgctgcagtgaggctgtaaagtggccccctgcggccctagcctgacccggaggaaaggatggtagattctgttaactcttgaagactccagtatgaaaatcagcatgcccgcctagttacctaccggagagttatcctgataaattaacctctcacagttagtgatcctgtccttttaacaccttttttgtggggttctctctgacctttcatcgtaaagtgctggggaccttaagtgatttgcctgtaattttggatgattaaaaaatgtgtatatatattagctaattagaaatattctacttctctgttgtcaaactgaaattcagagcaagttcctgagtgcgtggatctgggtcttagttctggttgattcactcaagagttcagtgctcatacgtatctgctcattttgacaaagtgcctcatgcaaccgggccctctctctgcggcagagtccttagtggaggggtttacctggaacattagtagttaccacagaatacggaagagcaggtgactgtgctgtgcagctctctaaatgggaattctcaggtaggaagcaacagcttcagaaagagctcaaaataaattggaaatgtgaatcgcagctgtgggttttaccaccgtctgtctcagagtcccaggaccttgagtgtcattagttactttattgaaggttttagacccatagcagctttgtctctgtcacatcagcaatttcagaaccaaaagggaggctctctgtaggcacagagctgcactatcacgagcctttgtttttctccacaaagtatctaacaaaaccaatgtgcagactgattggcctggtcattggtctccgagagaggaggtttgcctgtgatttcctaattatcgctagggccaaggtgggatttgtaaagctttacaataatcattctggatagagtcctgggaggtccttggcagaactcagttaaatctttgaagaatatttgtagttatcttagaagatagcatgggaggtgaggattccaaaaacattttatttttaaaatatcctgtgtaacacttggctcttggtacctgtgggttagcatcaagttctccccagggtagaattcaatcagagctccagtttgcatttggatgtgtaaattacagtaatcccatttcccaaacctaaaatctgtttttctcatcagactctgagtaactggttgctgtgtcataacttcatagatgcaggaggctcaggtgatctgtttgaggagagcaccctaggcagcctgcagggaataacatactggccgttctgacctgttgccagcagatacacaggacatggatgaaattcccgtttcctctagtttcttcctgtagtactcctcttttagatcctaagtctcttacaaaagctttgaatactgtgaaaatgttttacattccatttcatttgtgttgtttttttaactgcattttaccagatgttttgatgttatcgcttatgttaatagtaattcccgtacgtgttcattttattttcatgctttttcagccatgtatcaatattcacttgactaaaatcactcaattaatcaaaaaaaaaaacacacacaacaaccccacaaacaa

SEQ ID NO: 595861 - DNA, 909 bp, Homo sapiens
tttttgttagtattctgccttgatgatctgtctaatgctgtcagtggagtgttgagagtctcccactattattgtgtggtattttaagtcttttcataggccaagaataacgtgttttattaatctgggccctccagtgttgcatatgtatatatttaggatagttaagtcttcttgttgggttgtaccccctattattatgtaatgccctcctttgtccgtcttaatttttactggtttaaaatctattttatctgatataagaatagtgactcctgttgtttcttgtttgtgtttgtatggtagatcttactctatcactttacttttagcctgtgggtgtcatcacttgtgagatggatctgttgaagacagcagatggttggatattctttttatccagcttgccattatatgactcttaagtggggcatttagccaatttatattaaggattggtattgatatgtgagatttcgatcctatcatcatgtcgttagctagttattatgtagacttgattatatgatccggctttcatagcgcctatgagctgtgtgactaagcatgtttgtggtaactgcctgtcacctccggcttccatgtctagcattccctaaaggactggtaaggctggccctagcttgaggatgaattccctcagtagtttggcttgtctgagcaaggactcttatctcctccttccctttatcagcctcaaggttgtcgccacgactatgacgattctttgggttggcaattgctctgcctctcaccctctccttgccaatcggcccccatgtctggctctctccgcgttcagctccgcggcctgcccaatacccctgtggggttcctccttccttcttgcactggcaccttctctctactgcccctcccgctcttccc

SEQ ID NO: 595862 - DNA, 161 bp, Homo sapiens
aaaaaaaggaattcttttgtgtatatataaaaacctgcatgatatactgtagtcaatgttcggttcctccaaaggtcttgctgctgtcaggtgttatgccctccatccctcataactgtatgaaacccctttcatatgtaaataaacgtggggcctttgga

SEQ ID NO: 595863 - DNA, 811 bp, Homo sapiens
  misc_feature (614)..(614): n is a, c, g, or t
ggtgcagaggaggcaaaaggataggaatgaaccagtgaacaaaaaaatgaaaaactttggaacccctggaaaaacccccgcaagtaccagattgaaccaggggagcccccaggcgggggaaaccggccaggggcatttttaatcttttaagagactccgtgtccagaggggaaacgactggtggcacaggaacacaagttaaaaaaattacctggtaaaaggttagagaactgatctattaagaagaaattcaaggctgggaagggacagatgaaataattgggactttaagagaaacaactctaatataatgcgaagaaaacacaatttgaaagaaaccaaatattcgggaaggtagcgaatccaaataccaaagtgggggaagccatgccagaaaaaccaatcctgaataaaaaaggaaaggagtggagacgggaaaacaggggaaattggaaaaaaggtgttaatgggttaaaagaagggaaagggttttcaagagggaaaaataaggtaagggttgatgttccaaaaaaaataacccctaaatttaaaggaatcaacccccaaaaaaaaaggcccaagccctgggttaacaccaaaaggggtattaaatnttttggggggggaaaaaagggggtctggttccaaacaaaataacttcaaaaaggccccaaaggtgagggggaattctttaaaatcttttaaagagggacacccttcgggcagggaggggtgctgtggggtattaacaagggatgggtaactcttggggtcacaagcctcccgccacccgggggataccatcccggcg

SEQ ID NO: 595864 - DNA, 108 bp, Homo sapiens
ttgtggcgagatactgccttagccttggcttcccactgtcctttccagctttgcctccagccatgttctcggcgccgactccgcctccgctcggccgcgcgcccacta

SEQ ID NO: 595865 - DNA, 3491 bp, Homo sapiens
  misc_feature (301)..(301): n is a, c, g, or t
  misc_feature (307)..(308): n is a, c, g, or t
  misc_feature (329)..(330): n is a, c, g, or t
  misc_feature (333)..(335): n is a, c, g, or t
  misc_feature (337)..(337): n is a, c, g, or t
  misc_feature (343)..(343): n is a, c, g, or t
aagaaaatggcgacaagaagattgtccccaagaagaagaagcccctgaagttggggcccatcaagaagaaggacctgaagaagcttgtgctgtacctgaagaatggggctgactgtccctgccaccagctggacaacctcagccaccacttcctcatcatgggccgcaagtgaagagccagtacttgctgacggccatccacaagtgggacaagaaaaacaaggagttcaaaaacttcatgaagaaaatgaaaaaccatgagtgccccacctttcagtccgtgtttaagtgattctcccantcgcanntggggagggagcctcgggtgnngtnnnancggtgnggacagtgccccgggaacccggtgggtcacacacacgcactgcgcctgtcagtagtggacattgtaatccagtcggcttgttcttgcagcattcccgctcccttccctccatagccacgctccaaaccccagggtagccatggccgggtaaagcaagggccatttagattaggaaggtttttaagatccgcaatgtggagcagcagccactgcacaggaggaggtgacaaaccatttccaacagcaacacagccactaaaacacaaaaagggggattgggcggaaagtgagagccagcagcaaaaactacattttgcaacttgttggtgtggatctattggctgatctatgcctttcaactagaaaattctaatgattggcaagtcacgttgttttcaggtccagagtagtttctttctgtctgctttaaatggaaacagactcataccacacttacaattaaggtcaagcccagaaagtgataagtgcagggaggaaaagtgcaagtccattatgtaatagtgacagcaaagggaccaggggagaggcattgccttctctgcccacagtctttccgtgtgattgtctttgaatctgaatcagccagtctcagatgccccaaagtttcggttcctatgagcccggggcatgatctgatccccaagacatgtggaggggcagcctgtgcctgcctttgtgtcagaaaaaggaaaccacagtgagcctgagagagacggcgattttcgggctgagaaggcagtagttttcaaaacacatagttaaaaaagaaacaaatgaaaaaaattttagaacagtccagcaaattgctagtcagggtgaattgtgaaattgggtgaagagcttaggattctaatctcatgttttttccttttcacatttttaaaagaacaatgacaaacacccacttatttttcaaggttttaaaacagtctacattgagcatttgaaaggtgtgctagaacaaggtctcctgatccgtccgaggctgcttcccagaggagcagctctccccaggcatttgccaagggaggcggatttccctggtagtgtagctgtgtggctttccttcctgaagagtccgtggttgccctagaacctaacaccccctagcaaaactcacagagctttccgtttttttctttcctgtaaagaaacatttcctttgaacttgattgcctatggatcaaagaaattcagaacagcctgcctgtccccccgcactttttacatatatttgtttcatttctgcagatggaaagttgacatgggtggggtgtccccatccagcgagagagtttcaaaagcaaaacatctctgcagtttttcccaagtaccctgagatacttcccaaagcccttatgtttaatcagcgatgtatataagccagttcacttagacaactttacccttcttgtccaatgtacaggaagtagttctaaaaaaaatgcatattaatttcttcccccaaagccggattcttaattctctgcaacactttgaggacatttatgattgtccctctgggccaatgcttatacccagtgaggatgctgcagtgaggctgtaaagtggccccctgcggccctagcctgacccggaggaaaggatggtagattctgttaactcttgaagactccagtatgaaaatcagcatgcccgcctagttacctaccggagagttatcctgataaattaacctctcacagttagtgatcctgtccttttaacaccttttttgtggggttctctctgacctttcatcgtaaagtgctggggaccttaagtgatttgcctgtaattttggatgattaaaaaatgtgtatatatattagctaattagaaatattctacttctctgttgtcaaactgaaattcagagcaagttcctgagtgcgtggatctgggtcttagttctggttgattcactcaagagttcagtgctcatacgtatctgctcattttgacaaagtgcctcatgcaaccgggccctctctctgcggcagagtccttagtggaggggtttacctggaacattagtagttaccacagaatacggaagagcaggtgactgtgctgtgcagctctctaaatgggaattctcaggtaggaagcaacagcttcagaaagagctcaaaataaattggaaatgtgaatcgcagctgtgggttttaccaccgtctgtctcagagtcccaggaccttgagtgtcattagttactttattgaaggttttagacccatagcagctttgtctctgtcacatcagcaatttcagaaccaaaagggaggctctctgtaggcacagagctgcactatcacgagcctttgtttttctccacaaagtatctaacaaaaccaatgtgcagactgattggcctggtcattggtctccgagagaggaggtttgcctgtgatttcctaattatcgctagggccaaggtgggatttgtaaagctttacaataatcattctggatagagtcctgggaggtccttggcagaactcagttaaatctttgaagaatatttgtagttatcttagaagatagcatgggaggtgaggattccaaaaacattttatttttaaaatatcctgtgtaacacttggctcttggtacctgtgggttagcatcaagttctccccagggtagaattcaatcagagctccagtttgcatttggatgtgtaaattacagtaatcccatttcccaaacctaaaatctgtttttctcatcagactctgagtaactggttgctgtgtcataacttcatagatgcaggaggctcaggtgatctgtttgaggagagcaccctaggcagcctgcagggaataacatactggccgttctgacctgttgccagcagatacacaggacatggatgaaattcccgtttcctctagtttcttcctgtagtactcctcttttagatcctaagtctcttacaaaagctttgaatactgtgaaaatgttttacattccatttcatttgtgttgtttttttaactgcattttaccagatgttttgatgttatcgcttatgttaatagtaattcccgtacgtgttcattttattttcatgctttttcagccatgtatcaatattcacttgactaaaatcactcaatta

SEQ ID NO: 595866 - DNA, 2300 bp, Homo sapiens
  misc_feature (23)..(24): n is a, c, g, or t
ccgggtggtacgaggcgccgtannttgatcaaagagccacgggatctctcacggtttaaaacagtctacattgagcatttgaaaggtgtgctagaacaaggtctcctgatccgtccgaggctgcttcccagaggagcagctctccccaggcatttgccaagggaggcggatttccctggtagtgtagctgtgtggctttccttcctgaagagtccgtggttgccctagaacctaacaccccctagcaaaactcacagagctttccgtttttttctttcctgtaaagaaacatttcctttgaacttgattgcctatggatcaaagaaattcagaacagcctgcctgtccccccgcactttttacatatatttgtttcatttctgcagatggaaagttgacatgggtggggtgtccccatccagcgagagagtttcaaaagcaaaacatctctgcagtttttcccaagtaccctgagatacttcccaaagcccttatgtttaatcagcgatgtatataagccagttcacttagacaactttacccttcttgtccaatgtacaggaagtagttctaaaaaaaatgcatattaatttcttcccccaaagccggattcttaattctctgcaacactttgaggacatttatgattgtccctctgggccaatgcttatacccagtgaggatgctgcagtgaggctgtaaagtggccccctgcggccctagcctgacccggaggaaaggatggtagattctgttaactcttgaagactccagtatgaaaatcagcatgcccgcctagttacctaccggagagttatcctgataaattaacctctcacagttagtgatcctgtccttttaacaccttttttgtggggttctctctgacctttcatcgtaaagtgctggggaccttaagtgatttgcctgtaattttggatgattaaaaaatgtgtatatatattagctaattagaaatattctacttctctgttgtcaaactgaaattcagagcaagttcctgagtgcgtggatctgggtcttagttctggttgattcactcaagagttcagtgctcatacgtatctgctcattttgacaaagtgcctcatgcaaccgggccctctctctgcggcagagtccttagtggaggggtttacctggaacattagtagttaccacagaatacggaagagcaggtgactgtgctgtgcagctctctaaatgggaattctcaggtaggaagcaacagcttcagaaagagctcaaaataaattggaaatgtgaatcgcagctgtgggttttaccaccgtctgtctcagagtcccaggaccttgagtgtcattagttactttattgaaggttttagacccatagcagctttgtctctgtcacatcagcaatttcagaaccaaaagggaggctctctgtaggcacagagctgcactatcacgagcctttgtttttctccacaaagtatctaacaaaaccaatgtgcagactgattggcctggtcattggtctccgagagaggaggtttgcctgtgatttcctaattatcgctagggccaaggtgggatttgtaaagctttacaataatcattctggatagagtcctgggaggtccttggcagaactcagttaaatctttgaagaatatttgtagttatcttagaagatagcatgggaggtgaggattccaaaaacattttatttttaaaatatcctgtgtaacacttggctcttggtacctgtgggttagcatcaagttctccccagggtagaattcaatcagagctccagtttgcatttggatgtgtaaattacagtaatcccatttcccaaacctaaaatctgtttttctcatcagactctgagtaactggttgctgtgtcataacttcatagatgcaggaggctcaggtgatctgtttgaggagagcaccctaggcagcctgcagggaataacatactggccgttctgacctgttgccagcagatacacaggacatggatgaaattcccgtttcctctagtttcttcctgtagtactcctcttttagatcctaagtctcttacaaaagctttgaatactgtgaaaatgttttacattccatttcatttgtgttgtttttttaactgcattttaccagatgttttgatgttatcgcttatgttaatagtaattcccgtacgtgttcattttattttcatgctttttcagccatgtatcaatattcacttgactaaaatcactcaattaatcaaaaaaaaaaacacacacaacaaccccacaaacaa

SEQ ID NO: 595867 - DNA, 188 bp, Homo sapiens
tcggtactagaagcatctggactctaggtctcagtcatggagtgtctcacccattggccccatgcagtgacgctacggttccctccccacccgtgatcacgacactggaatcgtgtgctgatgattggcatctgcaatgcgcccatttactagagcctaccctggacatctacaggcaggatgcggct

SEQ ID NO: 595868 - DNA, 1560 bp, Homo sapiens
  misc_feature (301)..(301): n is a, c, g, or t
  misc_feature (307)..(308): n is a, c, g, or t
  misc_feature (329)..(330): n is a, c, g, or t
  misc_feature (333)..(335): n is a, c, g, or t
  misc_feature (337)..(337): n is a, c, g, or t
  misc_feature (343)..(343): n is a, c, g, or t
aagaaaatggcgacaagaagattgtccccaagaagaagaagcccctgaagttggggcccatcaagaagaaggacctgaagaagcttgtgctgtacctgaagaatggggctgactgtccctgccaccagctggacaacctcagccaccacttcctcatcatgggccgcaagtgaagagccagtacttgctgacggccatccacaagtgggacaagaaaaacaaggagttcaaaaacttcatgaagaaaatgaaaaaccatgagtgccccacctttcagtccgtgtttaagtgattctcccantcgcanntggggagggagcctcgggtgnngtnnnancggtgnggacagtgccccgggaacccggtgggtcacacacacgcactgcgcctgtcagtagtggacattgtaatccagtcggcttgttcttgcagcattcccgctcccttccctccatagccacgctccaaaccccagggtagccatggccgggtaaagcaagggccatttagattaggaaggtttttaagatccgcaatgtgaatgtgaatcgcagctgtgggttttaccaccgtctgtctcagagtcccaggaccttgagtgtcattagttactttattgaaggttttagacccatagcagctttgtctctgtcacatcagcaatttcagaaccaaaagggaggctctctgtaggcacagagctgcactatcacgagcctttgtttttctccacaaagtatctaacaaaaccaatgtgcagactgattggcctggtcattggtctccgagagaggaggtttgcctgtgatttcctaattatcgctagggccaaggtgggatttgtaaagctttacaataatcattctggatagagtcctgggaggtccttggcagaactcagttaaatctttgaagaatatttgtagttatcttagaagatagcatgggaggtgaggattccaaaaacattttatttttaaaatatcctgtgtaacacttggctcttggtacctgtgggttagcatcaagttctccccagggtagaattcaatcagagctccagtttgcatttggatgtgtaaattacagtaatcccatttcccaaacctaaaatctgtttttctcatcagactctgagtaactggttgctgtgtcataacttcatagatgcaggaggctcaggtgatctgtttgaggagagcaccctaggcagcctgcagggaataacatactggccgttctgacctgttgccagcagatacacaggacatggatgaaattcccgtttcctctagtttcttcctgtagtactcctcttttagatcctaagtctcttacaaaagctttgaatactgtgaaaatgttttacattccatttcatttgtgttgtttttttaactgcattttaccagatgttttgatgttatcgcttatgttaatagtaattcccgtacgtgttcattttattttcatgctttttcagccatgtatcaatattcacttgactaaaatcactcaattaatcaaaaaaaaaaacacacacaacaaccccacaaacaa

SEQ ID NO: 595869 - DNA, 782 bp, Homo sapiens
  misc_feature (567)..(567): n is a, c, g, or t
  misc_feature (576)..(576): n is a, c, g, or t
agcgggggttccgggctgatcaggagacgcctccatcctggcgtggatgacctcaggatcagtcccgtctggcccactcaaaccggagtctggtccccgaaagcgctcagtcagaatccgagagcaagtgtgggcagggcgacccgccgatgtggacgacagggacgtgaagacaagagggaaccgccgaattcgcaacgtgttactacacgccagtcctaggaacaggtgcgccaaggcgtgcgtctgcaccgggttgcacccgacaacctgggagcggggtagatacttgtgagcaagtaaatgaggacgtcgtaccacgagatacgtgctgtggtgcgagcgctcatgaggtacacatccatggcttctctcacatacactgcactgattgagtagtgaagctgcttggtcctcccagagaagtgaatatgaagctgtgatcgtctgtggctcttcacgaggcatgacgcggatggccttccgaggaacccaacaatcacgtcacggactcgaggatcttcagacggctgaatcttcgaagacccgcaaatcggccgcgtgtgnctgaagtgnccaacgggaacgcccagtgtggcgctacagggcgcttcgcagggactgggggaacacgttggtcgcttcacttgatacgccccgttcgcccgtctggttgcgcgtgcacatctgggcatacgcgggtcagagtttgtgcacggggcctgggttcgatcgcgcaggcaaattcaggtcgtagggagacgtaccatatcccttggggg

SEQ ID NO: 595870 - DNA, 268 bp, Homo sapiens
tggcgactgactagattcgcctaatatcgcgtgcccccgatatggcgttccccgctataacaatcattagcttctgactcttacctccctctcatcctactcctgttcgcatctgctatagtggaggccggagcacgaacaggttgaacagtctaccctcccttagcacggaactacttccagcctgtagcctccttcgagctaatcaatcttctccttacacctagcaggtgtctcctctatcttagggggcatccagggtaccgag

SEQ ID NO: 595871 - DNA, 2037 bp, Homo sapiens
  misc_feature (301)..(301): n is a, c, g, or t
  misc_feature (307)..(308): n is a, c, g, or t
  misc_feature (329)..(330): n is a, c, g, or t
  misc_feature (333)..(335): n is a, c, g, or t
  misc_feature (337)..(337): n is a, c, g, or t
  misc_feature (343)..(343): n is a, c, g, or t
  misc_feature (1907)..(1907): n is a, c, g, or t
  misc_feature (1911)..(1911): n is a, c, g, or t
  misc_feature (1923)..(1923): n is a, c, g, or t
  misc_feature (1930)..(1930): n is a, c, g, or t
aagaaaatggcgacaagaagattgtccccaagaagaagaagcccctgaagttggggcccatcaagaagaaggacctgaagaagcttgtgctgtacctgaagaatggggctgactgtccctgccaccagctggacaacctcagccaccacttcctcatcatgggccgcaagtgaagagccagtacttgctgacggccatccacaagtgggacaagaaaaacaaggagttcaaaaacttcatgaagaaaatgaaaaaccatgagtgccccacctttcagtccgtgtttaagtgattctcccantcgcanntggggagggagcctcgggtgnngtnnnancggtgnggacagtgccccgggaacccggtgggtcacacacacgcactgcgcctgtcagtagtggacattgtaatccagtcggcttgttcttgcagcattcccgctcccttccctccatagccacgctccaaaccccagggtagccatggccgggtaaagcaagggccatttagattaggaaggtttttaagatccgcaatgtggagcagcagccactgcacaggaggaggtgacaaaccatttccaacagcaacacagccactaaaacacaaaaagggggattgggcggaaagtgagagccagcagcaaaaactacattttgcaacttgttggtgtggatctattggctgatctatgcctttcaactagaaaattctaatgattggcaagtcacgttgttttcaggtccagagtagtttctttctgtctgctttaaatggaaacagactcataccacacttacaattaaggtcaagcccagaaagtgataagtgcagggaggaaaagtgcaagtccattatgtaatagtgacagcaaagggaccaggggagaggcattgccttctctgcccacagtctttccgtgtgattgtctttgaatctgaatcagccagtctcagatgccccaaagtttcggttcctatgagcccggggcatgatctgatccccaagacatgtggaggggcagcctgtgcctgcctttgtgtcagaaaaaggaaaccacagtgagcctgagagagacggcgattttcgggctgagaaggcagtagttttcaaaacacatagttaaaaaagaaacaaatgaaaaaaattttagaacagtccagcaaattgctagtcagggtgaattgtgaaattgggtgaagagcttaggattctaatctcatgttttttccttttcacatttttaaaagaacaatgacaaacacccacttatttttcaaggttttaaaacagtctacattgagcatttgaaaggtgtgctagaacaaggtctcctgatccgtccgaggctgcttcccagaggagcagctctccccaggcatttgccaagggaggcggatttccctggtagtgtagctgtgtggctttccttcctgaagagtccgtggttgccctagaacctaacaccccctagcaaaactcacagagctttccgtttttttctttcctgtaaagaaacatttcctttgaacttgattgcctatggatcaaagaaattcagaacagcctgcctgtccccccgcactttttacatatatttgtttcatttctgcagatggaaagttgacatgggtggggtgtccccatccagcgagagagtttcaaaagcaaaacatctctgcagtttttcccaagtaccctgagatacttcccaaagcccttatgtttaatcagcgatgtatataagccagttcacttagacaactttacccttcttgtccaatgtacaggaagtagttctaaaaaaaatgcatattaatttcttcccccaaagccggattcttaattctctgcaacactttgaggacatttatgattgtccctctgggccaatgcttataccaggngganctgcggaggtgnaagtggncctgggctattgacgggaagttgaactacctcaaacccctaataatcgcaaacggagaccaaatacaaagggctaccctgggggaaccaaaggggacgcaaagaaca

SEQ ID NO: 595872 - DNA, 182 bp, Homo sapiens
  misc_feature (129)..(129): n is a, c, g, or t
tgtgtgagtacggaatcagtggtcagaggggctcctagttgcctccaaggtgaccatatgtgccagtgcatgagacacaggaagcaggcaggattgggtacgactgttaggagcatcatgttcctactnactcgtcactaagagtatgagccctgcttccctgtgtctcatgcactggcaca

SEQ ID NO: 595873 - DNA, 763 bp, Homo sapiens
  misc_feature (1)..(1): n is a, c, g, or t
nggacaaggcgccagagggccgccgccgtccgcggcccgctcagctgggggcgccccccccccacaaagggggcgcgtgttcccccgagaatatccgctcgcgcaaaaaatgtggtctccacacgaccgctcggtcttttaaaaaagagacggacagatatgctggctcccgcgcccccgcgaaatgggggtgtgaagaaacaaaaccgcgccgcccctcgtcaaattatctacagagacacggtgtgataaagaacgcccccggtgggcgccgcccaccagtagcgccgcccgccgcacgagatgcgatcccaggcgcgtcgcctggtggtgcaacaacgcacccaccacaggtggggctcctccccagcacgcgcagcccacaaacccggcgcggcgcgtgtatatgctgcgtccctacgagaaagagacacgcaccgcggggccccccccaagaacacaatataacaaagaaagagagcgcgcccgccacgaagaatacggtgcaaaacacatattttgcgcccccacagcacgatatacgacaaatggagcgactaaaggaggaacgcgcgccccgggcacgcccattcgcgcgacaagaggaccccagaggttctcgcctactccgacggaggtctttaaacatggtagagtgcttcgaagccccctggccaggagaaacaaagagttgttcttctgagggcgaccacaaaacaacaagaagagtcggagagagtcccgtccaaacaaaaacaaagaa

SEQ ID NO: 595874 - DNA, 150 bp, Homo sapiens
gtctgcgaatgtcttttggttggtgctagtatctaaagtgattctccactgctgaggttattacgtagacatttttttaggctgacagatcataagtgacttctagttcgcttcgatgtctagactagtcagttggcgggggtctagtgg

SEQ ID NO: 595875 - DNA, 338 bp, Homo sapiens
tgtttagaagtggcacttctaggggattaagcggggtaatgcctgttggggcacagtgcccccctagttggggggtagggtctagtctgaagtggtaaaaggctcagaaaattcctgcgtgcacaggtggtgtgtggtgcccttggtatgtgctttctcgtgttacttcgcgccatcattggtatatggttagtgtgttggttagtaggcatagtatgagaagcgtatatgaagtgaaagtgaattccacatggctagcccggagtgtcattaggaggtctgagagggcccctgttagggctcatggtctgggtttcactatatgatacgcatgtgct

SEQ ID NO: 595876 - DNA, 117 bp, Homo sapiens
catatactataagcagaccgcaactcaacaccagcttcttcgaccccgccggaggaggataccccattctataccaacacctattctgattttacggtcaccctgaagtgtcaacgt

SEQ ID NO: 595877 - DNA, 555 bp, Homo sapiens
acgctctctttatccaagctgttatgcattattgagacatgcacttctacacaggaatgcgggtgacagatttattcatttatcaatccctaaattacaacgaagcggcaattacaggcatatgcgaccgtgcccgaatgatttaagtgtttttagtaaatacggctctcactcattttgggaagggtggcctcaagctattgacattaggtgatgcgactgactacggcatccaggatgctggaagtatacgcttgaacctctggccccggctgagctccaagttcttacaacactttattcttggtatctcaatgagaagggcctccagactttaacataagtgatgtagcattcttgacttagttagtgaggggaatctgtgaatgaagtaggttgacattgatacagactgcttatacatgtcaatgaagggggattaaaagactttaacttaaggcttgaagaataaaaaccaggggtttttacttttttatatacacctcgggcttaagattatattgaactggagaaacggccatacttgcccatccg

SEQ ID NO: 595878 - DNA, 204 bp, Homo sapiens
  misc_feature (37)..(37): n is a, c, g, or t
  misc_feature (65)..(65): n is a, c, g, or t
  misc_feature (116)..(116): n is a, c, g, or t
  misc_feature (155)..(155): n is a, c, g, or t
taacattttatatttttgctttattttattttatttnattttttgagacggagttccactctgtngccaggctggagtgaagtggtacaatcttggctcactgcaacctccacctnccgggttcaagcaattctcctggctcagcctcctgagtncttggactacaggcgcgtaccttctttagtagagactggggtttcacca

SEQ ID NO: 595879 - DNA, 353 bp, Homo sapiens
gcggagcttaaacaccgcatctaaaggaaagcagaaagcctcaatattatgggttataactaaatatatggaacaatttaatctatttaagtgagaatttaaaaagtaaaacatttataggagaatgtttctgatagaaatatattttttacaaggaataaaaccagataaataactgaccaaatagctgatatttggccaggcatggtggctcacgcctataatcccagcactttgggaggccgattgagaccagcctggccaacatggtgaaaccccgtctctaccaaaatacaaaaatacctgggtgcagtggcatgcgcctgtagtcctagctatttgggggggctgag

SEQ ID NO: 595880 - DNA, 158 bp, Homo sapiens
ggtcgagaatgaagtgtgaggcgtatataccatagccgcctagttgtcaagagtactgcggcatgtactattgacccagcgatgagagcttcgacatgggcttaagggagtcataagtggagtccgtccagaggtatctttactatactacattgtga

SEQ ID NO: 595881 - DNA, 115 bp, Homo sapiens
cgcaggcagagctgctggagacgagctggggagcacgccagagccgctggagacgagcttaatccttacttctttctctgcaattttcttctgtttatctgtctcttctcttgta

SEQ ID NO: 595882 - DNA, 1555 bp, Homo sapiens
  misc_feature (22)..(22): n is a, c, g, or t
  misc_feature (25)..(25): n is a, c, g, or t
aaagtgtcgccatcatgagcangancgagactatcaggatccggagacggaaatgtccgaaggccgcagtacttgaccctgtattttgggagtcgaacggagaatggaaactgaaagtggaaatcaggaaaaggtaatggaagaagaaagcactgaaaagaaaaaagaagttgaaaaaaagaaacggtcacgagttaaacagatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgaggtaagtccagatcctaaaaaaaaaaaaagaaagaaaagaaaccaagtattaaaatagtaacttttgcaatcatttcagtttcttaacaacccaccagaagaagcaccaagaaaacctggcatatttcctaaaacagtgaaaaataagcccattccagccttaagagttgtgggtgagtatttttcaatatttaaataggtgtagttgaagtaagatgaactaataatgatggcacttttacagaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagatatagaaatctctactgaagaggaaaaggatactggagatctaaaagatagctctctcttgaaaacaaaaggaaaccatagaaaaaaccataagagagacataaatgcgagaagaagtataccattaagagtgtatcaagagcgatggtgggtttgacacaagttttagcgtacaaaagctagctgcttcttaaaaaagattcccaattaatccgaggcggattggacgccgtgggtcccaaactgggtgaaatggaaaacgccgggagggtgccccggaatatgtccggccttcgttggtggtgggatataaaagcctctgcggaaacaggtttgcgccacatttgtgtaggaagctcatcactcagggtaaaaacaaactcgcaatgggcggtgccacacatatag

SEQ ID NO: 595883 - DNA, 1129 bp, Homo sapiens
  misc_feature (1129)..(1129): n is a, c, g, or t
cgacaaacggcttgtggaactgttggcaaacagtgttgcctctatataaattattcggaagaaataaagtctaatatacagcgtctccacgaagcatccgagaacctgaagaatgtaccattacttgattggcaaggcatatttgcaaaagtgggagactggttcagatcatggggctatgtgcttttaattgttcttttctgcttattcatctttgttttaatctatgttcgtgtctttcgcaaatctcgcagatcccttaactcccaacctctgaacctagccttatctccacagcaatcagcacagctccttgtcagtgaaacttcatgtcaagtttcaaatagggcaatgaagggactaacaacccatcaatatgacacaagtctactttgagaatatctgaacaaacagcagctgcagacaaaaagccttagctaaactttgatgagtaaagcaggtcttaccgagaattcagctgccaaaaccctcctctgagtgttcctcttataagggcacttagcactaggacctcccaaggtattgtaaataagccttatcagaactttttgtagtttcattctgaagccttaagacacacaccataaagctgatctgtaaacccttaccccttgctgttcagagagctactctttgtagtgttcttgcatgcatatataataaatgttttttctattgatctgttaaaaaaaaaaaaaaaaaaaggaaaaaaaaaaaaaaaagaaaaacaaaaaaaaaatagttgtttggcgccagcctacggagccccgctagaaagaaggttttttgaaagaaccacttgtctgtgtgggaccgcgcggcgaccgcagacgaggaggtaagtcgcaccaagcttggtgggcccacaagcgggtgttacccgaaaagaggaaagaacacggggggcaagaccaacacgaggcgcggtggggatgttctccccaccaaaagttaaaaaaaacgccccccgggggggagaaaccacggacgcgttgtagggacaacactcacagaaagggggaatcgtgaggggcaaacaggggggccaccacaccaagggggctcccaaagagagagccgaaaactaataacccccgcgcgggagggn

SEQ ID NO: 595884 - DNA, 350 bp, Homo sapiens
  misc_feature (63)..(63): n is a, c, g, or t
agaggatccccgaactctggcggccctttctttttttgaaacagtcttgctctgtcacccagngtggagtacggtggcgcgatcttggctcactgcaacctcagcctcctgggtcaagtgattcttctgcctcaccctcccgagttgctgggattccaggtgcgtgccaccaagcctagtttttgtatttttagtagaggtgggatttcaccatgttggccaggatggactcaaactcctgacctcaagtgatctgtctgccttggcctcccagaagtgttgggattacaagtgtgagccactgtacccggcaccactgttgtttctaggcttaattaatttgttgtggc

SEQ ID NO: 595885 - DNA, 217 bp, Homo sapiens
atgaaaatgacgcccagttaagattcagacgctgaatcaggttggtatccgacatttgctggcacagtgctttagatttggtttgaaaccaaaaagaaatgtaattgtcacaaaagacatttaaaacacttttttgtgacatgtttgtgttcttgataacgagtagaaaagaatgcacaacatctacgttatgctaatttggtacacttatcattgt

SEQ ID NO: 595886 - DNA, 1533 bp, Homo sapiens
ggagagaagcagtagtcaataaagagagtgccgtatttcgcagatggagctgagctgtggctgccagaagatagcgaacgaatggaaactgaaagtggaaatcaggaaaaggtaatggaagaagaaagcactgaaaagaaaaaagaagttgaaaaaaagaaacggtcacgagttaaacagatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgaggtaagtccagatcctaaaaaaaaaaaaagaaagaaaagaaaccaagtattaaaatagtaacttttgcaatcatttcagtttcttaacaacccaccagaagaagcaccaagaaaacctggcatatttcctaaaacagtgaaaaataagcccattccagccttaagagttgtgggtgagtatttttcaatatttaaataggtgtagttgaagtaagatgaactaataatgatggcacttttacagaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagatatagaaatctctactgaagaggaaaaggatactggagatctaaaagatagctctctcttgaaaacaaaaggaaaccatagaaaaaaccataagagagacataaatgcgagaagaagtataccattaagagtgtatcaagagcgatggtgggtttgacacaagttttagcgtacaaaagctagctgcttcttaaaaaagattcccaattaatccgaggcggattggacgccgtgggtcccaaactgggtgaaatggaaaacgccgggagggtgccccggaatatgtccggccttcgttggtggtgggatataaaagcctctgcggaaacaggtttgcgccacatttgtgtaggaagctcatcactcagggtaaaaacaaactcgcaatgggcggtgccacacatatag

SEQ ID NO: 595887 - DNA, 174 bp, Homo sapiens
gtcggtcccccctgcttctccccaggctcacatcttgccggtgctgggtcagctctgttttttagacaggttctcgctctgtcacccaggctggagtgcagtggtgcaatcacagcttgcgtgctgcctcaacctcctggattcaagtgatcctcctgcctcagcctccggagt

SEQ ID NO: 595888 - DNA, 142 bp, Homo sapiens
tctatgaaacgagtatatgagcgattctgtcgtggactaaaagaagtagaacggctaatcccagaacgaggctgggagtacatgtggaatgagcgcctaggatacatatttgacctgtccttcggaaccttggaacaggact

SEQ ID NO: 595889 - DNA, 900 bp, Homo sapiens
gggtctcatgatcatctcgagcgtcacgggaggttccagaaggtgactatattcatggtcactctctcgtagtcctccgtgggtaaccttagtacactgtatcttcgccggtttcgcaactactgtgcctataataatgacacagacgcacgtctgtctgagcaaggccgaaattgctgtccatacgtattagagctgagagagtattgttgattgacagacaattctacgaggctggacgtgagcagaatgcagagttcccagttactaactacgtcttgtgacttaaccgaattctttttctgacgaaatgactttttactaagcaaatggggtgacttctttaaatggcttttcttaacgttgacaggccacaacagttaaatggctggtattggtgtgctattctggtgtgctgcacatgtttttggataaagctttaagcatgtcctgctactaatttgggcggagagtgtttgccaggtttcaatgtgggctgcagcttttgtgtgctccttctctggtttgcagtgtaatgagtcataagctaaatttccagaacgattcgtttaagattatgcctcttatctacttgagagcacatgtcttttcactcatggattgcacctgacaactcaagtatttcttaatcgaaaacacaaaacagcacacaaacaaaacacttgctggggccacgggccctagaaaaagttctaacacactctggtaggcggcgggccagaggcaagcactggcacgggtccaaggaccctggcggaagcggtgtcccaaaaaaaccgggcacggcgctgaaccaggctaggctagcataagacggacccacagcgcggtaaatacagagcacgaacacacaagacgcagccacgagcgacacagaag

SEQ ID NO: 595890 - DNA, 344 bp, Homo sapiens
gtccggcttaggaggtatacaggcacagaaggttgacacggcagttctcagacagagtctggatttttgtttttgtttttgaggcagaatcttgctctgtgacccaggctagagtgcactggcgcaaccacagctcactgcagcctctacctcccaagttcaagcaatcctcccacctcagcctcccaagtagctaggactataggtgcaaaccaccatgcccagcgtaacttttttttttttccagattttgggaatttttggcatttattttccttatagtgtggcgtgagacatctcccttaatttcgaaaatctccagatattctgaagtgtgacatttc

SEQ ID NO: 595891 - DNA, 952 bp, Homo sapiens
  misc_feature (675)..(675): n is a, c, g, or t
  misc_feature (722)..(722): n is a, c, g, or t
  misc_feature (744)..(744): n is a, c, g, or t
  misc_feature (752)..(752): n is a, c, g, or t
agagaaaacaatgtgtctagagtagttgaaaatgggttatcttgtgtctcattttcaggccagttcttcaaccactaccgtttagggtctgtcttgcctatctatcgtaatgatatgaatatgaaattctttgtctttcatatagggtcaatgcaaccaacttcatggaggcaggagccccagttatgtggaatgggcacagagcaaggctgctggattccagtatccagcgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtggttgncttcagccagtcaatacaaatagatttttggtttttgttggtcctgnagccccagaagaaattaggggnttaaagcngaccagtcacactggtttcggccttgtcaaagacgaattctctggatccgaacaaaacatctataccgcggtcacagaaacggttggaaaattccacaaaacgggacaaaacaccgtcacgactgtaccctcctcataggccaccgtcattccggataaaccggaaataaagtctggctccaatcgtgagtatgggcttt

SEQ ID NO: 595892 - DNA, 977 bp, Homo sapiens
  misc_feature (28)..(28): n is a, c, g, or t
  misc_feature (32)..(32): n is a, c, g, or t
  misc_feature (53)..(53): n is a, c, g, or t
  misc_feature (579)..(579): n is a, c, g, or t
  misc_feature (626)..(626): n is a, c, g, or t
  misc_feature (648)..(648): n is a, c, g, or t
  misc_feature (656)..(656): n is a, c, g, or t
ggacgaggggccgcaggggagacagttnagtnttggaaagggctggcggggtncatgccaccaacttcatggaggcaggagccccagttatgtggaatgggcacagagcaaggctgctggattccagtatccagcgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtggttgncttcagccagtcaatacaaatagatttttggtttttgttggtcctgnagccccagaagaaattaggggnttaaagcngaccagtcacactggtttggtgaggtacaaagggctctctttgatctggacaaaaccattttttccacttcactgaaacgactgggatattacaatacccgtgcagaaacagcgtacggacttagactccgcttggcggcggcccaagccgatgatttctgaatatggcccggggacgaacggtggaacaagtaatttgagaccctctccgtttcagaatagaaggggtcattcttacaatattggaacgcgaaccatttctttttccaattacacaggaggtacgaccttgattaagaccaccaacctccacccccccgt

SEQ ID NO: 595893 - DNA, 1497 bp, Homo sapiens
catgccatgcatgcacattgccttccattcagctgctgcattttgttgcaacagtcacaggcatgttatgcaaaaactcatgctgcaggccacaaggatgtcttcctgggccatgttttagtcatgcacatcatgcacagcacaggccatccggcattcactcgtgtcgtggctgctgctgcagcacttgcccaagcaccatcatgcacaacccacgtctcagcagcacagtgctgtgccggcatgccggatcctccatgcaatcgctcatgcgcacacagctgcttcgcatgcacattccacacacctacattgtcggcacagcagccgtccagcaattctcaatccacaaccacaacataggtgcacgctttctacgcagccagactctgcgagcagtcaccgaaatttcccagaaaatagtagctcatctcagtatcggttcaccaccccacatgcacaagtcacccacgaaaagtggtccacaattccctcactacttcttgtcaaacagtgtctaccaacgcaaacaccttcagtgcaacaagttgcggccagccaaaatggttgaggtcacaacaatcccatgcacagcccacaacacggacaaatggcccgtgcatgtcacggacaaggcaccttccatctaagtccgcgactgggaccccctggcacaccccaggagaaatgacaggagccctacaccactgcaagaaacaacagaccgagatcaacgcgaggcatcagcacgaacaaacccacagaatggacatgcacaaccaagcaaagccgcatcttgcgacggaacacacaaggcaccggaagcccccacgcgccactatctaacacagccctacagggggacacagcacagcgaagttgcaacaccccatacccgatacccccacaacgacaagcttacacacggcctgaacagcaccgattcacacacgctcaccacaaggaccaacgcactctacctctagcgacaccaagcccccgacgacaccggcgacaacgaacccaacacaacagacaacaaccacgcacgcgacaacaccagcagagagcgccggaggccgacgcaacaaacgaccccacacagcgaagagacacaccaagcgacctcaggaaccgctagtgcaagaagacagacagaacgagacaaccgcgagagcgaacaacgagcgcaccagggcgagccaaagaggagcgacagcggcacggcaaggacgagcagacagaagccaaggaacgcgccgaacaacgacagcgcaacgcaaacaagcagcagcacaccagacgagcaacgaccgacaacggtaccacgaagagcacaagcgcgcaggcaccagacaacaacgcagagcagcagagagccatgcacgcagcacaaaggagccgacgcagagcagacgaacagtcagcgcgccaacccgcgcacaccaacacaagcccgcaccaagcagcactcacagcagacagcacaaccgcgcg

SEQ ID NO: 595894 - DNA, 1121 bp, Homo sapiens
  misc_feature (675)..(675): n is a, c, g, or t
  misc_feature (883)..(883): n is a, c, g, or t
  misc_feature (898)..(898): n is a, c, g, or t
agagaaaacaatgtgtctagagtagttgaaaatgggttatcttgtgtctcattttcaggccagttcttcaaccactaccgtttagggtctgtcttgcctatctatcgtaatgatatgaatatgaaattctttgtctttcatatagggtcaatgcaaccaacttcatggaggcaggagccccagttatgtggaatgggcacagagcaaggctgctggattccagtatccagcgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtggttgncttcagccagtcaatacaaatagatttttggttttcgacgtcctgcaggccccaaataaactagcgggtttaagcagaccggacccgcgtgcgttgggccaagtacaagggacatttcttttgtctcggacaaaactctgatgagcagcgtgttaagaaggactgggaaaggataaataccgtctaagagacctggcgcgggcattancgctctcgtgtgcgntggagccatgttgtataacttcgcgaatcagctcggggacaaagcaccggaagagttgtctgtgaaacacgtgatctttataattaacgggccggattcgcgaaaatgttcatagagacacttgattctacaaagaatcgacgtaggggctcatgaggtgtatagcatgaccgtccattccccccacaattaactcgcggcgtgagcggacaaagttaacgag

SEQ ID NO: 595895 - DNA, 329 bp, Homo sapiens
accggcccctgtggattggttcaggaccctgaagataccaaaccaggatgctcaagctccttacataaatggtatagtatttgcagtatacctatgcacatcctccagcatactttatttattttattttattttatttttttttttgagacagaatttcactctgttacccaggctggagtataatggtgtgatctccactcactgcaacctccgcctcccaggttcaagcaattgtcctatctcagcctcctgagtagctgggattacaggtgtgagccactgtgcctagcctataatgatcattttaatgtttcccatgcactcat

SEQ ID NO: 595896 - DNA, 133 bp, Homo sapiens
tcaaactgctgcatcagtgcgccctctcccagaggaggtttgaggcgatccaccatgagctgctgcagtcagagctgaccgagctgagaaccacgcaggtgaagacagcaaaggagtctgaaggcagtctgga

SEQ ID NO: 595897 - DNA, 423 bp, Homo sapiens
tactgtgtccgcgagcagaatgatgtgactaaactatactcgtaatggcagaagtaacgaagtgattgtctgtaagatgaaaagctgtgtgtgcaaaagatgtgtatgtgatccaaagatcctgtgtctcttgcgggtaaaaagctgcgtgaccacatgtaaagagcggaaggaatccagattggcgaaaagaatcagtcattttgatatgataagtgataaagaagcatacccaaagggcaaaaattaccattgatagaagcattgacacttctcaactgatcataaggttttcccagaaacctggactgagtgagaacaatatttgcgggaatacacagttttgaaacaggagagatgtggactactgttcttaaaatattgaagttaggcttgaggaagagatcttcctttttgacgact

SEQ ID NO: 595898 - DNA, 518 bp, Homo sapiens
  misc_feature (465)..(465): n is a, c, g, or t
gatcccctaaactgacgcgatatgatcacccgccgctccctgggttttgctctacgtcaacttccagcagccggccgacgctgagctggctttggacaccatgacctttgatgtgataagtgaaagccaatccgcatcatgtggtctcagagggatccctctttgagaaaatctggtgtgggaaacgtcttcatcaagaacctggataaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtntatatcaaaaactttggggaagaggaggatgatgagagtctgaaagagctatc

SEQ ID NO: 595899 - DNA, 281 bp, Homo sapiens
cccccacgaaacctaaaacgggatacacacagcaacattcaattaaccatctactgatacactgttcacctactcgcattaaatctcaaaactatcattctaaatgtaaaactatacacaaagtatcgttatgcttctatttatttgaaattccagacaggcaaagcttacctaaagtaaaataaaaaaaaaacttgaacattgtttgtgtcttcaagggatggggaaaggactgacataggaaggagcatgtaactttttgaggtcatagcttttccctg

SEQ ID NO: 595900 - DNA, 960 bp, Homo sapiens
  misc_feature (675)..(675): n is a, c, g, or t
  misc_feature (722)..(722): n is a, c, g, or t
  misc_feature (744)..(744): n is a, c, g, or t
  misc_feature (752)..(752): n is a, c, g, or t
  misc_feature (960)..(960): n is a, c, g, or t
agagaaaacaatgtgtctagagtagttgaaaatgggttatcttgtgtctcattttcaggccagttcttcaaccactaccgtttagggtctgtcttgcctatctatcgtaatgatatgaatatgaaattctttgtctttcatatagggtcaatgcaaccaacttcatggaggcaggagccccagttatgtggaatgggcacagagcaaggctgctggattccagtatccagcgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtggttgncttcagccagtcaatacaaatagatttttggtttttgttggtcctgnagccccagaagaaattaggggnttaaagcngaccagtcacactggtttggtcaagttacaaagtaaatttctttggatctgaccaaaacactttattttcagtttccatgaaatgattggaatattaccaatacccgttaagaatcaaggggaggccttttacctcctcatggggcgtggcccactcctgatgatttttgcgaaaggaagtggggattgaaaaattggaaaatggaan

SEQ ID NO: 595901 - DNA, 337 bp, Homo sapiens
tcggccaatctgttacacaatctggttaagctgagtaaccttattttaagtctgcagtcttgctgcatgataagcagacgatatcttatcttctaacagcaactgtactggttctgtgaatctttctgagctttacgaaagtgattttgcagtgtatacaggtgctaattttccttccttaaactgcatcatctgttgatcaaaattcttcaacttctcatttaagatctgttttttattttcaagatccgattgagtttgacttacattttgcttcacctgtttaatttgttgttcgctcatcaattacacgttgttggtcttgtgtcaactgatt

SEQ ID NO: 595902 - DNA, 958 bp, Homo sapiens
  misc_feature (675)..(675): n is a, c, g, or t
agagaaaacaatgtgtctagagtagttgaaaatgggttatcttgtgtctcattttcaggccagttcttcaaccactaccgtttagggtctgtcttgcctatctatcgtaatgatatgaatatgaaattctttgtctttcatatagggtcaatgcaaccaacttcatggaggcaggagccccagttatgtggaatgggcacagagcaaggctgctggattccagtatccagcgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtggttgncttcagccagtcaatacaaatagatttttgggatttggcagctcctccactcccatataaaattttgggttaaatgcacacgttaccacctggtttggccactacaaagtaattttctttagactgggataaacctttatattccattttatgaaataacgtgatattttacaattccgttttccattcagtgctaacttttaacatccctattggctgagttccatgctaataatttcggcaataagaacccgggataatccacaaacgacaggaaattgat

SEQ ID NO: 595903 - DNA, 949 bp, Homo sapiens
  misc_feature (675)..(675): n is a, c, g, or t
  misc_feature (722)..(722): n is a, c, g, or t
  misc_feature (744)..(744): n is a, c, g, or t
  misc_feature (752)..(752): n is a, c, g, or t
agagaaaacaatgtgtctagagtagttgaaaatgggttatcttgtgtctcattttcaggccagttcttcaaccactaccgtttagggtctgtcttgcctatctatcgtaatgatatgaatatgaaattctttgtctttcatatagggtcaatgcaaccaacttcatggaggcaggagccccagttatgtggaatgggcacagagcaaggctgctggattccagtatccagcgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtggttgncttcagccagtcaatacaaatagatttttggtttttgttggtcctgnagccccagaagaaattaggggnttaaagcngaccagtcacactggttttgggcagatacacaagtaattcttttgtcctggacaaaactttatatgaggttaaagaaagaatagaatattacaatacccgtaagatacaggggaggcatttaactcgcccttgggggggcccatgctgttattttgcaaaaggagtgtgatgagataaggaaaaaggaaatttaaag

SEQ ID NO: 595904 - DNA, 187 bp, Homo sapiens
  misc_feature (40)..(40): n is a, c, g, or t
  misc_feature (109)..(109): n is a, c, g, or t
taccttcccccatttttttttaaagaaccataaagaaagnccaattcccccagataggctatagcttaagaccaatctcccaaatcattttccattaattaaaactttncagaggctatagataataattcttattatcctttttacctgtttgcccaaagagagaagccaaaagctcaactggtta

SEQ ID NO: 595905 - DNA, 345 bp, Homo sapiens
  misc_feature (76)..(76): n is a, c, g, or t
ggcccccccccccgcccgggtgattttttttttttaggaaaaaagggggttcccccgggtgggccgggtgggttcnaaatcccgaccccggggattaaccccccccggccccccccagggttggggtttccggggggagctagcctgcccggcccggggtttaaaaattccaacctgttgggggggcccccatatgccggttattttgggaaacccggcccctttttattaaggggggggggccattttccgggggccaacccggtgggggatctggtctttttttccggcccccttgggaaaggttgcctaataaataaaatttttccggtttttttaaaggga

SEQ ID NO: 595906 - DNA, 99 bp, Homo sapiens
gatgagcgagtcggtgctactggacgctcgggtcggtccggggtggcgcagcgggactgtacctgggtgtccggagcggatgccgtctgccatgggcct

SEQ ID NO: 595907 - DNA, 288 bp, Homo sapiens
  misc_feature (53)..(53): n is a, c, g, or t
aagcaatcctgcctcatcctcccaaagtgctagaatacagggctacttccccntgccctgtgcccagccctcttaaaatgcttttaaaagctgttgtccattttaaaagctctacatatcttttcaatatcaacccaattgtcaatctttgaaaccaggtgtagggtccttggggcaaggcagaacctcaaacctagcctaaactgtttttccttgccacccaacttcaggcatatgtttgcagtatgatactttgagccatggacagtggcatcactgctcattatc

SEQ ID NO: 595908 - DNA, 266 bp, Homo sapiens
tagcgcagtagctcacgtggatccccccaatactttgatggcttcacctgctcatacaggtcacagtgtctcaactgaaatcactacgacataggggtcattcttgtcagctggccacttcgtgcaattccaggtcgtgactgaaacacccttctcgccatagtgtaatgcacactccattgcattcagcccgctctcccagtcctcacagtctggttttcttgatatcctagaaggaagattcggccacctccttatgatacacg

SEQ ID NO: 595909 - DNA, 415 bp, Homo sapiens
ggggctctattagcgtctgaagccctctcagatgttgggctgaatgaaaaagaaggcgctgatgttacatattcacgtcatcgtgcatgaatgtacatgagttaatcatatatcacctgagaaagtcgctagctccagaggatcgtaaagaatggcaaagcagcagcttatatgggaaagaacaacgtgctttcctaaggtatcatggctgatgtacacacccatgatcatactggatgggatctcttgatcaggcgtcacttactacgatcctggatactccagtcaaaccaatgaatgatgagcagtatgaccagcaggtagtgactatgtggtggtaccgggataccttggatgagggttcggaatttcactggaaccatagtagaggtccgaggggtcgtattagctgtgt

SEQ ID NO: 595910 - DNA, 897 bp, Homo sapiens
gaggatcaggtgagtggtgcccgatcgatggtacgaccgaagcgtgtcctggcccgggctccgttggtcccctctgccagcatgttctgtgcggcgaatgcgtttctttgcggtcccccaccgttcttatgtgcccccctgtcttgcggcctcccgttgtcctcgcctcccgtgtggttctgcccctccgcgccgtctatatgggctgtgcccaccttgaccttatcctgtggccggtgtaaccccggtggtacccttacgggcctccgacccacgcgtggccaggccctcctacgggatattcttgtttaactcagaagcttcttctctgcgacgaactgtttgggagcccttattacactattcgagcgctgttctctcccccccctttggggcggctggtcccccacaggaatctcccccgttcggctccccttgtggtccccgccgcttcgtagcccacccgtgccggtgcgtgccccccgggtgttctcacatccccgggcggcgccccaagtgtttattatggcctagcgcccgcgcgtcccccaagtgttcaggccccggctgtcgcaaccatttaccgggtggctttttactcccgcctctacgccgttctcggtgctctggggtgtccccgtacccatttcctgccgatattactgggcgccaacacattgttggtagaccaccaccagcttcccgaggactgcctaagtctttttggggccgcaacctttccctattatcgtgctggtatccgccccgcgatagatgtgttccgccttgagacttaggcccaagaccagctcattgggttgtgcatgagccccccctattggcctttttgaaaggggttatatttttgattcccctttttttgggggcccacataaa

SEQ ID NO: 595911 - DNA, 332 bp, Homo sapiens
gcccagatcatgtctcagcatctcagccaatgggacagtagatgtttgttcattttccaggtcagtgtcaagtggcaaatctagaagctgtatctggagcacttctagtaccagtctgatcttagtaaaaacttcagcatggtgatgcgatattccaaggttagtcagtgatagattcaacaacgaataataactatgttaggcgtggcttactatcacagcatgaagggatgggcacgatgccagcggcctaaggatatacttcagcagcatctgaccaagtgattaagcttgcagtgtagttctccaagaacagaaaatgccaagaggac

SEQ ID NO: 595912 - DNA, 460 bp, Homo sapiens
  misc_feature (85)..(85): n is a, c, g, or t
tgcttaagcctccggagtagttgggattataggcacccaccccccacgcctggctatttttgtatctttagtagagacagggttntgccatgttggtcaggctggtctcaaactcctgacttcaggtaatccgcccaccttggccccccaaagtgctaggattacagccaccgtgcccgccggggataaacatttttaaagctcttcatttcatgtagattatattaagggtctgttatttatgtgaagtttatctctttatggagaatcacaccacctcagaaaatctacactcttttacagaccattatgaaatatgtggtctcatgatagaatattataatcttcatagagtagatggggttgcagagaaatcagacatctgaactcttttccctttattacaatttacttgctctgtggcctaaagcaattcactgaacaattttgttagaaaact

SEQ ID NO: 595913 - DNA, 1581 bp, Homo sapiens
gataccagaggtgccagatgtggcagcggtgccacaatgcagatggctggacgattctgcgctacgagctctatgtgcgggcggggccgatggctcgggccgcatactcgcgagcgcactcagcgtctgtgtttgcagcacctcacgcagggcacttctgctaacacggatggggcttgtgtgtggcttctgttcgtatgcgtcttatgtcgctctggtccggtgcacggggccctgcgtcgtcgggccgtggctgacgacagcgtgtacacatcaagagcagaagggcactgcctgggtagacgtcagctcggacgcggggcctggagacggaccgttacgaccctgatggaaccctggcccgccaaggggacatcctcacagggcgtccgaagcccacggtggcagggcttgggggtcatcgcgcgactgtgggccttgccctcactagggggggtgggccggctcgtggacggtttaccccagggaagctggttgcgctgtgttaggtggcggtgacctctgcttgcccaggtggccttagcgccgggagagtatgcctctcttgcggcactgtgggcgccttgaacgccttatcttgagcgaatggccaaggacgccattgaggacggacagaacaggcgcttggggaggcaccattccgggtagggagacccccgtgatgcaacgggcgctgttcccggcgaccgcaccgttgttcattttgacccctggtttggtcttggcgatgggcatccacttttgcccgaggcataggcgtattggaagcgcctccaacgtgttggtcaagggggggcgaagagaaaatggcactggcaattggcgcaacggcggtggagatctgcggaaccaaccatcccaggacgacaacggctattgcgaaacgtgctgtgggaacaacgcgaaggacattgcgatgaagatgccaccaatgggtgtgggggcacctcaacttcaaaattcgcaacgcgccaagggggaaggtcaccacgcatgatgagaaaggctatgcacagacacgggggggaaccgtggttgggcagcgcgaatacaaacacccggtgaacgcacgcaccaaaggggggccccggtagcctagtaaaaggggtacgaggggggcgcgattggtagcgctgagggcccgcctgagacaaggtccagttgggccgccaccatcgaaggatagacaaggtgagaaacagatacccaaaaaggagtttgcggcacagcgacatggagttagcactcaaagagctacaccggggcagcctcaacacacgcgaacacagcgaataggctcgcacaacaggcgacactgctggggaacactaggaggcaaaggggaaaccccaaaagagagaaacccatgcacacagagggaaatgagccataagaggcacacaaaccacgaggaacccggaacacaccacgagccagacagcagcaccaaaacagacaagacaacagactcaacacacacagaaggaatcaaaccatgacaacaatggtccacgactacatctaacccaccaacgaacagatggagacgcacacaccgaa

SEQ ID NO: 595914 - DNA, 605 bp, Homo sapiens
agagcaaaagctcctatgcagaggaggggtgttctctgactgtgacaaggccacagagccaggttactttagtgactgtcagcggcagtcttcccaaagatgatggaactcttgctggactcagtggccttagaaccattaatgggccaactggtggtgatcttgctgacgccttagactaacaggccggggctcaaggaatcggagcgcatccctgaccggggaggtgacccttgggaccgcgctattctaacgttctgaggctggtactaccgacatcgattccatctatgaaggaattgacttttattcctcaattatcccgaccccgatggggagatcggaacgctgacctgtgcccgggcaccctctgcccatctcagaccgcccttggagatgccattctggtcaggtaacagatccatgatagtgccctgtgtggaggtgctcactgaatccccaagagacacaatctctggcaacactgcgccaatggatgagaacagtgtaggagcatcaaccctgatgaagctgatcgttattgtgcacatgaccaagcacccatcattggtgcagacaggcttgagacttgacaagattatctg

SEQ ID NO: 595915 - DNA, 130 bp, Homo sapiens
tggtattttaagaaaagacttggtttaaccaggtgggccgggcgggtctcaaactcttgacctcgcaatccacttgcgtgggcctcccaaaggggcgggagataacagggggtagagccaccattgccaa
